United States Patent 9,328,346 (POLYCOMB-ASSOCIATED NON-CODING RNAS) - sequence listing, part 145

SEQ ID NO: 192299 - RNA, 40478 nt, Homo sapiens
gucaggugacgcgagacccagccggaagugaaggaaaaagcgcuucagcccgcggcgccugcgcagaacgcuccagacgcugagaggcaggaggcacuagggaucguccgcaggauugggacugauacagaggccgccacggagcccgccggagccaccguuccugcugcugccgccgcugcccgaaucggaaccgucgggccgcagccgccggcaaugccgcgaaggaaggugagaaacgggagaggagggauggcggguuucuaaggacagucgauugagcaccgugacgcaguuggccacgccucacagugcuugggucccaacuuuccgcucccccgaaccuuguucagcuacccucucuucuguccauacccaacagaaaaaugugggcccgacccuggccucggccuaugcuugcaacuauucccgcccucugcuugccuggaucggaggcguucuuauuaauuggucgcugaaacgucuggaagcauauugauuggcuggugacgccgccuguuugggcucaacggucaccuccccgcgugcgggggcggugucuggccccggccccagcgcucucccacuggcuggagagaacgaucccuccucuccugauuggucgagguuggcagucuguccugugggggcgcggcuuaggcggaccucgauuggguggcccgaauccccgccuuuccgagcggggacgcugauaggugcagaggcgggguuuuggaggccucguuaccuuccaggugaggggcacaacaaagcagaagacuggguggugggaagccagcgcccacucgcaggggaucccucucaggccaguugccucuuuccuuauuugcuaguucgacagcgccuagaaaaugcaguugguaaaaacuaaaaacuucuagaauuagaaggcacuuagaagaucacccaggaauggccccgucguuucuucuuacagcugaacuaacggaggcccauggagugccgcaagccacucaggcaguggcagauccagaauauagaacaaaucuaacucaauucaacaaaugucuauugacuacuuucugcgcggugguugcuguggauucagaaauuaauuagaugugaucccuggcuuaagggugucacagcccgauaggagaaaacagacaugaauaaucuuagaaggaucuaguaaguucucagcuuggagguguauacaagguguugcuggaaggaagugaaggagcaguuaagucugcccuggaguacaaugggagauauauugguaaaagccacagagaagagcugaguuccaggaucaagccaggaaggaauaagucucacgucaaggcuuuaaauaucucgguaauuagacuauaauggugacuuuuaagauucccccuucauuucagccguuuucugugauucuugcucauuuccuggcagguuacccuuaagauacuuggaaaacugggugguauucuugcucauaucaauagaaaucuuucucuucacagcggcuuuucagguugaaaauguacacuuuuuaaugucuccuaaaaugaccucagcuggugggugguauguauguguuuuuuuguuuguuuguuuuugagacgagguuuugcucuuguugcccaggucggagugcgauggcgugauguuggcucacugcaaccuccgccucccggguucaagcgauucuccugccucagucucucuaguagcugggauuacaggcggauuccaugacgcccagcuaauuuuuguauguuuaauagagacgggauuucaccauguuggucagggugguuucgaacuccugaccucaggugauccacccgccucggccucccaaaguacugggauuacaggcaugagccaccacgcccggccggugguauguauguaaaggcucaccaaaugcaggaauaauauuggugccuugaaauagggccacaguccucuuucuuaauuucccaaauaccgggaguuacuugaaaauguacauuuuuuuaguaaccuguuuggcggcaaaccugucuuaaucuguccugaggcuacuuaugguuuuugugugucucauuuagugugacuguuuauauuuuuugcugcagaaauacuauuauguuuuguuauugggugguauuugcaggauacaugcaaaguacuccccuucuaaaaauccaaaacaauuacaaauucuaaacacaacuggcccucaggguuuugaauaaauaauugggacuuacagugugaaucuuuguauuguuuucaguaaauauuuuuuccuuucugguuuuguaaaggguauaguguuagugcuuaauugauaaaaguuaucuuuauggcuaagaaagaacuccucaggaggauaauaauugacaaauccuugcucauugaaaagaugguuuugaaaacaacuguuuuugaauacccaugagucuucaugugcaagcugccuuuuuggaagauagauggcuuucauguggagaaacgucaaggauagauggcauacgcacuaacaauuuucaucuuuuucugcuuaaauucuuuugggauuagaguugugguccaugauauuuugagauaguguaugguuuuuaaaaaaugugauagcuuuucauggagacauugaacaaaagcuacucuaaguuaaaugagguccagcaccaacgauuuucucacuacaguggaccuuuuuuugugauauugaucuccaaauggucuugguuaauacuuaguacuaauacaguaagaauuaauucucuucauggccgggugugguggcucacgucuguaaucccagcacuuugggaggccaaggcggguggaucaccugaggucagguguucaagaccagccuggccaacauagugaaaccccgucucuacuaaaaauacaaaaauuagcugggcaugguggcgggcgccuguagucccagcuacucgggaggcugaggcaggagaaucacuugaacccgggaggcggagguugcagugagccacgauugcgcccuugcacuccagccugggcaaugagagcgaaugaaacggaagcucuucauuuauuuaacaaaauucccuauuuguagguuguuccauuuaaguguucuaaauaaagugaaguugccugagggggugggaggaugagaaaugcuuguggaauccuuauuuagguuugaacuugggguuuucagugucacagcuuguuuuauuuucaauguuaaugcaaacucucagaccaaaugcuucugugcuaauaucuggaucuaugguauuacagaggaaugcaggcaguaguucagauggaaccgaagauuccgauuuuucuacagaucucgagcacacagacaguucagaaagugauggcacaucccgacgaucugcucgagucacccgcuccucagccaggcuaagccagaguucucaagguaaaaaaaccuucauuuuuccuuaccacuccucacaucuggcugacuggcccaucacauuauuuuccuaguuaauguggaaacuggccccuuggcuugguguagaugacagugcaccagaugauugguaaaauguagagugaaugcagaguugucaggucuuuaacaaugccucuguggggggcuacuauccaaucuguagacccaaaggaacugcggaugguauaauggauagagacacacguaugucuugagucauuuguuuguuuguuuguuuguuuuuuuagaucgcagugucuccaucaguaaaauuggaauguuaucccuucacuuucuguuugaauguuugaggcuuagggacuugaaguccagaugguaucugauuuaugguggcuugauuuaauuuuuuuuuuuaacuuuacaguggugcuaaaacaauaugcauucaguggaaacuuuuagaauuuugaauuucggucuuuuccugggccagugauaugugggccaaauauuuucucauguugcugagugguggcaaugagccauaauaacuccagucagugagccguaacucccagucagccauuugaucaugaggguaaaccaguacucuucaguguacugucuuuaauaaauuauaugcaauauucaacacuuuauuaaaaauaggcuuuguguuagaugauugugcacaauuguaggcuaauguaagugguuugagccuauuuaaaguaggcuaggcuaagcuaugaugcucgguagguuagguguauagcgguuuuuuuuauuuucuggagacagggucuugugcucuguugcacagguuggagugcaguggugugaucuuggcucacugcagccuugaccuccuuggcucaagugauccucccaccucagccuccugaguagcugggacuacaggugcacgccaccaugccuagcuaguuuucuuuguuuuuuguagagaugaggucuuauuauguugucuaggcuggucucaaacuccuggacucaagcaguccuuccaccuuggccucccaaaguacugggguuauagaugugagccaccauguucagccuguaaaugcauuuuuaacuuauaauacuuucaacuuaugauaguuuuauugagacuuaaccccauuacaagucaaggagcaucuguagucucuuggacuuacucuuggcagaggcccacuucuaaaaccauguuuaacucuggaauguaauccaauaaacacuugauagauauuaauaguuguaccaaaauaucaguguggaaauaauggaauuuugcuuugguaauaaggaauugagaaucuugggguuggaagguaguuugaacuaucucuagugcauuuaggcaucugggguuagauuuggaggguacccuugacccuccuggcucugcucugguauucccugaggaggaaagaagguugcagcuaauacagaaagccgaugaucaacaggugauaauagaugaagggaaaaaaacuuuaacauguuuugagcacuucaacaguguugcuuugguuaauuuuuuuuuuuuuuuuuuuugagauggagucuagcucuguugccaggcggagugcaguggcaugaucuugguucacugcaacuuccgccuccuggguucaagcaauucuccugccucagccugcaaguagcugggacuacaggugcacgccaccgugcccagcuaauuuuuguauuuuuaguagagaugggguuucaccauguuggccaggauagucucaaucucuugaccucauggucugccugccuuggccucccaaagugcuuggauuauaggcaugagccaccgcgcccugcugcuuuggucacuuuuauaugaguauguugcacaaugagagaaaaaccaucaguuuuucaagcaagaaagugggaauauccucuuuaacaacuguuccuaacuuuauuuuugaauuuaggauuucagcuaaaguauugcuauugucucuugauuucuuaagcuuuaaauuuuuaccacaaugagacuauggauaaauagcuacuauaacucaagcaguauguuauguacuaggaaccaugauagaaaaaucauaguuccuguccucaaagaucuuacaguucagugcaagauacagauaugaaaauugaucaugggaauacauuauggcaagggcugugagagggguuugcauagaguacuacauaagcccagaggugggacagccaacuuagggcagcacucccacaaugaugaagucuuuuuuguuguuguugagacagaaucucgcucugucgcccaggcuggagugcaguggcaugaucuugguucacugcagcuuccgccuccuggguucaaggaauucuccugccccagccucccaaguagcugggauuacaggcgagcaccaccauaccuggcuauuuuuuguauuuuuaguagagacaggguuucaccguguuguccaggcuugucuuaaacuccugaucucaagugaucugcccgccucggccucccaaagugcugggauuacaggcgugagccgccgugcccagcugcacacugagaugucuuaaaggcucugauaggaauuuacaaguugaaagaugggaauauguuauucucggcagauggaacagcauaugcuaaggaaaagacauaauguuuguaggaaguauaauugaccaugcccuagacaccugaaaacuaaauauucaaaacagcuaggaaaugcguaagcacugagucucuuucugguuaucauaccucaugaccacagaguugcacaacuccagggguaccauuuacaaugucagcaauguaaggugguccucccuagagcacaagguagaucauauugugaaaggaggccccuuggagauguacaaauggauaaccuugcucugugcuaacuuuucucacccgaaaguuuggaaauuuucaguuuucuucuuuagagaaucuauaagauuucuucagauuuuuuuuuuuuuuaaauauacguuggggggugcagccgugagagagugaggcugacaccgcgcccuggccugugcaucccgcccucugaaaaaaaaauuaauuaauuaaaauaaaauauacuuuagagaggauuuugacuguucucaccacaaagaaaugacaaguguuugagauauggauaugcuaauuauuuugauuucaucauuacacaauguauacgucuaucagaacaucacaguauacucuauaaauauguacacuuacaugucaauuaaaacaaaacuaagacugcuaggggcuuacacggagggaauugagccagcaucaccacgaugguguuguuggagagugagcaguuccugacggagcugaccagacuuuuccagaagugcuggacaucgggcagcaucuauaucaccuugaagaaguauggugguggaaccaaacccguuccaaagaaagguucuguggagggcuuugagcccucagacaagugucuguuaagagcuaucgaugggaaaaagaaggucagcacuguggugagcuccaaccaagugaauaaguuucagauggcuuauucaaaccuaccgagugcuaacauggaugggcugaagaaaagggacaaaaagaacaaaaguaagaagaccaaagcagcagcacaguaaagggcacaaauuuccugcuuucaccaauuaaccacugaauuguuauuuuuuccuuugguuuuuacuuuuggccacauagcuagguuucugguuccccuacacuagguguuuucacauaagauguaggguccuuuugcaaagaauaguugcaauguuuauagggcaguugugguaagaaucuaguuuauuuuacauuuggcuaauuggucuguacugcaugguuauauacuccuggauuauagauuaaaagucucuguagucaucucugugaagagcaagcuaugauuaaacaugucucuuuauaaaaaaaaaagcacaaaaaaacuaaaacauaucuacauauauuuuuuaaaaaugcuuuaauuucagcuuugaauuuuccuucauuuccuuuguccucagguuggagauauaaaagggcugcugagugccucagaauagguuuuucuauccaaaaaacuuaaaaugcugcauuccugcuuuaccuuuaugaaucuauuaugacagugccagagaggguaauaagaaagaaaaaaaaaucggccccuuaagaaaggaaaucguuuuguuuguuguuauaucuuugguaauagaauaucuguuuuaugguggguuagaaaaagggaagaaugagaggaugcaguuaauauuuauaaagcacucuguaccacggaucauguuaagugcuucacaugcauuaucucaccuauuccucaccacaguguuaugaggaaugugcuacuaguauuuuccuuuucaauaggucaggaaacaggcuuggagaaaauaacuugcccaagaugccacagcuaguugguaugguggaguggaguugaaucaaguucaguccuaauuccagaaccuaaacuuauuaaugcuguacuacauuacaucuguauaccugagcuaggcucuuuugcuuauauuuuauuuaauuaaauagauauuuuaaggauuuguuggauuuugugaaauaugaagaggaggaggagcgauauucugauaaauuauauggauaggaaguaaaacagauuuccaucuuuuuucuuuauuuucuuuuaaaauugggaucagauuccaguccuguucgaaaucugcagucuuuuggcacugaggagccugcuuacucuaccagaagagugacccguagucagcagcagccuaccccagugacaccgaaaaaauacccucuucggcagacucguucaucugguucagaaacugagcaagugguugauuuuucagauagaggugaguggguaugguaugacuuagaccuauuacagagcaucugggugaaauucuuuuuaaggagggcuuggggccacugcagguagaugccuaauacuucagcuagaugaaugcuguuugcuugcuuccuuucuuaugucuuuuuuuuuuuuuuugagacggagucucgcucuauugcccaggcuggagugcaguggugcaaucuuggcucacugcaagcucugccucccggguucacgccauucuccugccucagccuccugaguagcugggacuacaggcgccugccaccacgccaggcuaauuuuuuguauuuuuaguagagacgggguuucacuguguuagucaggauggucucgaucuccugaccucgugauccacccgccucagccucccaaagugcugggauuacagguauaagccaccaugcccagccuccuuucuuauacauugcugaggacaguuugauaucagaauauucucaagguccagaguagcuggaguauauuaaaucguaccuguaauaggaaaaagagacugggcccuucuuaaccacauuugaaaagggcuugaagcagacuuuucuuauagccauacuucucaguccauuuaucuccaaauuucuuaaugcagaggucacagacuggugaacuacuucuagcuguccgcaugguugguugguuugcuugcacaguguuuaaaauuuuuuaaauuuguugcuaguauuugaaaacacaaugauuucauauaaaaaccuggauuaauaguuuauuuuaaacaaugaaaagaucugggaacacugggcggccaaucacccauaguaauaauuggcuggaguugaauaguaguuguccccuuuagauggacaaugagcugucucuuuggccuugcugagccccuguaggcauuugguuugcaauuccugauuuagagucuggaauuucaagauugaauuguuagacuacaaacaggcucacucaagacucuaaguccauucacaucuuacaccaagccuguucagugucauccagaaagauaaucacugucacuuaucuucuguccuguguaucuccuggaagggaagugggauaguaauguuuuaaaaacguauuuccaucuaguuuugauuauccaugauuagcaacucaggagaaauacagauagguguaauagaugaaguacaaauuuaauuuuaaucagaauuuaaaguugcacaaaauggaugguguagaagugccucuucauuuuccauuuagccaucuagcagaugaauagcugaaaguuacugguuaaaucauagaaaaagaaccugggaagcccauaaacucugaauaguaaacuucuaaauaaaugaacuccacucauaacuucuaccaauugcuuuugcuuuagaaacuaaaaauacagcugaucaugaugagucaccgccucgaacuccaacuggaaaugcgccuucuucugagucugacauagacaucuccagccccaauguaucucacgaugagagcauugccaaggacaugucccugaaggacucaggcagugaucucucucaucgccccaagcgccgucgcuuccaugaaagcuacaacuucaauaugaaguguccuacaccaggcuguaacucucuaggucagugugcccuagcuucaugacauccuuuguucugugguucucucucccaggaucauccagaaauguuuuguguucuguugggauuuagcuucuuaggcucuucaguggucaugugcugagugauaaugaguugcucacuugaauaaaagcauuuaucuucuuggccgaugguccauaauaauagaucugguuguaaggaaauuaacuaugaugagccauucaguuuauccuagagcuuuucccagugaaaaauucccucauuuuccuagcaaaagcaaaaaagacuaucugcagauaucuuacugcauggcacauagcucguacucagugaggacuaguuaaggauaagguagugcagaauagugguugcacggccauagcuguuaaggaaaugagaaaaacauuuccugucaagaggcugugaaauuaggaguacacaugagacccuggccuucuguaacuuuaguagcuuagguuccuugcuuuguguacuuaguaaguaugaacaagauaaaauauuucuucugugauaaauaaguaucuuauuauauucuuaugaguuuuaccccuuagugaauuacuuuagagauucuugugguuugaaccuuauuugugcaccuucagugagcugaggugcaaauauugggcuuaagguuuugucuagaguuggaagaugcugauugggagguaaggggccuuucacuacugggucuacuucucaaauucacccuuugcauguggcuaucaaguuugaaaaaccguagaacagaguaaauugcugcuuggcaggccaacaguacacuuccuguaguguguuuuguuuguuuguuuguuuuugagauggagucuugcucuauugcccaggcuggagugcaguggugugaucucggcucacugcaaccuccgccucccagguucaagcgauucuccugcuucaaccuccugaguaguugggauuacagaugcccacaaccacaccuaacuuuuguauuuuuaguagagaugggguuucgccauguuggucaggcuggucucgaacuccugaccucaugaucugcacgccuuggccucccagagugcugggauuacaggcaugagccuuuuguuuguuuuuauagagagacaggggucucacuuuauugcccaggcagaggugcaguggcaugaucauagcucacugcagccuuaacuccuaggcuuaagugauccucccaucucagccucccaaguagcugggacuacaggcacguggcuuucaagcuuggcuuuuuuuuuuuuuucuuguuuuuuaguaaugagguuuuugcuguguuguucagguuggucuucaacuccugggcucaagcaauccuccccacucagccugcugaguagcugggacuacaagcgugagccaccaugcccagugguuuucuguaguguuuaauuaauuuggauuguuuccuggccuuuuuuuuuuuuuuuuuuugagacugagucucgcucugucccccaggcuggagugcaguggcgcgaucucggcucacugcaagcuccgccucccggguucacaccauucuccugccucagccucucgaguagcugggacuacaggcgccugccaccaugcccggcuaauuuuuuauauuuuuaguagagauggggauucaccguguuagccaggauggucucgaucuccugaccucgugauccgcccgccuuggccucccaaagugcugggauuacaggcaugagccaccacgccuggccauuuccuggucuuacagcaguuucucagauaauuucaaaccaucggaauaaauacagcaaaguugucuugaacuccauaccaguugucacucgaagauaauuguuucaggccugcauugauuuccuuggaauaaauaaugagaaaaacuaagaaagacaauauauuacacuaguagaugauaugauggcuaaugugcuuuaagaguuuaaggggaucugcuugccaugcaucaagaaaaggaauuuuccucugcuucugcuuguuacuaaccaugcauugcuaaauuguuaauuuuauguacuauauuuggucauucaugcagcaaauauuuacugaauauuggucaugugccagauacuguuuuaaguuaugaggauguagcuaugaacaagucaaagucucugcccucauggagcuuauagucuagcugagaaaggcaaauagauagacguguaauauaucaacuggagauaaaugcugugaaggaaaaugaaacugggaguacugaggguaggauauuguguguguauauacauacauauguguauguauaugugacauauauauguaguuggcuaggaaaagcugcugugauauggucacauuugagcggagacuugcuguuggaauauuugagaauaagcauuauggguaaggagaacagcaagugcucugggcaagagaauaguuaaccaguuugaggaacacuuagaggccaauauaccuggggcagaaugaccagaacggagaggaggagauaggucagaauggggccugauuguguuauuuaugcccaggaguuaaccucuuaaugggguagaccauaggguaaauaaaaaauauguuguauuagaggaaaguuuacuuguauuuguuuauuuauuuauuuuggagacagagucucacucuauaauuaccaggcuggaguacaguggcguggucacucacugcaacuuccgccucccgggcucaagugauucucaugcgucagcugccugaguagcuggggauuacaggcaugugccaccacgccuggcuaauuuuuguauuuuuuaguagagacagggcuuugucauguuggcuaggcuggucucaaacucuugggcucaagugaaaaaguuuacuuugacuuugguuuuaauguauuggaacuuugaaaaauaugaacccgagcuuccaaaguauccuuuuuuuuugaggcagagucucacucugucaccuaggcuggagugcaguggugcaaucucagcucacugcaaccuccaccucccaggcuuaauugauccuccaaccucagccucccaaguagcugggacuacaggcacaugccaccaugcucagcuaauauuuguauuuauuguagagacaggguuucaccauguugcccaggcuggucuugaacuccugggcucaagugacccucccaccucagccucccaaaguguugggauuacaggcgugagccacugcaccgggccccaaaauauucuugacccuagucuauuccuuaagaguuuuauguacuugugaaaaauuaaaacucuauaggaaaguuugaagugcauuaaguaaaaauugcccuuaacucauacccgcagaacugugccacagauacaaaacuucuguuugcaguuuucuaugaaugcuuccaagaaguuuuucuacauauauaagcacacguauauguacacauauuuccuuuuugugauuauucauaaaacggaaaauaggauacauuuguucguuguacaucuuggauauuuguauuuagaggcuugucuuuuuaaaagauacagagaauuucauuauauugauaguuuauaaauuauuuaaauugucucauugacauuuagauuguuucucauuuuuagcuuuuuugaacaauauuguaauggguagccuuguauguacauauuuuggugucuuucuagcaaaucuguaggauaaauucagagcaguggaauuuuuaggucaauagaucagcuguuccuuuuuuacuguagauaauagauugguuuuauuuaacauauaaaagaaaacaugcccugaauaaauuacuaagaaguauggauaugccugggugcgguggcucaugcauguaaucccaguacuuugggaggccgaggugggcagaucaccugaggucaggaauucgagaccaaccuggccaagauggugaaaccccaucucuauuaaaaauacaaaauuagccaggcgugguggcggcgcuuguaaucccagcuacuggggaggcugaggcaggagaauugcuugaaccuugggagguggugguugcagugagcugagauuggccauugcacuccagccugggcaacaaaaggagugaaacuccaucucaaaaaaaaaaaaaagacguauggauacauaguaucugaaaagcaagucuugcaguauuaaugacauuacuuuuuuugagacagggucucucugucaccuaggcuggaguaugguggugugaccaugacucacugcagccuugacuuccugggcuuaagugauccuggcaccucagccuucugaguagccaggacuacgggcauggacuaccgugccuggcuaauuauuuuucuuuuuguagaaauggagucucacuauguaugucacccaggcuggccucaagcucuuggaaucacauaguccuccuguguuggccucccaaagugcugggauuacaggugugagccacugagcccagcugaugcuacauuguauguaugguauuugaucagugaggaugguuuuucguguucaagauaauuuugcggaccucuaaaauugcauuuuuuuuuuuucugagacggaaucuugcucuguugcccaggcuggagugcaaugaugugaucuuggcucacuauagccucugccucccagguucaagcgauuugccugccucagccuccugaguagcugggauuacaggcaugcaucaccaugcuggucuaauuuuuauauuuuuuuaaguagagauggagucucaccauguuggccaggcugaccucaggugaucuaccugccucggccucccaaagugcuaggauuacaggugugagccaccgugccuggcccuaaaauugcauuuuuaaaauuuauuuauuuuauuuuauuuuuuugagauggagucucgcuuugucacccaggcaggagugcaguggugcaaucucggcucaccgcaagcuccgccucccggguucacaccauucuccugccucagccucccgaguagcugggacuacaggcacccgccaccacacccggcuaauuuuuuguauuuuuaguagagacgggguuucaccguguuagccagaauggucucgaucuccugaccucgugauccgccugccucgcccucccaaagugcugugauuacaagugugagccacugcgcccggccuaaaauugcauuuuuaauaauacagucccggagaaaugauggccugaauguccuaaaaucacccauucaccaguacuuggacuguuuuuuccuuuuaaaguuuauucuauaaauuauguuguguaagcuuuaaacuccacuuucuucuuuaccccaaauuaaaugucuuuuuuuuuuuuuuuuaugaaagaugaagauuuuuguagacuugcuauucagguuagcuaacuuuuuaucucauuagcauuguccuaugaccccuuucaaucuuagguguuuuauaaaccuuuugguugaagagaaauauauaaaaaggaaauaauguucaauucccuguguguuuucaaaaaaaccaaaugaaaaauagaugaaugggccgggcgcgguggcucacgccuguaaucccagcacuuugggaggcugaggcgggcagaucacgaggucaggagaucgagaccauccuggcuaacauggugaaaccccaucucuacuaaaaauacaaaaaauuagccgggcguggcggcaggcgccuguagucccagcuacucaggaggcugaggcgggagaauggcgugaacccaggaggcggaacuugcagugagccgagaucgcaucacugcacuccagucugggcaacagagcgagacuccgucucaaaaaaaaaaaaaagaaaaauacaugaaugaagagauacccauuuaaauaaaacaagcuuucguguuuuguuauuccuaacauuuuuacgucuucagaaggccuuguguuacugccuguuucaggcguggcucaugccuguaauccuagcacuuugggaggcggaggcaggaagauugcuugaguccaggaguucaagaccagccugggcaacacugagacccguuucuacaaaaaauuuuaaaaugggcccagcgugauguugugagccuguagucccagcuacuugggaggcugaagugggaggaucacuugagcccaggaguucaaggcugcuuugagccaugguugcaccacugcauuccagccuaggugacauaaaaaaauuuuuuaaaguaaaaaaaucugauuauagaagaauccuaaaucuuuaagcaaaacucaguucucccuccaaaaaauaaguauuuaaucugguuuaaaguuauguaaguauguuuacuuauaugauagaaaaggccgcuucuccauuuuucauaaauuugaguauugaaagggguuaaauucagguuggauaacauugcacaguagaaagaaaaguacacuuauucuacauauaaccugauuaauuuaguauaggagaguuacauuccaccaaaagaaaguguuccuguucauagucuugggcuuuaauuacaaauguugacuucgugacauuuugagauuugagaagucuaagagcagaaagaauuauaguuuauauugaucauacauaagcauguucaaagacugccagauccauccuguggaagaaaagaaugaguguaaguuauagcccuaccagccuuauguuugguggauucagucugaucagacauauauuugauaaaaaugauguagcaaaaaaacagguuugucuuagagaaacauacuacuuucuaagcuugucuucuuucuugagauuaaguuuucccuccuuuaacaggacaccuuacaggaaaacaugagagacauuucuccaucucaggaugcccacuguaucauaaccucucagcugacgaaugcaagguaauugugcucucauuuauucaacacaugcuuauugagugcuuaccguuugccaggcacuuugcugaacacuggggauacaguggccaacaagauggguaggguccuuguucuuacauuguaguggaggaaacauaaaaaacaaugugcuuuuuuagaaaaaacuaguuaaacagacaaaagaauuguaauauguaaugagugcuuugagagaaguuaacaaggagauuaugaaacguuuggaacaucagccacuagugcauugauauuuucuguugaaaauuggcuucgaagacugcuagggacuuauugcacuaaggaauaacuugcauaaauaugugaucuuaauauuuaugcauucgguucucuucucauaaaucuaugaagucauuuugcuuuuaaaaaccuuucauaauucuuguuccuuuuucuguccauuucugugaaauacuuuuuguuacucucagucacaccuacuuuuggcuaauucaucuuuuaaauucuugaaaccuagcuccuaaauaaccuuugggauuuugagauaauguauuuaaguagaagcucagaucccauuugugcguucuuguguggguugcuguucccaaggauggaaccgaagaucuaauuauggggaagcaagaguggaaaauguuauuaauuaaauggauugcuugaguaguauuggacagguuaucuaagcugguuagaccaaaguauuauuguuguuuuuguuguuacuuugcuagugacaccagggucacagguuuauuccugucugagccaauuucauugugaggaaaauuagauucccuagcuaacauuaauuuuccuugauucagaauuuguucucuuauuuacagguagaccgcaggggugaaaguuucuuuugugugguuagucuuucagcaaaguaguguacuuuccgugcuuauauggauuuuaaggucaaugacccuacucuuauuuuucuucauuccaaaucauuuuauaaguggcaauuccuucugcucuguguaaaagugaguuguagaucuucccauuguccucccauuauucugggacuaaaucaaaacagaaaaagcugugcccacaucuaugucagaagcaggaaaggcuucagguacuucuuucucagaaaauaacugcgaucccugcuuuuugagaguuguccucuaccacuugucucuaaauacaaugaucugauacuauggaugguuuuacauaaaaaucuuccugagaugucuuuugcuuuugaaauuguuaguuuguagcaauaugaccauguaacguuaagcaguuuauuuuagaaaaagaaaaauuucaguuuggugaagaaaauucugaccaaaggaaaacauuucuaucuugaauuuauccucuuuguucucucuucuuugcaaggggcauuaggcgcagaauaauccaucuuuacuacuggaacaugugcauggaggaucaggagaauuucugagaugauauauuuuuauuacauuuagaacccuaaguggaaagauuagacaaauuccccacauuuauuaacagcucuaguguuuuugaagaaccugcauauacaugauugcucuugaguuucccaggacacccuugcgaucagugauguuacauuuguauucagucauauauuucuguagcugcaugugccaaauacagguaucugaggauucagugaauaaaagacugcauuuaaggagcucauguucucacagggggaggcaacauaaaccuucaaauuaauaaguaaauaauuuuguguagugauaaauauugugaggaaaaaaagacgaaugauauagagagagucuguuucgggggugaggguagggauagcacugcuuuucccaggaugguccuggaagacauuccugaggagauggcauuugaucugggacgugaaugauggcaaagaagcaguuguguaaagaucuagaagaaaagauaucuuaaguagaagcaacagcaagugcagaggccaugaggcgcggcuaaacugauggguuugagaggcugaaugaaaguaggccguguauggcuggauccagaucauaaaggaccuuguggaccuuggcacaggaguauauuuuuguucugauagaaugagaagcauuuggggggcuuuaacaaaggcaugacaggauuucaggcacgcuuuugaaaacugaagacuuguuaacguggagaauggagugugggggcaagaguugaugcaggguauagggugcuugggaaacugcauggaaguucaggcaguaguugguggacuggacuagcuuuguaucggcagcaauucuaagacuagguuggauucaggauacguuuuagaggggagcaacccguuaggcuugcugauugauuugaugugaggugugagaaaagagaagaaucuaggauaacauucaaguuguugacuggaucagcuauuuagacaguauugccauuuauuaauacugggaagauuugggguagagcagauuuguggagaaaugccagucguucuguuuugaccauucugaguuuuaguggugaaguggaauaagcaguuggauaucaguucccaauucccagauuaugaaacagaaacuguugagagcugaugugauuugucugaggucauguaacuacagaauuaaguuucccuggagacuugaacccagguuuucuuuuuuuuuuuuuuuuuuuuugagacagucucgcucugucacccaggcuggagugcauuggugcaaucucagcucacugcagucucagccuccuagauucaagcaauucucaugccucagccucaaguagcugggauuacaggugugcgccaccacgccuggcuaguuuuuguauuuuuaguaaagacgggguuucaccauguugcccaggcuggucuugaacuccuggccucaagugaucugcccaccuuggcuucccaaagugcugggauuacagauauaaggcacugcauguggccaagcccagguuuucuuucuuucuuucuuucuuucuuuuuuuuuuuuuuuaagacagagucucacucuguuguccaggcuggagugcaguggugcgaucucggcucacugcaacuucuaccucccggguucaagcaguucuccugccucagccucccgaguagcggggaucacaggcgccugccaccaugccuggcuaauuuuuuguauuuuuaauagagacgggguuucaccauguuggccaggcuggucucaaacuccugaccuuagcuaaucugcccgccucagccucccaaagugcugggauuacaggcgugaggcaccacacccagcccaaacccagguuuucuaauguuuucuuuguacuuccauacucuauucuugcacuuccucaugcuuuuuuaauuuauuuauuguacuuugagaagaguccaggcucagagucaucagacaugauuaaaaccuuagugaucccaucauuuagcuggaucauuucaacuucucugauccuguuauuggcugagaaggcagaaugugaaucuugcauuaucucuuucuuguagagauugugacaauaagugugaagacccuuugaaaguaaaguacaacauaaauccaaggcauuaucauuguauucuuaugcuuuaaguaaacguagucuuagaagcagguggauuuauugacguuguugaugguugcaggugagagcacagagccgggauaagcagauagaagaaaggaugcugucucacaggcaagaugacaacaacaggcaugcaaccaggcaccagguaugggccuuguuaaagcacuggccauucauaguuugagguccguuucuuggaucuccucuauaauugucuucaggcaugucugugccucauuuccugugguauaucuuccagauguaaacuuagaaucauguuuguuuuucaaacaguaaauuuucauaaaacaaacacuucuaccucaugaaugaaggaaucaugcuaucuacaguaguaguaauaguaguagcaguaguaguaguagauaauucugauuauuugaaagauuacacuugcugcuucauuuccucacuucgcauccuuuaagacuauuguagcuuucaaaccucuccacucugcuagcaccuuuccaaggccaccagugacuuuuccccagcauuugacacuugcugacuguguuauuugucuucuacuuaucucuucccuugguuuguagggagcauccuggcuugguccuaaaccuccuccugccucucugaacauuccugccacauugguucacuuacuuccuuguucuucccuaaaugccuuuggucuucacucuuccuguuuuccugccuggaacgcuauaccuguaccaagaacagaugguauuuucuuucaaggcccgugcaguucucagcuguuggaggaauuuuucccaaauucucucccaccguuaaggaauuucuuccuuauguauucccauuguagugcucucaaaauguuagccuuugugacauauuauauuuuguucaucauuuaggugucuguuuuugcaguuagauuauaguuggauagcagagauauauggugaugaggaagaaguuugacuuuggagccaaacagaugugaauuugaauacugauuauuuaacucuagcuauguugucccgggcaggucaacuaaccuauuucuuuguuaauaagaagaggugaauaaugccuaccuggcaggggagucagcuaaauuauguauguaaaguaccuauacccagugcuuggcagguaaaaagcacuccauaagugguaacuacacuuuucuucguugucuaucuuagguuuaauuuaauuuaauuuauuuauuuuuuagacagaguuucacucuuuuugccccggcuggagugcaguggugugaucucagcucacugcaaccuccaucucccagguucaagugauucucuugccucagucucccaaguagcugggauuacaggggcacgccaccacgcccagcuaauuuuuguauuuuuaguagagacaggguuucaccauguuggccaggcuggucuuaaacuccugaccuccaguaauccaccugccuuggccucccaaagugcugggauuauaagcaugagccacggugcccaaccuuggguuuuauucuuauucaguuuuucuauuuaaauuaauacauauaaaugaauuuuuguaccacuguugaucagaucaauaagcauuaauuggaaaacaguaagcauucuauaaaugauuaguugaaaugaucuuaauuuuauucuuguugcuuugguggagacgucuauccuuaguuuauguuaguaguaaaauaaguuuguauuccugaaccuauauuuaacuggcaguaaagguggugggugaugagaaccugauuuggaauuuuuaaauugccauauucaugaaaaauuuagcugggcguggugguguacaccuguagucccaguuacauggaagacugaggcaggaggauggcuugagcacaggagguagagguugcagugagccgcgaucgugccgcugcauuucagccuaggugacagagcgagacccugccucaaaaauaauacaaaugaauaaaauaaaauugccauaugauuugcauuguggcuagaaaauuucuggcauuuuuuucucuuuaaaauuuuuuuacauguuuugguaccuucuuuuuuuuuuuuguuuuugugccagagucucgcucugucucccaggcuggagugcaguggcaugacuggcucacugcaaccucugccucccagguucaggugauucucccaccucagccucccgaguagcugggauuacaggcgugcaccaccaugccuggcuaauuuuuguauuuuuaauagagaugaggauucaccauguuguccaggcuggucuugaacuccugaucucagguggucugccugccuuggccucccaaagugcugagauuacaggcgugagcuacugugccgggccuuggcacuuucauuuugaagcuuagcuuuauaaggaguuuucucucaguuuucuccuuuuuccuuuuaggcaccaacggagagacagcuucgauauaaggaaaaaguggcugaacucaggaagaaaagaaauucuggacugagcaaagaacagaaagagaaauauauggugagggaaaguuaaauauuuaaugagcaugaacuccugcuaucacauuugauuccuuuugcuuucugagcuucugccuuucagauuugccauuuaguauucuccacaugugaauaccaauugacucuucuauggcacuuagaguuuauuucaucccccaaaacugaauuguugagaguggaaacaggaggucuugggaaaaugaaauacaauuagaauuuaaauuuuaaaaaauuugauccucuaguuguucauaaauuuuacuuucaucuuaaaggguuaaauuuacccgcuagaacacaugccauggcacuggaaaugucuguaugaagaaaaauauucaagcuuaauaguagucugcuuauuuuaauggaaaaauagauuuccuccaugauuaaaagguauuaauugggugaauauucuguaauagaccuucuuguaguauuuuaacauuuuuuucuaacuuuagaaguaauguacauuuguaagagaauuuagagugauuaagcaaaguauauggaagaaaacaaauccuacuaccuaaaaauagccacaguuaguguuuuuggauauauccuagcuuuuucacaaucucuuauuuacauaauuaccuucuuacuguauguagcacuuugaauucuguguuuucgcuuaaaaaucuuuuuuuuuuuuuuuuuuuugagacagucggccaggcuggagugcaguggcacaaucucggcucacuacaaccucugccuccugggcucaaguaauucucccgccucagccucccgaguagcuaggauuacagacaugugccaccacgcccagcuaauuuguguauuuuuaguagagacgggguuuuaccauguuggccaggcuggucucgaacuccugaccucagguaaucugcccaccucggccucccaaaguguugggauuacaggcgugagccaccaugcccggccuuaaacaucuuuuuuuaggaaaagauuuuauuauaaauguauuaauacaugcuuacuacugaaaauaccaaaaauauagagaagaaacauuccaauaaaaaaaaauuguccuucaagauacaaaccacugcuuaacauuuugauguguguucuuucacagucuuuuucuuuuucuuucuuuuugagacagagucuugcucugucaccaaggcugaaggcuggaggcuggagugcaguggugcgaucuuggcucacuguaaccucugccuccuggguucaagcaguucucugccucagccucccaaguagcugggauuacaggcgcccaccaccacacccggcuaauuuuuguauuuuuaguagagaugggguuucaccauguuggccaggcuggucuugaacuccugaccucgugauccacccgccucggccucccgaagugcugggauuauaggcaugagccacugcacccagccuuuuuuuuuuuuuuuuuuuuuuuuaaauuuauuuauuuuaaauuuuagauaaggguguacaugugcagguuuguuacauagaucuauugugugaugcucagauuuaggcuucuaaugaucuuauccugucacccaaguagugaacauagugauagguaguuuuucaacccuuguccgccuccccacucuuggaauccucaguguuuauuguucccuucuuugugucccucuguacccagugguuagcucccacuuauaagugagaacaugcuguguuugguuuucuguuuuuguguuaauuugcuuaagauaauggccuccaguugcauccaugucgcugcaaaggacaugauuucauucuuuuuuauggcugcucuuuuagauuuuuuucugacauuuuaguuuuuuucauagaauuggaauguuuucuuauucagccauugggauagauucuuaaacauagggcaugugaauacuuagucagagcauggcuucacuaagacaaaaauaugccagacuaugcauaguugacccuucguauccauggauuuuguuccuguggauucaaccaaccacggaucggaaauauuccgggaaaaaaaugugguuuguacugaauguguacagacuuuuucuugucauuauuucugaaauaguaguguuaacagcuauuuacauggcauugacaucacauuauaaguaaucuagagaugacuuaaaguauacugcuggaugugcccagguuauaugcaaauaugacaucauuuacauacgagacuugagcauccauggauuuuguuauaugcagggagguugugggggcguuccuggaacuggucccccagggauaucaagagaugacuguauuuccuuuuuuuuuuuuuugaggcggaguuuuugagacagagucucacucugucacccaggcuggagugcagcaguggugcaaucacagcucacugcaaccucugccuccuggguucuggguucaagcaauucuccugccucagccuccugaguagcuggaauaauaggugugggccaccacacccagcugauuuuuguaauuuuaguagagacaggguuuuaccauguugcccaggcuggucucaaacuccugaccucaagugauuugcccacuucggccucccaaggugcuaggauuacaggugugagccagcacaccuggccuguauuuacuuuuuugacagucaucacugucuuaaaugcuaauuuuaugaauacauggacauaggccaauguaagauggguuguggggugaauuuguaguuagaccuuuacaccagacuguguugguuuguacagugagggcuuuaguagugggcuauaggguaccagauuguuugcuugccccagucuuguucacuguuuccaucugcaaacuuguuagaaggguaauaagacaaugauaccguauauugagugauuagugcuaggcacugugauugugacguuccuuugaucuuuuaacaguccaguaugauuggugauauuucccauauuuuauauacaggaaaacuaagacugagagagguaacuuaccuaaaaucauacaggcagaaagagugucugaaguaaaaguucuugaaauuuuuaaccuuaacaaacaucugcucugcuuuuuaguaauuugggauagguuauuaggacccaaccuccuugauuaaaaugcuggcuaggacuuuuuucaagcuuuuuuuuuuccaguguuccucaaaauagaagaaauaacuaaugcguagaacccaaaucuuagaugauagaguccaaauuuaaaaagauucacagcagauggaaucagauuaaccggaagaaauuuuaauagggauaaagauacugaugaauggucucuucauaugguaauaugugugugaaaucuauaauguuuuccugagauaagccauccacuccacuuaacuaccauuaucuccuauucucuggaugggagguggagccuacaacagagugggaagggcugaaaucaaaggcuuaaaagggaaguuuccuuuguagaaucucuuuccuggaaaggauucuuguagugacugccaugguaagauuagggaauuauuuaagacuggauuauucucaugcuuuuaauuuucuauggcuuucaccugucuuauucuugcuuaauauuuaguaagucauuuuuagagaguccagccuauuuuucuguguauguggacuggaguuugaggguagcacgccuuuugcagacagcauaaugguggcuggagcaauucaagugaaagaaguuacaaaggacugcuucauccagcugccccugccccucccuuccugcagauuuucuuuugagucuaaaaucuuagacacuaaggcuuagaaaaucugguuuuuguuuguuuuguuuuuaaaucggggaguaucuaccaaagcuccuuccaaaucucaggauucugggaauuuguagugucucuggguuuguuguacuuuauuuauuuguacugucauguaaauuuuuacaugaaggaacagcguucugauccacaaaguguaucuuuucagagauagaagaaugaagcucccuucuggagcugugggagcauuuccucuccagaaucacugggguggguagugggagucuuguggcauuaaccugauaaguaguaugucuugugcucaaucccuagcaccuaguauguaggcacuaaauaaauagcuuaugguugugugguuugcauggauugaaaugaaauagauuaaaaaguucuuagaagcagagaguaucagaguaucacgcucugguuauuuuccuaggaacacagacagaccuaugggaacacacgggaaccucuuuuagaaaaccugacaagcgaguaugacuuggaucuuuuccgaagagcacaagcccgggcuucagaggauuuggugaguauuaaaaccuccaaacugaaggccgcuugugaaaggugcuuagaguugccaggaaaaaugauugcaaaucaguuugaugggaauuaaauguaccuugcuucuggaaucucuuucccugucucccagcugucccuuuuuggagacuagccuucccuuucagauuuaaaaugaaucaccccuccucccuuccuuuuuuuauucccugcuuuccaccucggcucccggaaguaccaguuuggcuagagcugaugaggcuggauaaaaccauaggcgccccuuugucucagcugggcaauuugcaauucugagaaccuguagccuaggagagacucaucucuguuguuuucuuaaucccaacaggaacuccccuuuugcuagguuuccucugcacuaagaaugaaaauaacagugaagaggaauaauggaaaaggcuguugucagauguuuuagaauuaaucuuugacacagccaaguuugauacauugguuuuccauucugauauuuauuuagagcuaguuuauacugaguugcuguccuaggcagaauuuuuaacaacuuugcuugaagaaaauucuggugauugaguuuaccucugauauaacagauuaaauguguucagggaagcucaguuuuaaagugaaucucgucuucacccccuucccccuuguauuaaaaaaaaauuguaucaaauacuagacuuguugaaaacuuggcagaggcaggguuugcuggcuacccuuggcugggaugggcuguuacugcugcugguuuucucuauccuauucuggcauggagcauuuccugggcuagccuuuuacaacuuuacaccugguuaugcuuacaaauuauacuuuuguagccaacucagagccacugaauggagauggauauccgaauuuuuuuuuuuucugagacaggguuuugcccuguugcccaaacuggagugcaguggugccaucauggcucacugcagccucgaccuucagugcucaagcgauucucccacgucagccuccugaguagcugggacuacaggcaugccacuacacccaucccagaaauauuuucugccuucuagaguuuagauucuagaauuaucaugcacauuucaaaaauauuuuuuaaagggccuguuuuuuuuucuaagugaccauuguggauauauuucacggagauucauauagcuuuauaaaagcuucugcagauaaguaaggcagauucuaaaucaaguuuuuuguuuaguuuuagaauacuuuauaaggguggggaguuuguaucugugaugauuuucuuuauaauucaguuuggucuaggcugauaaaaaugaaguuuccaagguaucauucuggugaggcccagaaugugggagguagcagagaaaccucucuuuugagaccugugcucugggcaguauggguaguaaguuuucuguacaccugugugauuuuucauguagcucucuuuaguguaaauucucauggauagaagccaaaucugucugauuuuuuucauagccuagcgugguggcaugcacacacacuuuuaaaaacaaagauaauauuuauuuuuuuaaaaaggaguuucgcucugucucccaggcuggagugcaguagugcgaucucgguucaccgcagccucugccucuugggcgauucuucugccuuagccucccaaguagcugggauuacaauuguuugccaccacaccuugcuaauuguuguauuuuuaguagagaugggguuuugccauuucggccaggcuggucucgaacuccuggccuuaagugaccugccugccucagccucccaaaguguugggauuacaggagccacugugcccugucuaaaagcaaagauaauaaauucugauccuccuuugacuuuugauuucuuggcaauaggagaaguuaaggcugcaaggccaaaucacagagggaagcaacaugauuaaaacaauugcuuuuggccgcuaugagcuugauaccugguaucauucuccauauccugaagaauaugcacggcugggacgucucuauaugugugaauucuguuuaaaauauaugaagagccaaacgauacuccgccggcacauggugaguugucuuggguuccucugccuugaccaugauggcaauaagcuguaggaucucuagauuuugccauagcgauggcaucuguucaggcaccuucucagugguccucagcagugggaugaaggcauaggaaaugacaggccacagcuuaaggcgggguauagagccugagguauggcuugugcugggugccacccaaagcagcugagggcccuuacccacauccugucauguacaucuucuugucuuuuguucuugcugccuacugcucuucauuuccuccuuggaauaugaauuaccucugcccacagguuuugugugucccaaacuagaugaaaauacagacuucauuaggcacagcagagacagcauggcucaccuucauaucccuagcaacuaguguggacaacugaugcccaagaaguauauguugaauggguacuuauuaauauuuaauagugaucagccugugacagauuaugaaaguagcagaguggguccuuuggugccuuccccucuuuuuccuaauaaaacagguauaaggaguugaaucuguuauuguugacaaauagguuuacuagauuuuuugcagcuucaaaaaaaaagccauuuuucccccgcucuguuacagaauaagcuuugucuuaaggggaauuucugccauggagcaagggugcggaacaggggaaggaguagagauuagccuuucaggcagagaagacuuuuucuuguuuuuuuuuuuuuugagagggagucuugcucuguugaccaggcuggagugcaguggcgcgaucuuggcucacugcaaccuccgccucccagauucaaacgauucuccugccucagccuccugaguaccugggacuacagucgcacaccaccacaccuggcugauuuuuguauuuuuaguagagacaggguuucaccauauugaccaggauggucuugaucuccugaccucaugauccacccaccucagcuucccaaagugcugggauuacaggcaugagccacugugcccagcccuuguucucauaaucacaauauaauuuggcucuaaggccucuggggugucucuuuuuccuuccccuuccuuuuuuauuucccaggauuuccauauguugagcaucuaugacccagguuuccugugauuucugucauuauacucuucuccccaguuugguuggugauaacugcuuuuuuauguucccaguucaggagcauguggucuguaaguucagggcccagaacuguugcuuugacucagguucuccagacccuggcacacuugacugcauagggcuagagucauggaggggaggugauuggcggcgauugguagaaauaucagugcacaggaaauaauggggucagaagguggggcacugauacagauggcaggccguggagauaaaguaaaaugguuuuacugugugaaagcggguauuuuuauugaugugaacugcuuaccauuuaugccuuuuuuccuuuucguuucugguuguugagugacacaaaccaaugaaauagccaaaagggcaagaaauaguaauagaaggagaaaacaaagagucugaauaaaucugagaaucaaauaaacauucugaauauuugaaaaucuuccauauuauaugauauaaaaaucagauuucaggaaauaccuaauuuauuccaugccuguucuuauucccguugcuucaggugugaucacugaaaugaaaugaucuuccuuuggcuuggcuucuguuucugaacaaauaauaauuguuacaugaguuugguuauuguugggaagagccagcaugaguaaagggguagagauaggaacaaacuacagauggaauuuucuuggauggauuccaguuaauaaauauuuggauuuacauaugacaaauuggaacaugcuucuugaguugacaaaaagaguugcaguaaauuugcuuaauagaaaguguuucaugggccaggugcgguggcucauaccuguaaucccagcacuuugggaggcugaagugggaggauugcuugaggccaggaauuugagaccagccugggcaaaauagugagacucuguugcuucaaaacccuuuugaaaaauuaacuaaccaggcauggcgccaugcgccuauaaucuuagcuacaugggaggaucuuuugagcccaggaguucgaggcugcagugagcuaugaucgugcuauuucagccugggugacagagugacacccuaucucaaaaaaaaaaacuuuuuuuuauacgucuauacuuuuuaaacacuuuuuucuuuuuuuuuuuugagacagagucucgcucugucacuuaggcuggagugcaguggugcaaugucggcucacugcagccuccaccucccggauucuucugccucagccuccagaguagcugggauuacaggcccccgcugccacaccuggcuaauauuuguauuuuuaguagagacgggguuucaccauguuggccaggcugcugucaaacuccugaccucaggugaucugcccaccucagccucccaaagugcugggauuacaggcgugagccaccgcaucaggccuuaaacauuuuaaaauguaaaccuuuugaagaauucaccuaacagcagauggcuggcuggcuggcugcauuaaaacaguaagcacuugagggugaggaaaaggggguacuuugugcucccuuguggccaagugacccuagcuuccugcugcucagcuaggcugcuugccuuuuuuuuuuuuuuuuuuuuuucuuuuuuugccacaggacuuucucuuaauuuccuuauauaacaaagggaaugcacuugcaggggagaagggcagacagguagugguacaugguuuuuaucauugugaguggguuuucuaaucugaacaaagaaggccaucaugguuaggugguaaugagaaguuauggguaaaggugagaguaaaguacuuagccacccuaagcugcuggaaauaagcugcuuaagaauuuccuguuggcuugaggcauuugguaauaagcaagcguauuguuauuuauuuggccuuuauguagugggugauuuuaaucuccugggcuaaaguagugccagaauguaauccagaauacuuguuccagauugcuauaaaagugucauaaauauauucaaaugacuuuggaagccuuuguuuuauggaaauaaaaucucuguuuugcuguauguucucagcuuguccaacuguccgguagcucaguuaaccacauuugaccugucauuccuuuucccuuuugaggagcagucuuguugggaggcuuugguucccugaugugaauuucauugucuugcaggccaaauguguguggaaacacccaccuggugaugagauauaucgcaaagguucaaucucuguguuugaaguggauggcaagaaaaacaagguaaaaaguggugacuuuagaaaggaguugaaauguuguauauucacagguuucagaaggcauauguuuuuucuccaucacaccuugugaaggacauagaacucuucucuugccaaaauacacaauguguuucauuaauaauuaugguauguuugugaauuuuaggccuuuaucuguuuaggaaucaguggcccacacaugaacucuguuucucugcuuccagaucuacugccaaaaccugugccuguuggccaaacuuuuucuggaccacaagacauuauauuaugauguggagcccuuccuguucuauguuaugacagaggcggacaacacuggcugucaccugauuggauauuuuucuaagguaagcaggaucuggagauuaagaagccaauggccagagcagggugauccauguucgcaguugggggcucaaaucacugacaggaagaagcuguacucugggcaaugaugacaccccuuccuuaaauuaaaaaaaaaaaaaaggcaaacccauguaucaaagauuguuuaaugaaaaugcaguuuuuauuaaaagcuucugguucauucauuucuagaauuguggacuggagcugccuauuaauaacuggccagagcccucccuaguaacucacaagcccacaucuuguagucaaaccaguucugcuggcuuugccugccucuauguuauuagcuuaaaaccaggaauauacucuuuuugccugauuguuuagcugggcuccuucuagcacagugccuucagugauaacacuacugcgccuuuuaaagacccaaggccagauuuuuuuuuuuuuucugacagagucucacucuguugcccaggcuggaguacagagguaugaccuugacucacugcacccucugccucccagguucaagugacccuccugccucagccuccugaguagcugggauaacaggcgccugccaccacgcccagcuaauuuuuugugugauuuuaguagagaugguguuuuaccauguuggccaggcuggucucgaacuccugaccucaaguaauccacucgccuuagccuccuaaagugcuaggauuacaggugugagccauugcgcccggccuaagucauaaaaguuuaugacuuuuaguauaacaacuuuauugaaauauaauucauauaccauaaauucacgcacugaaaggguacaauuuagugguuuauaguguauucacagaguugugcaaucaacccaguuugcauuauccugaaaagaaauugauagcaaucacuccuauuucuacucaaucccucucaguucuucuuucucuauaaauuucccuauuuuggacguuuccuacaaguggaaucacacauuuugauuugauucaaugugauuuuuuuuuuaaucccuuugcagaauggggacuuacagugguguuuccuucccuucucuuccaguaggcagcuccuuuucaaaaauugcguuuaaagugggcuucuauauacugagucagcagucuuaaacuucuugcccuacucuguggcugucaggagcccagagucagccuccuuaaaaugacacuggaggucucaacuagggaaauccugggaugauuaauggcuuuggccaugauaaagggugugguuauaacagcugugagccuggcagccacuccuugggacugguuagccagauguuuugcaagcagccuuauuuugcaucuguggaagugcugaaaccuuugguuucaaauccucaugacguguucaucuguuugcucuugauuuuaggaaaagaauucauuccucaacuacaacgucuccuguauccuuacuaugccucaguacaugagacagggcuauggcaagaugcuuauugauuucaguaagugaaacugcuaagucauuaguuccacaaggcagggaccaugugaauauuguuugucuuuuuguccuguggucucugcaauuccuggaauauagugaagguacauggauauuuaguaaaugaaugaacaaguaggaaaaaccugaacauugucauucugccuaauacacauugaacauugaaggaguacaggacuccuccuuaaugaguaggagguacagaggaugauaaaguaagcucuuuaggauuaucccaguuugagacuuuuaaacagcacauacaugcaugaggcuuaaaaucugguccuugaugcuagggauuucacuuuuguagggacuugucuagagguaauccauguacccaauggacccugugcauaauauacucugcccucauuaauuguggauucugucuuugugaauuugcuuacucacuaaauuuuauuuguaaccccaaaaucaaucuuaacauuuuuguggucauucgugaacaugcacagagcagcaaaaaguaagagucauggaugcacacauucccagcugacuucagaguuuucagcucuuacacuguaaacaaguucauuuucagucugggaaugccacaugguuuucgccuucuguugauuuuaaauggccccuaugaguaguacugaugugucugguguuccuaaucucaggaauaccugggguaccuuacagggguuagguagcuuucuucaggugaauuagagaguugcuggcagugaguucaauguuaaugauaucaacaguguauauuaaauaaggcauuuuuaaacagaaacauaaaauaaguuuauguauugaugguugaccaauaugugaccagaggcuugcaggaaccuaacccucccuguauuucccguaggaguagugguucaauauucacuaauucagguucucagugacuuuauaaaacauaacugcugugaauaacaagacucuacuguguguuauucuauauuugauguccacugucauaggacaggguauauuguaaucaaaauuggaauuccuagaauuagccuuccaagccuucuuucuuucuuucuuucuuuuuugagacggaauuuugcucuuguugcccaggcuggagcacaauggcccaauguuggcucacugcaaccuccgucucccggguucaggcaauucuacugccucagccucacgaguagcugggauuacaggcaugugccaccacgcccagcuaauuuuguauuuuuuuaguggagacggaguuucuccauguuggucaggcuggucucgaacucccgagcucaggugauccgcccaccucagccucccagagugcuggaauuacaggcgugagccaccuugcccggccaccuucuuucauuuuuaagucaccugagaagagaugaacugggaagugacauaagaggggaacuauauaucuuugaauagguaacacuguucuuauaaacuugauuuuauagaaauuuuuaagcauuaacaaaaguauaauaaaugcuucuauacccaucacccagcuucaguaauuaccguuuuuuggggggcuaaucuuguuuuaccuacauuuucacuugccauuauuuugguaucucuaaaagauaaggucuauuacaccuuaaaaaaaaaaguccuucaugucauaaauugugauauucaaauuucccuggugugauuuuguucuuuuuuuuauuuuuauuuuuuuaauacucagauccagguagaauugauagugggauugagaaauguggcucauaauucacuuuuagucuaaaacuuuccacucccaucauuuuuuucuugcuguguuuuuguugaagaaagcagguuaguugucuaaaaggguuccccagauuaugaacuuugcacacugcaucuccauaguguuguuuuauauauuuuguauaaauugaauguuagguguuuagacuuuacaacuagaggcuucaucauuuggguuuuuuacaccccgcacuaucucauaggugguacugagcuaaucuguucuuaccauucaaagauuuaaaaaauacuuaaaaacuagguagugaaguggcuucacauuuuuguuucucaucucccuuguuuccaacacacaccuacagagauucauuaucaaaauaauggugaaggcuuccagaguucuuuuagugccuauuacaguagugcccuccuuaucugccauuucacuuucugcaguuucaauuaccuguagucaacugcgguccaaaaauaggugaguacaguacaauaagauauuuugagagacagacaaccuucacauaacuuuuauuacaguauauuguuauaauuguucuguuuuacuauuacucucuuccuguucuuaauuuauaaguuaaacuguagcauagauauguguugauaggaaaauacauaguauauauaggauuugguacuacccacaguuuugggccuccacugggaguuuuggaacacauucccugugaauaagaggggacuccugugucauguaaaugcaaauacacauucuuccccuuuuguuuauacaaaggcaguauacuauaguuaaccacacaguauuccauugaaugacuaaauccuaauggaguggacugugcuucuuaaaccuucuuccauguuggcacacaguuuuuugcuauuaggauaagaucgaguguugcuagaaaaagucuguauuuguucccuggcagguuauuugcuuuccaaagucgaagaaaaaguuggcuccccagaacguccacucucagaucuggggcuuauaagcuaucgcaguuacuggaaagaaguacuucuccgcuaccugcauaauuuucaaggcaaagagauuucuaucaaagguugguuuuugacuccuuggaaugguugauuguuacccaagaaguuaacucuacuggguauuguguuuccccugaaugugagaacggaaggcccacugaauauggaccacugcggagacccucacuaaagcugccuaggaauccaaagcauuuggccccugggaaugguuauuaauuggcuucucaaauccagaguugccaacacuuuaauucuuauaaaagucaagaagcaaaacuucagaucguuugguucaucuuucugagaaagacaucccuguguauuuaugcaaggguggaacaauuuaguuugaucuauauuugauccugauuucuaaggggccaagaguagcuucuugcuguaauauccuuuugugguuauuuggacuggucaaaugaauacuuuguaaacuccuucuaaacagauuggguugaguacagaagauucuguccauuuggauuuccuuuaagggaaaguagaccuugguugggggcaaaggggugggaaccugcacuuuggccagguugucaguacuucuucuguuucagaaaucagucaggagacggcugugaauccuguggacauugucagcacucugcaagcccuucagaugcucaaauacuggaagggaaaacaccuaguuuuaaagagacagguaagguucucaucaggggcuugcucauugcuggauguccuucaagacuuagcagagcaaaguaugggccuuaagacuggagaaccuucccuuaaaggaguugggcuacacgccccuuuuacugggucucauuucuguagcuggcagugaugccuguguugccuuauccuuaucagaagguuuugauaagcuccugucucaaauuuggaugacacaaguuaagcagcuccaguuaagcagcuuuauguuguacagcauuucugucauuugauguuuuucuuaggugggaggaaauugcccaucuguagaggaaucuucacaaaugcugucucaacucaaacucacaucuaauuuuuuaaauuauuucauauauacaauaaaggucggugagcgaugauuuucauuucucacugaggguaaaguaggaagaauggauuagauaggaaagcaguuuauaagucaaaauauaguauuuuuuuugauacccuaauauguuguuaaaccuuuggcaauuccuucuuggcgguuaguuauuuuggaaucuauguaaaggcacuugaguugaaaguauguaauccuuuuucccauuguucucccucaggaccugauugaugaguggauagccaaagaggccaaaagguccaacuccaauaaaaccauggaucccagcugcuuaaaauggaccccucccaagggcacuuaaagugaccugucauuccgagccagcgaaccccagcaguaggaauccguacccuagggaucugucugucauuucucuguugcucuugugauuggcaaguacaguauccuuugggaaggccaucccccucaggacuguccuggcuccgaccuuuguguacacugcagacgcugguucugaggaacuguuguuucggccucagugagguugccuggaugggaucuguauuagacuugagugcaggucucucagcacugacccaaggaguucuguuaugguacuguaccuguccagucacugguucucuccucauguccucucgccccaugagguuguguugugucuucuaagcgugguacuagugcuugccaccuggucaccagaccuccaaauauggcugccaccaccaggaccuuuccaguuacuccuuauauguguguucuauggaggggcagggaaaagguggcacuugugaguguguguggauuggcaggggguccauucacuuuggguuccaucuugcuuuaaauuucuucauuuugauuaagagaccucuuuuugaucuguauugggcuaaccagagccaaauacuuuugaagaguuucccagggacuagucaugguaauagcauauaauugaucugaaugagauggagagaagaaugaagggguggugguucuggguuugauuugaguucaccugugggcagugggcagugggcagugucuuggugaaagggaacggauacuacuuuuugccucaccguaaaguacucacuaguaaauauuuccuucucucuuuacucccacuuuuuacguuugcaggugccaaaguaauguccacuuuucccuuucaugcugcauauuaacugguuaauuauacugcagaaaccuuuucaccuccacuagucugauacaguacaucuguacuuccauauaccuugcacugauuuugucugagugcccugggagaaguagaaaaugauugaaagugacuuccguaucucagcccaugacucagcaaggcagaauggccaccccugccaaaguuugcuucucuuuucaacagugccucacccucccucuaggauuaaagugcuucugcccuuccacgaacuccuccuccauuuccuuuuugggauuugucaccauccuucuauucucuggucuucuauuuuugguguuguucaagugaaggaagagauguucccucuaauuucucucuagcccauuauaaccugcuaucuuggggcaacuuuugauguaugacaugucacccuucccaacuuggucuccuccaacaugcugucuucauguggagcccucaccacaaucccugacuccggucauuugugccuuucucuugucaucucuguacacuacuuauauucacuguggguugggggagcuaauuuuaagcauguucaguggcagcuccccuccaguuucagugucacuguuaaaauuuaucaaaaagcaacuucacuagggguuuucuuaagggauaaaggccuuuuacagaagcuaaacccuuccccacaugugguagaaugugcucuucuauaucuacuccucaauaaagcauguucucugcucaa

SEQ ID NO: 192300 - RNA, 37221 nt, Homo sapiens
augcaaaugcuucaaaaaaggcagggcauuguacaaaucaucauugcuauuaauacagucuccauugcccuggucagugacugguucauuuccagugacccuucaccuuugauugguacuuccaguaacugagccauuucccuuuucccuacccaccagcugguuugguacaacguucaccuaucaggaguccaguuuuugguggccugcuauagauaccauaaccagccagccuaguguuucuccuaugcccucacaccuuuaugcggcacauuggagaugguucuugaaguaguggagggccagcuugaacuggacccgggugaggguguuggaccgguauguauuguaggucuucucuagggcagccaguucugaguccaccacuggagaccgagacuggugaccuauaaucacuucugggcaugaccccacgaguagggucccuagcccaucaaugaagaauucugcaaagagagggagagcagaaggaagugggagcugcggucagaaaagugggcacuauucuaggucuggugggggagagucccagggagaggacacaguucauacacuggggagguucagccccacgugaagccacacccuuaacucuaggagccugucccugcugaugaguuggaaggaaauaaauaagcucauuucucaggcagagauaugggcacagaggcagaguggcacagauuggcuuucaaacuggacagaacugcggacuccagggcugauggaguaagagggaaagagagagcaguuaauaggaaaggauuucugaaaaaauagaauaugaagcagcaugggaaaggaggaagaagacagagcuguagggaaaggaaggggaaggaaaagaagggcagccuacaggagacacagaagucaaagagacgugaggagggagguaagagagaucaagagcucccuagucuggggagaaaggggaaaggggaaagggauguacugcuacugggcaagcgacuaugaucagccagccggguacagcccuuggaaagaacaaacuucugcagcuaauucccagcccagcucccucccucacucuuucagccuucccaccugagugagccacucguugcaggcggggaucaaagccaacucuuuggagucgcuccgugugggccaggaagaaguugaccacgccacuggucaccacgcagcuggggaagccauccagggguuggaaaaaucccauccucuugugaaggcaggccccauucucacucuguuccagcaacaacuuaaacuggaacacauuucccagcacacugccgccuaccuagccagcaggcagagaaauccauguuagagugcagaucaauauucauccugccucuuccaggaagacucgcuggacugcaccucgguuauaacaagaauuguuauuucucugucuauccuucaaauuaucccucaguuacucccucguugcugcuguggccauggcuuucacuauaccacuguugggucccugggcucuuucauuuccugccuaccccagaaaaucuccuuggcaugaguaacccuuacccaagaccaaagaagguuaucuuuccagaagaagauaacucacucccuuccacugggagaggaguacugcaguacagguaagaggcagccugugugcacugguccauuugcggaguuuccacuugcuagauuucuugcagggagcuguuugucucgagcugucuuccuaguauuuucugcuccuggcuuaccucuuggagcugccuauccaugcacucauggaagagaugugcauuuucauguuugagccugagcacaacagaugagcaaguacaucuauuucugaaagaaucauaauccucuaagggugaugugguaaagucugcucauugucccccaucacccguucuuucccucuuccuuuuaauaaaugacccuucugaguuucacgacauagucaacuagucagcuaaagacugcauuucugggagcuaaacaauggguacaugcaggcauacgguguggaauaauagacacuggagaauacaaaagguaggagguuaagagugguugaggguuaggcugggcgugguggcucacaccaguaaucccagcacuuugggaggcugagguggguggaucaccugaggucaggaguucgagagcagccuggccaauauggugagacccugucucuacuaaaaauacaaaaaucagccgggcaugguggcaugugccuauggucccaguuacucaggaggcugaggcaagagaaucccuugaaccugggagacagaggcugcagugagccaggauugcgccacugcacuccagccuaagugacagagcgagacucugucucaaaaaaaaaaaaaaaaaaagaguaggugaggguugaaaaauuaccugugggguacaauguucguuaugcagguaauggguacacuaaaagcccagacuucaccacuacguaauacauguguauaagcuaucugcacuugggcccccucaaucuauaaaaauaaaaaacaaagcccauuuauuauuuaaagaaaaaaaagauugcauuuccccaccucccuugcagcaacguuucacugugugacaaaguuuuggcugaagggguaugauuuagaaccgaugcgagaaacguuuacaucacauccuuaaaagaaaccugcucucccuucacuuccucuuccccucuuccuccuggccaugcagccagggaccaaaggauugaggagcaacaagaaaaagaagcugauccaggauaauccuggagccaacucagcugccagugugguuguuacaugagcuggaacaucuucucucuuaaguuaucgugaucuggucucuguaagaguugccaagagaugucuuugcugaucuagguguuuuggggauuguccacuugcaguagaguuaacugugaucacgacaccacuuaccuucucauccaugccccuuuuucuuuucuacagugaauuuacuuuugauguuuuuauuauuuucuuuuuuugagacaggugucacucugucguccaggcuggagugcagugacauaaucucagcucacugcauccuugaccuccugggcucaggugauccucccaccucagccuccugaguagcuuggacuacagaugcacaccaccaucccuggcuaauuuuuuguauuucuuuauacagaugagguuuugccauguugcccaggcuggucuugaacuccugggcucaagcgauccuccugcuucagccucccaaagugcugggacuacagguguaagccaucacaccuaggcuguuuuuauuauucucuucuuauucuuuuuuagaaugucauuagugccgugugugcuuuuaaagcuuuguaccauuuauacuguuuuuaauguugugugauagaaccagaaugcuccugucuuuaaucucauacuagucaacggagggaguuagaaaugcugcauaaacacacaauuuuaaaagaaaacaauugcaaaugagggaggagguguaauuuacucaaagaaaagucaguauggaggcgugagcuggugcagcacucuccaccuggguugcacuggccuauucaccuccugcaccagccccucucccuccccucccuccccucccucccccuccucuucucuuauauauuucuucccgcucucuucuccccucuucuccaucucuacagauuguggcugggugaaacuggcaacugucccuuaccacguccaguucuguuuucuccaggacauccaccagcaccucaaucuuggucuccucguugaagagaaaaucaucguccacccagagaacguauuugguggugaccugagauauggccagguuccuaccagcaaaccaacccuguagaugaaaugagguuaaaggagugguugcccauauuacauauuagaaucaccuggggagcuuucuaaauucccaacagccaggcugcaugcacuccagacaaauuccauuagaauuggugcgagcgaauccagugugcagccaaggcugugaaccacaggguugaaggaaguccaugucucagagaaagucuggaagggacagugacuguguggaucaaagacugagacaaagaaaggcuagaaagucauuccuuggcucuguggccuauauaaauuggcugaagucccuuuucaccugacaguuucuauggcucuccuuuugucuccuguaagaugucaaguuugaaggacaucugguauguauaauauucguuuccuccuuuguccuuggaggaaggaagggggagagagagggaggaagaaaaugagagagggaaagaguagcaaggagagagagagguggggggaaagagagaggaagggugggaagaagagagggagagagaaagagagaguggggagggagagagaaaggugaggggagagaaggagggugggaagaagagagggagagagaaggagagaguggggagugagagagacaguggggggaagagggagggugggaagaagagagggagagaaagagagaguggggagugagagagaggugggaggagagagagaggugggggagagagggagggugggaagaagagagaaagagagaguggagaggaagaaagguaggggagagagggaaggugggaagaagagagggagaaggagagagaaagagagaguggggagggagagagagucaaggagaaagagggagagagggaaagaggagagagagaccaagacccuagcucugguagaaucauggagaugacagauuucucuacaugucaggaaucuuugagaugucagagaccucaagucgcuuauaaggaccccaaucgauuuccacaucggaaaugaggaaagaugggagcaguguacaguggcucacgccuguaaucccagcacuuugggaagccuaggugaaaggaucucuugagcccaggaguucgagaccaaccuggccaacacagugagaccccaucucuacaaaaaaauuuaaaaaauuagccuggcauuauggugcaugccuguagucccagcuacuagggaggcagaggugagagaaucacuugagccuuuaagguugaggcugccaugaucacugugauugcaccacugcacuccagccuaggugacagagcaagacuccaucucaaaaaaaaugaaaaauaaaaaaauagaaaugagaggcugggugugauggcucacaucuguaaacuuugggaggccaagauaggcggaucaccuaaggacaagaguuugagaccaaccugcccaacacggugaacccugccucuacuaaaaauacaaaaaauagccgggugugguggugcaugcugguaaucccaccuacucaggaggcuaaggcaggagaaucacuugaacccaggagguggagguugcagugagcugagaucaugccacggcacuccagccugagcgacagagcaagacuccaucucaaaaaaaaaaaaaaaaaaaugaggaaagguggaauaaccaccucaugaaugcagagaagugagggugaccaauuucucugugaaucagcaaugggacucagaggacagcccucacccacucccacuccuggacucugcuuucuugggaagacccuugaggaagcggccccauccaggguagaaccugacccuggggcccucuuguccuggaaugcaggugccacccaaucugagagggacauaccuucccaaagggcauaguguaauacuccacgugauugucuuuaauuuccaggggcuucuggcugucaucagccacuauuacggucaagucuggguaauacucucgaauacuccggagcaugaucaugagcuugugggggcggaggaaagucuugguagcaaugguaaccagguuucugagcuuccucucugggcagaaaacagugggugucagagcucuguccuguaggaagcuucacugucuuuuccugcuuugaucugauggcuucuuucugccauaaccugucagugucugugggucucaugccucuuguacccaggaggugcuuaauaagaguuuguuaguugcauuagaaaauaaagacauuuacaacauacccaauuuguugcauuuccugguucuguuggcuccacuaugucauuucccaacugucugucugaaugcuucauuuuacaccuccugccuguuagcacuuugcuuauguccugcuuucuuccuuuuuuuuuuuuuuuuuuuuuugauacggaguuuugccucuguugcccaggcuggagugcaauggugcaaugucggcucacugcaaccuccgccucccagguucaagugauucuccugccucagccucccaaguagcugggauuauaggcaugcaccaucacacccagcuaauuuuuguauuuuuaguagagaugggguuucacuauguuggccaggcuggucucaaacuccugaccucaggugauccaccugccucggccuccuaaagugcugggauuaugggcaugagccacugcuucuggccuucaucuuaauauuaggaguugaaaugcacagagcuuugcccaucuaaggguucaauauggagggucaugaagcccaggaagaggagaaaauaucuacaaaucuugagacuugcuucuaccaucaucugcaacuccuagagaaaagcuuaccugaucucuauccucaggaagacaugguuagaaaugucuccaaauacuuggagaucacaaggccuggacagaauuguccaucuuaaggcaugugacguauaagagacuggagaggggacagcuuuccuaaggaaaagaccccgugaugccacaacuggagcugcagauguguuugggauucagccacuaaacggagaacuggcaucugacugugcaguugccaugucugcauggcauggggccagcuggaguuaaugcaugcuggaagccacaacccuaccuguuugugggugagugcacagagccacuuucccagaaugacaaaaaucagaagucguuuggacagaaguuguuccagaacccucccccugugccacccucuugcccuuuuuuuuuuuuuuuuuuuuuuugagacaguuucuggcucugucacccagacuggagugcaauggcaugaucucggcucacugcaaccuccaccucccagguucaagcgauucuccugccucagccucccaaguagcagggacuacagacgugcaccaccaugccugauuuuggauuuuuuggauuuuuaguagagauggguuuucaccauguuggccaggcugaucuugaacuccugaccucaagugaucugcucaccucggccucccaaagugcugggauuacaggugugagccacugagcccagcccauucuguuuuuugucauugcaaacagcgcugcaaucgaacaaaugucauuucacacagauauaaauaucuguaggauaauuucuagaaguggaauugcuggccuaaaggauauacacauuuaaaauguugauaggaacugccaaauugccucccgagaggugccaauuuacauuccuaaccacaguugauaugcuguuuuuccagcccuguccaaaaccuuuugaugugaaaguaguuuucauaugcacuuuucucagugugagagugggcauauauuuuaauggcuaaaaguguuacugaauuuaauuuuuucugaacugugcauuuuuccauuauuggguguucuuuucuuauugagucauagaugcucuuaaguaaaauuagaccuuugucuuuaaugugaaucgaagauuuuuuucccaauuuguccuuuguuauuugacuuuacuuauuaaaauuugcuaauuugauuagccgggcaugguggcgggcgccuguagucccagcuacuugggaggcugacgcaggagaauggugugagcccgggagguggagcuugcagugagcggagaucgugccacugcacuccagccugggcaacagagcaagacuccgucucaaaaagaaaaaaauuugcuaauuuuaauauauaaaauuuuauauauuuuauauuuuuaauuuuuucuuuauggucucugaguuuugugucaugccuuauacccuaagaauguuuuuugaaacuacaaguuuuuuuguuuuuuuguuuuugagacggagucuugcccuguugcucaggcuggagugcaguggcaggaucucggcucacugcaaccuccgccuucaggguucaaaugauacuccugccucagccuccccaguagcugggauuacaggugcaugccaccauacccagcuaauuaaaaauuaacuacagguuuuuuuucuaguacuuuaaaauguauuuagauaucugaucaauuugaauuuaucuugguaugaacuguggcauauauucaaguuuuacuucuaauuuaaaaguuauuuuucauuguuaauuuuuuuugagacagggucuugcucuguugcacaggcuggaguauaguggugauccuggcucacugcagcuuugaccucccaggcucaagcgauccucccaucuccgccuccugaguagcugagauuagaggugugagcuggauuacaggugcaggccaucacacuuggauccaacuuuuuaucuuucauauagcuacaccauuaucucacgugauuuuuugaaaagccaauuuuuaauuuguucauuuguccuccuuuaauuugacaagcugucucucucuuuuuuuuuuuuucaagacagagucuugcucuguugcccaggcuggagugcaguggcgcaaucuuggcucacugaaaccuccaccuccuggguucaagugauucuccugccucagccuccagaguagcagggauuacaggugccugccaccacgcccagcuaauuuguguauuuuuaguagagaugggguuucaccauauuggcuagacuagucuugaacuccugaccucaggugaucugcccaccuaggccucccaaaguguugagauuacaggcaugagucacugcgcccggccagacaagaugucuuuaucacacagugaaauuccaacauguauuggguuuauaucaggauuuccaauuugauucaauaccauucuuuuuauuauuauuacuuacuaaaauguuauaauuuuuuagcuuuuuuccccaaaauuagcacacaaccacauaauaaguuaaauauaauuaagcaauuuuaggggauugugucuuagaguuuuuuuccuccaaacgaagcuugucagggagcauaucagagcugucauuuugaucaauucuccuccgucucagaggugaucccuucugaauuucaccaauagcuucacaggguugccaccacggagccccaaggacaagggccuuaccugguccagggucguauagcuuggguaugacaggauggcggauggucacuggaaacuuggccacugaggaccuggacuccagacucacuggagggagaaauaagauaauggcacagggaguaucaugucuggauuaaacuccaugccaccccgggaagccaccaugacaggcgaguacagguuugguggggagaguccugguugggaugagaucaaggaccccauagagucucuggcauucaggcuucugccuugcugugucccuggggcaacgugcugaaugacuccuaaguucacauuucuuccccugugagaauguguuaggguggagugggcuugaaaccagagggucugggcuaaguuugacuuuaccauuuacuaucugauuuuuuuaucugucugcaaaaccaggauaaaaauacccacccuauuuuaucucacaggguaaucuuaugaagaggaauguuugaaaaucugaagguagggagaacuaucucuuuagcuaguggucaugaauaucaucuguaaccguguuacauuuuuuucuguugauguccugggaaugcauccuguguauccggucaaaagagaaaagggugcuuuuaacucauccagaaggaaacucaggcugcccugagaguggcagggauuguucucccuagaauuucuuggugggagggaaggaggggagagacaaagcccuuggaauggggaguucucccaguucuuuccuauuagugcccaagacaagaugcugaggcacaggcuggcucccuccucuacugcaguggaaaucuucagcuuugagagcugcagaggacugggaaaagaacugaaugguucucaccaggugcaaagcgcacagcaugauuuguucucuccucgaguggcucuauggggucaauggcaauguggggauaguacuggguacaguaauuaugaaauuaugugucugggauuagaaagaggaaagagggaaggaaucuuaaaagcaggcaggcaggccagacgcuguagcucacgccuguaaucccagcacuuugggaggcugaggcagguggaucacgaggucaggaguucaagaccagccuggccaagauggugaaacccugucucuauucaaaauacaaaaauuagccgggcaugguggcaggugccuguaaucccagcuacuugggagguugaggcaggagaauaacuugaaccugggaggcggagguugcagugagcagagaucacagaacugcacuccagccugggugacagagugagacuccgucucaaaaaacaaaacaaaacaaaacaaacaaacacacacaaaacacaaaaaacaggaaggcuuccugaaggaggaagacuuugaaagggcccagagguaucuucuggaucccuaagcauuuugcacuccaaggacaggcucucaccuaugucuaccuucuggugcugguaccccgugcugguguaugucacgugcugaagaaugaacuucaacagcuuccggucacugguagaaaugaucagcugcuucuggccucugcccugcaccacacugucugggacaucagcaaggguguucaguguccccagagaagcugucagggugaccuagggugggugagguagaaugaugcucaaugcagggauuggaaaauaucucccuggaaagauacauacauacccaggccaggagccagggcagagcacauaagggugaggggagaagcaccagggugcccuugacaguguagggcuggcucugcagggagucacugugcuagcgcccccgcccccaaucccccaaguccuagggccccaaggaugaaaggacccauuucuggaaacauucccaucucucagcucgcaggguuccguucuucuuggcuucuuauuccacccacagccuuuuuugaccucucuuugacaacuccucuuccucucucuauauaucuccaaauggaguuuuucagaccuugaucuggauuccuuuuuuuuuuuuuuuuuuuuugagauggagucuugcucugucacccaggcuggagugcagugcaugaucucagcucacugcaaccuccaccucccagguuaaagcaauuauccugccucagccuccugaguagcugggauuacaggcaugagccaccacacguggcuaauuuguuuuuguauguuuaguagagacgggcuuucgccguguuugccaggcuggucucaaacuccaauccuagacucuuuucccuucuuacuccacaccuuccugcuagauuucaucuguuuccaugguuuaaaacccguucuuuugcagauggggucacauuguaguaagucucagcucaccuuucugagauccaacugcugggaccuuucacaagcaacucaaacuuguugucuucaaaauggaacuacugauuuuccucuaaaaaccuguuuccucccacccucaccuccauucccucugccuuguggauggcaccuccauccacucaguuguuccaggccccaagggaaguccuccuugcucuacccuuuucugcacacagacagcccaucuggcggcaaguccucucagcucugccuccaaaaugcagcuagaacuggcuuacuccucuccaccccauugcuacccccacagccacucucuucucuugccuucugugagucaucgcaguuaucuauuaaaggaaauugaauagugucacucccgacacuguugauacuagucagucaacagacacuuucuaaaaaccgaguuacaggcacugggaaaacagcaguaaauuccuucgugaagcuuguauuccagcguggaagagagaugauaagcauggaacuacgcgcagcagggaauucagguccagagcaggacuacgaagaagacaauauagccaggcacgauggcucacgccuguaaucccacugcuuugggagaccgaggugggaggaucauuugagcgcaggaguucaaaaccagccugggcaacauggcaagaccacaacucuacuaaaaauaaaaaauaaguaaccaggggccagacacgguggcucaugccuguaaucccagcacuuugggaggucaagauggaucacuuaaggucaggaguucgagaccagccuggccaacauggugaaacccugucucuacuaaaaauacaaaaaauuagcuggguguaguggugcaugccuguagucccagcuacuugggaggcugaggcaggagacucgauugaacucgggagguggagguugcagugagcagagauugcaccacugcacuccaggcuaggugacagagugagacuccaucucaaaaaaaaaaaauuaaccagguuuguuggugcgugccugcagucccagcuacucacaggcugaugcgggaggauugcuugagcccaggaggucaagccugcagugagccaugauugcggcacugcacuccagacugggugacagagugagacccugucucaaaaaaagaagacaacauagagaaacaagaacuccauggugacaggugguggaggccuugccgaucugcucacucaucacccauuccaaccucugaccaacauguaaaggugggaaaacuaaaaccacacuucccagauuccucuugguuaggguucugggcacaauuugcaucccacugaucagauauagcaccauaagaucuugauguggagcugcauaaaguggggaaaggaaggcagggcacaagcaccgucuguccugccagcccuaacccugacagaggccacgcagugccagagcccauggcuguaguggccgcuuccucuugcaccagaagcagcagcagccagugggucccauucuucaguguggucugggaaguccucucuggaacuccagccacucccaaggcuagaaguuaaguuuucuacacacccuuccauccccucccuccuugggcucaugucugaccuugaaucuggacaggggcuccgucaaaggcugagagcagccacaguugagggaaugaggacaggacaccaagugcaaagaggggcugggagaaggacucaccucauagacgggggcaucggguccuucaaacuggaggccuggaggacacagggaaaaggaaagaaaacugcucaugaaagacaucgcagcuccccgcugcucucgccaaccucauggacuccugcacauccuugagagcuccuucaagugucaccucccgcccagaguguuugcugacacgugcgccucuccccagggcucuguuaagugguguuucguggucuuucucaaaccccaacgguucuaaaaccucugaugcccguccucaguuuuggaggcugugaauuaauucaguuccuucagggaaucucugucacugaaggggaggaagcaauggaugaauaaugaaucaucuuguauaaggcaccuggaguagccaaacccauagagacagaaagcagaacggugguugccaggggccagggagagggacaguggggaauucaguuggauggguacagaguuucaguugggaaugauggaaaaguucugguggugacugaugguugcacaacaacaugaauauacuucaugucacugaaguauacacuuuaaaaugguuaaaauaguuaauuuuggcugggcgcgguggcucaagccuguaaucucagugcuuugggaggccgaggcgggcggaucacgaggucaggagaucgagaucauccuggcuaacacggugaaaccucgucucuacuaaaaacacacaaaaaaaaauuggccgggcaugguggcgggugccuguagucccggcuacucaggaggcugagcgggagaauggcgugaacccgggaggcggagcuugcagugagccgagaucucgacacugcacuccagccugggcgacagagcaagacugcgucucaaaaaacaaaaacaaaaacaaaaaaaaguuguugauuuuauguuuaaauauuauauauuauaaauaauaauauauauguuuuuauauaacauuaauauaauauauauguuucuauauuuuauauauauacauuuuuuuuugagauggggucucacucugucgcucaggcuggagugcaguggcgcaaucucaacucucuguaaccucuaccucccaaguucaagugauucuccugccucagccucccgaguagcugggacuacaggugugagccaccacauucgacaaauuuucgauuuuuaguggagaugggguuucaccauguuggucaggcugguuucaaacuccugaccucaaaugauccaacagccucagccucccaaagugcugggauuacaggugugagccacugcaccaguccuuuuuuuuuuuuuuuuuuuuuuugagacugaaucucacucugucauccaggcuggagugcaguggugugaucucagcucacugcaaacuccgccucccaggaucaagcaauucuccucacgaguacugggaccacaggcauguaccaccaugccuggcuaauuuuuguauuuuuaguagagacaagguuucacuauguuggccaggcugguuucaaacuccugaccucaagugauccauccgccucagcccccaaaguggugggauuacaggcaagagccacugcacccagcccauuauauauauuuuaucacaauaagaaaugaaucauccaaaaugaaaaacaguuuuuaagauggcuauucaagaacacuagugcuugaccccaaaugcauuuacuuuagaaucuaucucuguucucauaguaggacuaauucaaauuugaauucaaguacauccucucuauguggccuuugauaacuuacuaaacucucaucucugcuucccuguccccuuuguccccugucugggaccuugcccuuccuucugugugggacaugccaucuguugauguccugcaucccccucugucucaggcagucauucucaucucaccuguuugagaugugguuugugaaauucagguaucugucaugcuccucagugcuggaccuggagagagcucggcuggguccaugagauaugucagauccccaggugucaccacaccgagaccuuacuuggaggucuuuucuggggcuugcagguuucggggggcuguuugccuccagaagccaugagcccacaagcagaagaagacuucacuggacagacccacagaauccaacaucucugcacugggaggggacaucugugccugcaggcucauccuucuggucccucugauaauauucaacuuuauucugaugaggaaugugaugcugaacuagagggguguguaaaaauccaucauggagggcaguuuuaaccaacauaaauauucuuuucacaaugcacucccggccaggcucaguggcucaugccuguaauccuagcacuuugggaggccaacgcagguggaucaccugaggucaggaguucgagaccaguuuggccaacauggugaaaccccaucucuacuaaaaauacaaaaauuagccagguguggugggcacuuguaaucccaacuacuugggaggcugaggcaggagaauggcuugaacccaggaggaggagguugcagugagccgagaucaugccauugcacucuaaccugggugacagcaagacuccguccccaaaaaaaaaaaagcacuuuuuacagaguggcuuauguuuugccuguucccaugaugauggaggacauugaaaagccaauuauguccuaagauucuuugaggcacacagauuucuguccucuccuguguuaucuuggagccccaggaggucauggcuacuaaaggagauucccaguuguggauacaauaaggcuaacaugaaaugaaaucacaucaagccaggcgcgguggcucaugccuguagucccagcacuuugggaggccgaggugaggagaucacuugaggucaggaauucgagacuagccuggccaacauggugaaaacccgucucuacuaaaaauacaaaaaauuagccaggcaugguggcagaugccugucaucucagcuacuugggaggcugaggcaggaggaucauuugaacccgggagguggagguugcagugacccgagaucaugcuacugcacucuagccugagagauggagcaagacuccgucgcaauaaaaaaaaaaaaaaucacaucaagcuucuugccuugugcugaguacacagcagguaccaaugaaugucugcuccauacuuuuauuuauuuauuuuuuaucuauuuuugagacaggaucucacuuugucacccaggcugaagugcaguggcacaaucucugcucacugcagccucggccucccagguucaagcaacccuucugcuucaaccccacaaguaguugggacuacaguugcccaccgccacauccagcuaauuuuucuauuuuuuguagagacaggguuuugccauauugcccaggcuggucucaaacuccugagcucaagcaguccacccaccucagccucccaaagugcugggauuauaggcaggcgugagcacagcacccggccccuuuuauguuguuguuuuuuuaagagacagcggggucucacucugucacccaggcuggaguguauuggcaagaugauagcucacugcagucuugaacuccugcuuuggacucccaaagugcuggaauuacaggcaugagccacugcacccgaccucucccuccuuuugccuuagaagagugagaauguugucuggggucucuugguauguggauguacuuaccugggaugggaaccgugugcaggggcaucaccuccacuccguggacuggguacccaaaggggagguugggcuggaccagcaggggcagugggcggggcagcccuucucugcaggaaggagaacagaaacgucagcagcugcccugaugcuggucccugguucguucucaaaguggugccugugcacagagccuugcccugacaauauggagaaaucaaaauuggguugucccugucucccuccauucucgucacccaggcuggagugcaauagugcgaucucggcucacugcaagcuccgccucccgggcucaagcgauucuccugccucagccuaccuaguagcugggauuauaggagugcgccuccacgcccggcuaauuuuguuguauuuuuaguagagacaggguuucaccauguuagcuaggcuggucuugaacuccugaccucaagugauccaccugccuuggccucccaaagugcugggauuacaggcgugagccaccgcaccuggcugcauuuuuguuuuugagacaggguuucacuuugucacccuggcuggaguacaguggcacaaucacggcucgcagcagucuugaccucccuggcucaggcaguccucccaucucagccuuuucauagcugggacuacagguacaugccaccaagcccagcuaauuuuuaaaauuuuuuuguagagauagggucucacuauguugcccaggcuggucuccaaccgcugggcucaagcaauccuccugccucagcugucagagaagccaggacuauaggagagagccaccaugccuggcuaacaaagcauauuuuuuuuaaaaaaaaccaugaccagcauagaagaaggaaauuaucagacgguaggggcccacccagcugcagcagcuaaacaccaaagucacaucugaacuucgugggaaccaggauaaaagcgauugacaaucaucacaugguccuuaauauccaaaggaagaaguagaccaauuccugaagggagguggaacuucuccuaccgcugaaauaauaaauaaacuaaaucacaagaaaguguauaugggaguaauuguugucacaauauuuuuagaggaaacagaguaacuauuuuuaugguuuuuuugguuguugauaacgauuuuuuuuuuuuuuuugugacagagucucgcuagguugccaggcuggaguucaguggugcgaucucagcucacugcaaccucugccuccuggguucaagugauucuccugccucagccuccuuaguagcugggacuacaagcacacaccaccaugcccggcuaauuuuuguauuuuuaguagagacgggguuucaccauguuggccaggauggucuugaucucuugaucuuaugauccgcaugccuuggccucccaaagugcugggauuacaaauguuagccaccacacccggccaauaacaaucuuuagucaaaagcaagcacauagcaccauccagcaagauuagcuuuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuaagauuagcuuuuugaggaacuacgguacaaugguugaaauguuagccuucgggacccaguuuaagcaggagaucauuuaauuaccuugaaaaaaaagauuagaucaucauagugaauacuuacgguaauaugaaaaaggcaaaauuuuuauuuuuuauuauuauuuuuuuaauugaucauucuuggguguuucucgcagagggggauuuggcagguucacaggacaauaguggagggaaggucagcggauaaacaagugaacaaaggucucugguuuuccuaggcagaggacccugcggccuuccgcaguguuugugucccuggguacuugagauuagggaguggugaugacucuuaacgagcaugcugccgucaagcaucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaaugaaaagucucccacgucuaccucuuucuacacagacacggcaaccauccgauuucucaaucuuuuccccacccuuccccgcuuucuauuccacaaaaccgccauugucaucauggcccguucucaaugagcuguuggguacaccucccagacggggugguggccaggcagaggggcuccucacuucccaguagggguggccaggcagaggcgccccucaccucccggacggggcugcuggccaggcggggggggcugaccccccccaccucccucccagacggggcggcuggccgggcggggggcugacccccccaccucccucccggacggggcggcuggccgggcggggggcugacccccccaccucccucccggacggggcggcuggccggacagaggggcuccucacuucccaguaggggcggccgggcagaggcgccccucaccuccuggacggggcggcuggccagguggggggcugaccccccccgaccuccaaaauuuuuaaaugguaaagaacauaaacagguaauuaacggaagaggaaauacaaauggcaaugaacauauggaacauacucagcuucaaucagggaaaugugaauuaaaaaaaacauggaauaccuuuuucauuaaaguuugaaaaugugaugauagcaaacguuaguuagguguauguaaggugcaacacuuacccacucuucaugaaagugugaguucacacaagcccucuugagggaaauuuggcaauaucuaucaaaaauaaaaaaggcacacccugggaucuagcaaguaagaugcuaggugaaaggagaaaugcuugcauguguaagcaauaagacaagcacaagaauguucauuucagcauuguuugaaaugaacauccuuauacguguauuuuucuuuuuucugagacgaagucucacucacucugucacccaggcaagaugcaguggugugaucucggcucacugcaaacuccaccucccggguucaagcgauuuuccugccucagccuccugacuagcugggauuacaggcauacaccaccauguccagcuaauuuuuguauuuuuuuguagagaugggguuucaccauguuggccaggcugguaucgaacuccuggccucaagugauccgcccaccucagccucccaaaguguugggauuacaggugugagccaccgcgccuggcccuuauacaugucuuaaugaaaaaggaaauaauguaaauauaauguaauauuauuguaaauaauguaaauguaaacaugaagguuuuucaacaaucuaaauaccuuucaauagggaaguggcuuaguaaaaugcagcauauucauauucauagcuauauugcaauucagagggaugaacuagauauacacauagcucuuaaaaacauuucauacuccuuuccaguucuggccccagacccugcagccaccgagauguugaugccuaagaagaacgggaaugcauuuaucaacuccuuuuuuuuuuuuuuugagacaaggucucgcucugucgccagacuggaauucaguggcacgaucucggcuuauugcaaccuccaccgcccagguucagacgauucuccugccucagccucccaaguagcugggacuacaggcacaugccaccacgcccagcuaauuuuuguauuuuuaauagagacgggguuucuccauguuggccaggauggucuugaucucuugaccucgugauccgccugccucggccucccaaagugccgggauuacaggugugagcuaccgcacccagcccuaugaacuccuuuuaaaggagggagucacgguggccaagaaggauguccacaugccuaagcaccuggagcuggcagacaagaaggugcccgaccuucaugucaugaagguugugcagucucucaaguccggaggcuuugugcaggaacgguuugccuggagacauuucuacgcguaccuuaccaacaaggguauccaguaucuccaugaugaccuccaucugcccccagagauugugcuugccaccuuaugccacagcuguccagagacuggcaggucucugccugaaggucuggagggugagccaccugcaagacccacaaguggggaagcccacagccugcugccaacaagaaugccgaggcugaggcugugucaacaaccaaauuccaguaagaggcagauuugguuguggauguggucagccaccucaguaaaauuggagaggacuuuuguuuuguuuuuauuuuuuuuucgagacaggaucucacucugucgcccaggcuggagugcagcggcacgaucuuagcucacugccacugccaccucccagguucaagugauuguccugccucagccuccuggguagcugggauuacaggcgcccaccaucacgcucgacuaauuuuuguauuuuuaguagagacaggguuucaccauguuggccaggcugggcuucugaccucaggugauccaccugccucagccucccaaagugcuaggauuacuggcaugagccaccacacccacccagaggauuauuuugcauugaauaaacuuauaaucugaaauauauauauauauauauaauugaauaaaaaaacaaauuucagagugauuuguuuuuaugguaccaaguacacuaaaauacacaaaaaaccaacaguauauguuuauauggauauauauacacacacacacacacauauauauauaacauacauguauauaacaguauuuaaaaauaguguggaauaauacauaccaaauucauaauggcagacuccuuagcuagguuuacaagggaaccuaucauuuaagaaagggacgagaauagcagugguaguggucaggggaguggguuaaaauggacuuuuucuggccaggcaugguggcucacgccuguauucccagcacuuugggaggcugagacagcuggauugcuugagcucaggaguuugagacaagccugggcaacauggcaaaaccccauaucuacaaaaaaacacaaaaauuagccaggcaugguagcaugcaccuguagucccagcuauuugggaggcugaggugggaggaucccuugagcccagaaaguggagguugcaguggguagagauugcaccacugcacuccagccugggcagcagagccagaccuugucucaaaaaaaaaaaaaagaaagaaagaaaagaaaagaauaaagaaaaagaaaacaagaaaagaagaggaaaaaaaugaacuuuuucuuagaggagcauuacacaugcugcuuuuuaauggaaguauaauguagcacuaacacacaggaucagauugaccaaucagccucaacugagucagagaucucauccaguaucaagcucuauuuguaauuucaaggauacagacaagaggcacaaacauccucuuaauuagucauccuauauggauccccgggucauuccuuccacaucagucaugcauucuccggaggauaacagauguggucucuaaaugcaauuuugccagauuaccucauccaacauguaacgaagaauguaaauuaagaaacaucuccuguauauacuccagagauuuauauagcuuaugugacauuggccagggagcaaaugauucuggguuauuuaucauauguaauuucauuagcugaagacauccugcaagagcagugccaaccuucagggaaucccuaaucuaaggaaggagagagagcccaaucuuagaaguaccagucuaagggaggagacauagcccuuguaaucaugaaccuuccagucugauggaggacaguuuagcucucauagaggccuuggacugaugggaaaacuacauucccaccuuaaggagcccucaaucagacaggaauguuuagacacauggcuuagcuagaauuugaggaucccuauggaguagucagcaauggaaauuaagaaaagacaguguugggccaggcaugguggcucacgccuguaaucccagcacuuugggaggccaagguggguggaucacuugaggcuaggaguucaaaaccagccucggcaacauggggaaaccccaucuccauaaaaaauacaaaaauuaacagggagugguggcgugcaccuuuaaucccaacuacucggguggcuaagccagaagaauugcuugagccugggagguggagguugcaguuagcugagaucgugccauugcgcuccagccugggcaacaagaacaaaacuccaucuugaaaaaaaagaagaagaagaagugcggcaauggauucaugcucauggaauucacuggucuuaccauguuccccaucauccugaagcagcuggauugauagaacgguggaauggccuuuugaagucacaauuauaaugccaacuaggugacaauacuuugcagggcugaggcaaaguucuccagaaggccauguaugcucugaaucaguguccaauauaugguacugauucucccauggccaggauucacggguccaggaaucaaagaggggaaguagcacuacucaccaucaccccuagugauccacuagcaaaauuuuugcuuccuguucccgcaacauuauguucugcuggccuagaggucuuaguuccagagggaggaacgcugccaccaguguacacaacaacaauuccauuaaaguggaaguuaauauugccaccuggacacuuuggacuccuccuaccuuuaugucaacaggcuaagaaggaaguuacuguguuagcuggggugauugacccgggcuaucaagauaaaaucagucuacuacuccacaauggagguaaggaagagugcacauggaauacaggagauccauuagggugucucuuaguauuaccaugcccugugauuaaggucaaugggaaacuacaauagcccaauccaggcagggcuacaaaugacccagacccuucaggaaugaagguuugggucacuccaccaggaaaaaaaacauuaccugcugaggugcuugcugaaggcaaggggaauacagaauggguaguaaaagaagauaaucaauaccagcuacgaccaugugaccagcugcagaaaugaggacuguaauugucaugaguauuuccucuuucuuuuguuaaaaacauguuugugcauauacacacuuguacuaagaaaauaucuucauuuuauuuccuuuuccuuuaucaugugacguaagauuuauugacuucauaucagcaucuaaguauuguuaacuuuauguaauaguauuuggguuggggauuggugcguuucuggucguacaaaagauaguuguauuauguuaggcauaauuauaaccuuauuauugucuuuauuugaagauuauguaugaucucaggagauguguauggguucaaguugacaagggguggacuugugcugguuaauacuaaaugucaauucgauuggauugaaggaugcaauauugauccagggugugucugugaggguguugccaaaggagacugauauuugagucagugggcuggggaaggcagacccacccuuaauugggugggcaccaucuaaucagacgccaucgaauauaaagcagacagaaaaacgugaagcaaugagaugagccuagccucccagccuacaucuuucuccagugcugggugcuuccugcccucgaacauuggacuccagcuucuucaguuuuggaacuuggacuggcucucuuugcuccucagcuugcagacagccuguugugggaccuugugaucauguaaguuaauacuuaauaaauucucucucucgcuuucucucucucuccccccuguuaguucugucccucuaagaaaacccugacuaauacaugggguuucaccauguuggcuaggcuggucucaaacuccugaccucaggugaucugccugucuuggccucccaaagugcugguauuacaggcgugagccaccaugcccaacuggagcuagguguuauuagcauccucauuuuacagagauuaagcagcuugcccaagaucaccuagcuggcagauagaggaugcaggaccugaaugcagccagucagcuucccgcggcagcacuguuaacuaccaagaccaguugcuccucacauagcuaggugcaccaggguugaaauccaugccagcaucaccuguguauuccacuggcuguccagcuuucaacaccuccugauggagacggugccuccaucugucuucuggggagccuuccacuugcauguaauuuggaggguaguggcuacuaugguuugaauguguuccccaaauuucauguguuagaaacuuaauucccaaauucauauguuguuuggagguaggggccuuuaggaaguaauuaggauaaggucaucagguagggaccccaugaugggacuggugguuuuuguuauuguuguuguuguuuugagauggagucucacucugucacccagacuggagugagugcagcggucugaucucagcucacugcaaccuccaccucccagguucaagugagucuccugccucagccuccugaguagcugggacuacaggcacucaccaccacagccuggcuaauuuuuauauuuuuaguagagauggaguuucgccauguugcccaggcuggccucgaacuccugaccucaggugguucaccugucuuggccucccaaagugcugaaauuacaggcgugagccaccaugcccaaccaagggacugguaguuuuauaagaagaggaagagagaccucagcugaugcaugugcucuugcccugucaauaugugguacccuccaccauguuaugauguagcaagaagccuucaccagaugccagcaccgugcuguuagacuucucagccuccagaaucguaagcuaaauaaacuuaccuuuucuuuauaaauuacccagucugcaguauucugcuauaguaacagaaaacggacuaagacaguggcuagcuucaaaagucaaaccuggaggggucugaugcacccuuucccuuccuuuugauucaugaguuaggcucaguuaauugagcacuaaggcaguaaccuggggacaguucauugcagaagcaacaacaauauggggaccagauggcccuggagccugaccaguucuucagugcuccguuaguucuuaccugauuuccuagccuggacauccuaccaccuauggauuugguaaggccccagcauccuucuaacaaguucccuuuugauacaagccaggcagaaucaaguucagcccuuuucuuguuuuuuguuuuuuuguuuuuguuguuguuguuguuuguuuguuuguuuuuucucuuuucuuuuuuuugagauggagucuugcucuguugcucagguuggagggcaguggcacaaucucagcucacuacaaccuccaccuccuggguucaagugauucuccugccucagccucccaaguagcugggauuacaagcgugcgucaccaugccuagcuaauuuuuguauuuuuaguagagaugggguuucaccauguuggccaggcuggucucgaacuccugaccucaagugauccgcccaccucagucucccaaaguguugggauuacaggcgugagccaccgcgcccagccaaauucugccuuuuucaaccaacaacccugguugauacaccugaguguugacaccccuuguaauuuaaaacaaagggauacacuccuugcauauagcacaggguaguaugcucucaacauauaaaugaauaaaauagggcaccuuggugaugacuacaaaaucaccugcuaugauggccugggugcauggaggauguaccaccagauguuucaaacuaucuccauuccuuuuguuuuuuuuguuuuuguuuuuguuuuuguuuuugcuuuuguuggagacacaguuucaaucuguugcccaagcuggagugcaguggugugauccuggcucauugcagcuucaacuuccugggcucaagugauccucucacuucagccuacugaguagcugggacuacaggcauguaccaucaugccuggcuaauuuuaaaaauguuuuguagagaugggggucucacuauauugcccaagcuggucucaaacuccugggcucaagcuauccucccaucuugaccucccaaagugcuagaaugacagacaugugucaccaaucccagcuuuuuguuguuguuguuguuguuaugaaauguuuuguacauacaaaguuuuguaaaucuucauuuaaggaugauuuccucgauuccuucuuuguuucauuccuaauaguuccucccagggacccuugcaagagagagaauuccuuccugcuuuuucucuuaagauucacaaccucaggacauagggagggcuuuuguuccaucucagaacccaagggccuucaugacccgcauuaccuccucugaaaguguucaaauucagccugucuccucgcuuucaccgcugggaggucgcucuggccauaggcauccugaaaguuguaaccucccugcucuuuguuggcuucacauuugcacugauuuuucgggaacagccugaaacaagcaagaggacuguaaacauggauuggguggguaggcuggugggugagaggaaaccggaguccuaauccaguguguaguuuacccugaaaaucuucuuuccuacacccaacuguucugagaugaugagacccuggaguccccugcacuggccccucacagagacaaggggacaaagggagggaagcagggacagaggaaggcugaagacuuuuccucucuugaauuguccccugcaccuaacuucuuuaaaucugagagccacgugacugucaguuguaucucaccccaccauaaaaggagggcagagagacagagaagcagcaucuuuucugcaguuuugauaaaaaaaaacuacaugcucucgaaaguuuuaagggauuuugcuggaugcuauagagaacauagacuggaucguacagaccaagccccauccuggcuugcagucacuugugcauucagcacaggcuuaggaaagcaagggaaccaucuguacaaugggcacaguagggcaugguacuugaggaggagcaaggaagaugugugcauuaaggugaaagaaagaacacgcagucucucaccagauuccaucguaggaaaagagguuccugagacguuccucaggcagaagcuucagcuucuggacacccggggcaggacuugggaguucuggcuuggggcugcugaacacugcuugaaggaacaugcuuccgaacauaaauccaacaaugccaaguaccaggauuaugaccaauaucuugaggagccacagaaaucucgagcuguugggacacaaaagaacagauuauguuaaaaucuuuuuucuugauuauguaauguauaugagacugauaauuucaggaaaaauguaagcuaagcacauagcuuauauuggucacuaaaaucgauuucugauaaacagaggaggaaagaaucaaguugcaacaaagggacuuagaaaaauuacaaauaaaaggauggcaaaaaaauccagaaaaaaaaaaagguuagaggcugggcacgguggcucacaccuguaaucccagcauuuugggaggccgaggcaggcggaucacgcggucaagaaaucaagaccauccuggccaacauggugaaacccagccucuacuaaaaauacaaaaauuagcugggcaugguggcgugugccuguagugccagcuacuugggaggcugagacaggagaaucgcuugaacccgggaggcggagguugcagugagccaagaucacgccacugcacuccagccuggcgacagagcgagacuccucaaaaaaaaaaaaaaagguuaguaauguuaaugucagcauagcuaaauucaaggcaauaaaaaagaguauuaaauaggacagaaagaccacuuauagugaucaaugcaugauaccaaaacagauagccgugaacuuuuauccacuaauaauagcauuaaaguauacaaaguaaaaaauggcaggauaugaaagaaggauuagaaauacaaagauaguuagagaugcugacaugucucacuugaucaagucucaaaaauauuuuaaagcagcagaacaacaaaaugauauaauuuguauucuguuaaagagcucuuaaaacauuuauaaaaauuggccacauaugccgggugugguggcucaugccuguaaucccagcacuucgggaggccaaggcggguggaucacgaggucaggagaucgagaccauccuggcuaacauggugaaaccccaucucuacuaaaaauacaaaaaauuagucggguguuguggcggacgccuguagucccagcuacucgggaggcugaggcaggagaauggugugaaccugggaggcggaggucgcagugagcugagaucacgccacugcacuccagccugggcaagagagagagauucugucucaaaaaaaaaaaagaaagaaaauccuguuuugcuuuuauucacgugguuauuauaaauuauauuauauuauauuuauaaauuaauauagggcaaaguuacaucucuacaaaauugagcuauucuagucaagaauaaaaagaagguaucucaaucuauucauauauauuucccuaauacagugguaauuugagacucugucucaaaaaaaaaaaaguuggccacguauuaggacacaaagaaaacuguaauaaaguagaaaucguucagaucauacguucugacaaugcaauucaaauguaaccucgccgggcauaguggcucaugcccauaaucugagcacuuugggagaccuaggcaggaggaucacuugaagccaggaguucaggaccguccugggcaacaaaacaagacccuguaucuacaaaaaauugaaaaauagccaagcaccguggcaugugccuauaguccuaacuacugaggaggcuaagucaggagaaucccuugagcccaggaguucaaggcuguagugagcuaugaucgcacuacugcauuacagccugggcaacugagaccccaucucuaaaaacauaauaggcugggcauggugucucacgccuguaaucccagcacuuuggggggccgaggcaggcggaucgcuugagcucaggaguuugagaccagcaacauggugaaugucucuacugaaaaaaaaaauagcugggcaugguggcccaggccuguggucccagcuacuugggaggcugaggugggacgaucacuugagcccggagggcgaaggauauagugagucaaaacugcaccacugcacuccagccucggugucagagggagacucugucuccaaaaaaaaaacaaaaacgcccacugcuauuaucuaacauugucauggaagugcuaaucaaugcaguaagauuagcuuauagaauaaaacauaaauaacgaaaagggaaauaaaaaguauuauuuacaggugaaaugauuacauauucagaaaacuaaaauguaugaggugagaagcuauuaguaagauuuuaauaggguaccuggugacaaaauauaguaaaaaaauuaauaauaauaauugucuaaugaccacuuaguauguucuagacccccugccaagagcuuugugugcauuaucucauuuaauccucacaacagcauaacaagagaaguuuuauuuuuuguuuuucuuuuguuguuguuuguuuuguuuuguuugagacagagucucgcuuugucacccaggcuggagugcaguggcacaaucucagcucacugcaaccuccaccuccuggguucaaaugauucuccugccucagccuccugaauagcugggauuacaggcgcccaccaccacacccggcuauucuuuguauuuuuaguggagacgggguuucaccauguuggccaggcuggucucaaauacugaccucaggugaucugccugccucggccucccaaacugaugggauuacacgcaugagccaccaaggcuggcugagagaaguuugauuacuccacgcaaugaucagaugagauagcugaagcuaaauaggaaaaguaaccugcuuucucgguuaugacagaugcagaauucaaaagcagaccacacuuuuaaccacuacccuacaaagguuucuauaagccaacaagucagaaaacauaaugaaagcagaaaucugcuucaaauuaacaacauaacacaaaaugacccaggcaggcagauacuuaagaagaaacaugugggacuuauguggcagacucuuagguggcccauaugaucuugaucucuugggcgcuuagcaaaagauucuugguuuuuagcauuuaagaugugccuaugguugguaccaaccgacauuuccugaaaucaugcagucuugaguuauaaaucuuuaagucuauugccaugcuagaaucuuauuaauauauaggaaauuuagagagauuaagugccuaaauggccugcccaauacuuguauauuuuuaguaucacacagaacuaaaauccccggaacuaggaacacucuagaccuuacaugguuuauuccuccugucauuucaaacauugaaaguggggccuaucugauuauuugccugcucacuuuauguuuauaucuacugcauuuguaccaauauacaucagguuugugcaaccacugauuuuuguuggauuuuaaucaggucucacagugaucauuuaacaucuuccucuaagucucaucuugugcuguuauggauuuucauuuugaaaaucuacacuguauggaagcacaugucuuuaauaucuccagacauuacauuucaucgaaugcuuaaauuuuaguggguaacuuaacaggggccucccuguuaaguucugaaaaagaaugggagggaacaauuaaauauuuuugguaaaauguguuuuuuucuugugcagaauauguagaacauacauuuuaauuuaguaaauacauuuuaaaaggaaacaaugcucuguuaucacacugccuuggucugguuuguacgguuuugugcugcuauaacagaauaccugagacuggguaauuuacagggaacagaaguuuauguucuggaggcuggcaaauccaagauccaggggccacaucuggggaccuucuugcugcaucaucccaugguggaagguggaaaaacaagugagugcaugugagagacacagcaagagggggcugaauuuguccuuuuaugaggaauccacuccuacuauaacgaacccacucccaugauaauggcauuaauccauucaugagcgcagagcccuuccggccucaucaccucuuauaaggccccauuucuuaacauugucuaauuggggaugaaguuuccaacacaugaacucugaggggcacauucaaaccauauuauauaacuaaagcaauuuuuaaucauaaaauuucugaacagcuuguaauuuuuaaaauaccuauuggaaguuguuuacaguuauuuuguuuaagugugaauuuuuuccuuuucuugucaaucucucuuuggggaaaaaaaaaaguggguuucugguaaugaacugagcagacaucugauauauuacaugccuuuuaagcuguguaacuuaauauuuguauacuugauaauuuguuuuacuauguaauugauaaaauugugauguguauugauauuaguuuaauguguaagaauguaugcuuguaguucucugggagaaacaauuugccaaguguucaccagcuuguaaaacucuaaugugaggcugggcccggugguucacgccuguaaucccagcacuuugggaggccgagacaggcagaucaccugaggucaggaauucgagaccagccuggccaacauggugaaaccccgucuccacuaaaaauacaaaaauuagcugaguguaguggcaggcaccuguaaucccagcuacuuggaaggcugagauauaagaaucacuugaacccaggagguggagguugcagugggcugagaucgcgccacugugcuccagccugggugacaagagggaaacuccaucucaaaaauaaauaaauaaauaaauaaauaaauaaauaaauaaauaaacucuaaugugagagcuuaaacaucuaaguaaauaaaggcaccuuuuaaaaaaaucaaauuacugaauauacauaaaauauaaaaucugcgcccuuaaaaaauuaaaacuuuauucgauuguaugccugaaaugacacacaucaaguucuuaauugugaucugcacuauuaaaugaacauguuucuauagucucuuuuuucuuucuuuuuuaguaaugaucaagaauuaauuuugucacugaacaaauaaagaauuaagcaaauuaccacuguauuagggaaauauauauaugaauagauugagauaccuucuuuuuauucuugacuagaauagcucaauuuuguagagauguaacuuugcucuauaguaauuuauaaauuuaauauaauaaccacaugaauaaaagcaaaacaggauuuucuuuuuuuuuuuuuuugauccagagucucgcucuguugcccaggcuggagugcaguggcgugaucucagcucacugcgagcuccaccucccagguucacgccauucuccugccucagccucccaaguagcugggacuacaggcacgcaccuccacaccuggcuaauuuuuauuuuauuuuauuuuauuuuuguauuuuuaguagagacggaguuucgccguguuagccaggauggucuagaucuucugaccucgugauccgcccgccucggccucccaaaaugcugggauuacaggcgugagccaccaugccgggccaggauuuuccuuuuuuagagccaggcucucacuauguugcccuggcuggucccaaacuccugggcucagguaauccuccugccucagcuuucugaguagcugggacuauaggcacacaccacagaggcuaacagaacagauuuuuuauuggucaaaaugacucuaaaauuuauuagaaguaacacauaagaauagcaaggaagauauuaaaaauaagaaggaugggccgggcgcgguggcucacgccuguaaucccagcacuuugggaggccgaggcggguggaucaugagaucaggagaucaagaccauccuagcuaacauggugaaacuccaucuuaggcgggcaugguggcacgcaccuguagaggcaggagaaucgcuugaaccugggaggcggagguugcaaagugaaacuccgucaaaaaaaaaaaaaagaaggauagcuauauuacuacuaaagagcaaaguuaugauaaggccacaguuauuaaaagcauguuaccaauucaggaauaagcaaauaagugaauggaacaaaccgaagcucagaaauacucuguguguguauguguaauuugaguuugcacuaucuuugucacauauuucuguaacaucuuaacuucuaaauuuucuaaaaugguacccagaaaaauaaauacauuuaaacuauucgaguuauagaaacugucuuaauccauuuugugcugccauuacaaaauaccacagguauaccacagaguaauuuauacagaaaaauuuauuuggcucacgguccugaacacuaggaaguccaagggcaugguuacacaguuucagcuagauagcagaaaugccuuucaguguuuuguaacauuguaggaugaacauaguuacaauaauauauaguaucaggcugggcacuguggcucaugucuguacucccagcacuuugggaggcugaggcggguggaucauuugaggucaggaguucgggacuagcuuggccaacaugaugagacccugucucuacuaaaaauacaaaagaaauuagcagggcgugguggcgugcgccuguaauuucggcuacucuggaggcugaggcaggggaauugcuugaaccauggagguggagguugcagugagccgagauugcgccacugcacuccagccugggccacagagcuagacucugucuaaaaaaaauaaaauaaaauaacaaaaauuaguugggcaugguggcgcgcgugcgcacgccuguaaucccagcuauucgggaggcugagguggaagaaucacuugagcucgggagggaaagauugcagugagccgagaucgcaucacugcacuccagccugggugauggagcaagacugcaucucaaaauaaugauaauaauauaguuucaaauagcuaggaggaagauauugaauguuugcucccaacacaaagaaaugauaaacguuugagaagacguauaugcuaauuauccugaucuuaucacuaugguauguguuuaucacuacauguaucaaaauaucacuauguaccucaugaauauguacgauuauuauuugucaauuaaaaagaaacugcagaccuuuuaugcaugauuccacagguggaggaaaagucaaauuugccgaggauuugccagcuuuaaauuuauccgcaucaguaucaggccucccagcuuccuccuuuucagucacccaugaaggauuguggagugggggaaguuggggaaggggaacgcuggaaugaaagccuuagccaaggacguggauggaugcaaagccgccuuccuuucccccauuccgccaauccucuauucaacguguguugcugcuuuuuguuuguuuguuuguuuguuuuguuuguuuguuuguuuuugagacagagucucccucugucgcccaggcuggagugcaauggagcaaucucggcucacugcaaccucugcuuccagguucaagucauucuccugcuucggccucccaaguagcugggauuacaggcacuugccaccacacccggcuaauuuuuguauuuuuaguagagacgggguuucaccauguuggccaggcuggucuugaacuccugaccucaagugauccgcccaccucggccucccaaagugcugggauuacagaugagagccacugcgcccggccaaacguguucuuuuucaugcuuacaagaugucaugucacaaacauguuauugcauuuuugugagaugacuucuuugucaauguuuagcgauuguuuuagaguuuuggaaaauacaaacaaaauaaacuuugcggauaaaagaauaccaaauguaugucugauccuucuucguagcuuauaaaaauuaauuuagacuuucaaauguacuuuaccccguuaauuauuauaucacuccguagaggcucuuuagcacgcggggccacacaaccgcagcucacucugcccugcggugggcgccuggauuugaaaaccgacuuuucccugacuccgcgcggacuguggaggagaccaagccgccgggcuccccgacuguccacagcccgcaguccccgcgcccgggcacucacauaccccugacggcggcuccucccgugggcagcaaacgggccccaggcugggucagcgccucugaguuccaagcagagagccccgaagcccgcacucccgagccgauucccacacucgggcguccccgagacacauucccggccgcgagaggccacuuccacguggaauuuucccacggaaaagccagcgcuccccauuccugggggugcagaguucguuccgcacgcgccgucaccucgccucugcagccaccuaugcggggaaccgguuggacuuaagacuccaaccgcccgcucccuggcuccggcgucugcguccccagcaccugcccgcucugcagacgccagaaaggacccgcggcgcucccugcucccgaaguuucaccucucgcucugcucugccccggggacacucacccgcccgaagucaucccgaaucccgccgcccucagacu

SEQ ID NO: 192301 - RNA, 92199 nt, Homo sapiens
ggcggggccgcgcacgcagccgccgccaccacuucccccucucccucccuccuugcgggcccuccuccccuucccuccccuccgcccccuuccccguaggcagcccgcccgccaguccgcccgcaccgccuccuucccagccccuagcgcuccggcugggucucucccccgccccccaggcucccccggucgcucuccuccggcggucgcccgcgcucgguggauguggcuggcagcugccgcccccucccucgcucgccgccugcucuuccucggcccuccgccuccuccccuccuccuucucgucuucagccgcuccucucgccgccgccuccacagccugggccucgccgcgaugccggagaagaggcccuucgagcggcugccugccgaugucucccccaucaacuacagccuuugccucaagcccgacuugcuggacuucaccuucgagggcaagcuggaggccgccgcccagguacagcgacccucgggccccggggcaagcugcggggcgagcaguuaggccgcgcccgcgggcuggacucagggcccggccgggagggcgggcgggccucgggucggggcugggcggccgcagggcgccggguucggcgugcucugccuugcucuguuggggcuggggcuggggcuggggcuggggccggggcagggaccguggccggagcugaggcuggggcucgggcuggggccgcgcugcgggagcucuggggagccggcggcccggccauugcgccccuccccggcgagcacaccuguguggggcuuucccccccgccccggacccuucugggcuugauaguguuccgggggaggcuggaggguguugggggaggacggagaggucaugggaguccccgcucugccucaaccaccugacucaguucuuucuuugguuucucucuacaccucucgggugauagauuggaggggguggucauuugggacucuggccgccgcguuggagcgacgaggggagcuucuagaaggggggggagagggugagaacgagaauguuaaucccaggcagccucgcugacuucuccccgccugcuccagcccaggggcuggguuuccaagaugauccgcccccucccccuuucccucaagugacagugcagcagugacuuuguucucucuuaaccuccagagaagcugcgggaggaccccaucuccgcuuuuccaccuaucuuccuagcuuugcggccuucgaagcugguggauuuauugcuaccgugaugguugcuuagcaguaccuuccucucccaagaagcuggcugggcgcgguggcucaugccuguaaucccagcacuuugggaggcugaggcgggcgcacuugaggucaggaguucgggaccagccugaccaacauggugaaacccccgucucuacuaaaaauacaaaaauuagcggggcgugguggcgggccccuguaaucucagcuacucgggggcuaaggcaggagaaucacuugaacccggggggcagagguugcagagucgagaucgcgccacugcauuccugcauuccagccugggcgacagagugagacuccgucucaaaaaaaaaaaaaaaaaaaaaaaggaaagaaagaagcuauuaguuauaacauaccaccggugaaaauauuccauuacucuucacugcaguuuuuggugaaucauacuccacucccuccucccgcagcauuaucugaaguauuguuugauuuuggagaccaucaguauagaugcccgacaaacauccugcacaauaggcauuuaugauacuauguaauaggaagccuguaauaaaaaugggaacuguuugauaguuaucuguaaauagaauguuaguaaauauauuuuguuucauuucucuuccuacugcagucuggggucgggggaaaucaguaggcucccaccuuaaagaacaugguguauauaguaaugaaaugaagugaagacuggugcucgaaugaauugaauguugguaguugucuuugaaaaaccaagaggguacgguacucagauuaaaaauaugucuaaaaguacagaauuuaaaaguauaguuaucuauacuuaucugugauagauaacuauagcugucacauuuggagcacuggugugaaagcaagagggcucuaggauuuggcagcaucaaaaggcagaacuuagugaaaaucaggugauuuaaaauuuuuccauuaagaauaugaaucagaacgaaugcaucuugggucuaaauuagaauuugagaagguuauuugggaaacuguggcuuaagccaagugacuagaguguuugauauauauuggcaaggggcagaugggagggauuguaaacaguagugugucuugugacuuggcaaaccuuugggaaagagaaccuagugaugaaugaguucgcauuaugugaaaagacuaacauuaaaaaaaacauuuguuucuuuacccuauuaguugccaaaauggauucauaauuuuuggaggcaaacauauuuugggaaaagucuagaaaaaaguacagauuuuuaaaugauuacuuauuaaagaagugaguuugauuuaaguaucgggauagaacaacaagcagugacauguuucuccuuaccucuuuucuacuuuuguggaagacugguuugugccauugagugagcauaugguaauauacuagauauuagcagggacuuguuaauuugaugcaaggaaauaaauaaaaaauaaauaaauuuuuuaaguagcaugaacuuuucaaaacacuuuuuuuccagaaauucuuuucaggcuagauggcaacacaaagaugacacaauagugaauuccaacagguuuuauuaaaggaugauuggacuuuuaaauuguacuaauugacauguuuggaaggguaaaagaggaauuaacauugguaagaaguaaaaagcauauauuaauguuuuugaaauccaugaauuagagcaauacguuuaaauuguggcauuaggugguaucuugugggcauuuuaaaauauugacaaaauucuuuuuuuuuuuugagauggagucucgcucugucgcccaggcuggagugcaguggcacgaucucgccucacugcaagcucugccuuccggguucacgccauucuccugcuucagccucccaaguagcugggacuacaggugcccgccacugcacccagcuaauuuuuuguauuuuuaguagagacaggguuuuacuguggucucgaccuccugaccucgugaucugcccgccuuggccuccuaaagagcugggauuacaggcgugagccacugugcccggcgacaaaauucuuaucuguagaaaccuauauuuaugacugauauuggaucaguuuccuaacaguuggaaucacauaacacaaaacaugcaaguugcuuaguugcuuuaguuacaaaauuuuacgauaagcccagaguauuuguguagguuacauauuagaaacuuaguggauuuauuuuauuuuuuauuuuuauuuuuuugagauggaguuucgcucuuucucccaggcuggagugaaguggugugaucucgacucacugcagccuccacccugugccccugccggguucaagcgagucuccuugccucagccuccuggguagcugggacuacaggugugugccaucacgcccaacuaauuuuuguauuuuuaguagagaugggguuuugccauguuggccaggcuggucucgaacuccugaccucaggugauccccuucccuuggccucccaaagggcugggauuauaggcaugagccaccaugcccggccaacuuaguggauuuuuaaccuggccugggguguggacugcugcagaaggugaagaaauuaguccauguucagugauuuaaaaaucaauugucuuggccgggcacgguggcucacaccuguaaucccagcacucugggaggccgaggcgggcggaucacgaggucaggagaucgagaccauccuggcuaacacggugaaaccccaucucuacuaaaauacaaaaaauuagcugggcgugguggcgggagccuguagucccagcugcucaggagccugaggcaggagaauggcgugaaucugggaggcggagcuugcagugagcugagauugcgccacugcacuccagccugggcaacagagcaagacucugucucaaaaaaaaaaaaaaaaaaaaaaaaaaaggcugggcgcgguggcucacgccuguaaucccagcacuuugggaggcagaggcgggcagaucaugaggucaggagaucgagaccauccuggcuaacccagugaaaccccgccucuacuaaaaauacaaaaaauuagccgggcgugguggcgggugccuguagucccagcuacucgggaggcugaggcaggagaauggugugaacccgggaggcggagcuugcagugagccgagaucgcgccacgcacuccagccugggugacagagcgaggcuccgucucaaaaaaaaaaaaaaaaaaaaauuaguugucuuucacauuaguguggucuagcugguuuugaaaauuuguuauuauacagaaguuucucuaggcccaaaauuuauuucauucccuguccccucccuuuacacuggauacuugagagcaguggacuuuuguagauauuucauauuuugauccucuccguuuguggauaauuaauuaaaaugaauuauaaguuuaugugugugacuacuauuuaugauuaugaguguguagugguugguacaauaauuggguauucuuuuuuuuuuuuuuuuuuuuuugagauggagucuugcucugccacccaggcuggagugcaguggcgggaucuuggcucacugcagccucugccucccggguucaagcaauucuccugccucagccuccugaguagcugggacuacaggcacgcgccgccaugccuggcugauuuuuuuguauuuuuaguggagaugggguuucaccauauuggccaggauggucuugaucuccugaccucauuccaucuuccucggccucccaaaguguugggauuacaggcgugagccaccgugcccagcugggcuuucucuuauggaaauauuuuaccugugccagagaaacuaaguuuaucauucaaggccagaaaucaggauauccuagccaaccccuggccucuacuaacaaaauauacauguuggagauaacuaaauuggcacuaagugaauaguugccaauauaguaguuuguuuggcagauuaaaaauuuggcaccugaaugguuauugucaauucuguguuacaaauuuuuugcccaaauucugcauauuuucucucuuuuuuuuuuuuuuuuuuuuugagauggaguuucgcucuuguugcacaggcugaagugcaguggcaugaucucggcucaccgcagccucugcccccccagguucaagcaauucuccugccuuagccucccaaauagcugggauuacaggcaugcgucaccacgcccagcuaauuuuuucuguuuuuaguagagacgggguuucuccauguuggucaggcuggucucgaacucccgaccucuggugauccacccaccucagccucccaaagugcugggauuaugggcgugagccaccgagccaccgugccuggcuucuuuuuuuuuuuuuuuuuuuuuuuugagacggaguuuugcucuuguugcccaggcuggagugcaauggcgcgaucucggcucaccgcaaccucugccucccaggcucaaguguuucucuugccccagccuccagaguagcugggauuacaggcgcgcaccaccaagcccagcuaauuuuuuguauuuuuaguagagagaugguuucaucauguuggcuaggcuggucucaaacuccugaccucaggugauccacccgccuuggccucucaaaaugcugggaucacaggcaugagccaccgugccuggccauuuucugcauauuuucuauguaaucauuuuggccaacacuguggcucacuccuguaaucuuagcacuuugggagguggaggugggagaauugcuugagcacaggaguuugauaccagugugggcaacauagcaagacccugucuccaggaaaaaaaaaaggaagaaauuuucuuaaaaaaaauucauauauauaaaauuaaauucaaaauauuggugauaaggaauugaauuuguucagauuuucuguuuuuugaaauguaucugugaggaaagaaguauaacaguuuuguaugcuaagcuuugucuaauucaucuggcaaugaauucugcagugaauuuuccagauaacugaaguuuacccuuugaggcccuuagacauuuuuaaaaaaguuuacuaggcugggugugguggcucacgccuguaaucccagcacuuugggaggcugagguggguggaucaugaggucagaaguuugagaccagccuggacaacauggugaaaccccgucucuacaaaaaaauacaaaaauuagccgggcgugguggcacaugccuguaaucccagcuacucgggaagcugagacaggagaauugcuugaacucgggaagcggaggagcggagguugcggugagcugagaucacgccauugcacuccagccggggugacacagcgagacccugucuuuaaaaaaaaaaaaaaaguugacuaaucugaauggaaauauuucuaaaauacauuaucuuuuuaugcuuugcaauuccucauaguguagguuuguuucauuguuuuuuuuaaauacugaacuuuauuuugaacaucucucauugaccccaaacuauguacuauaauuuaucaguuucauaucuguuuuuuuuuuucuuuuuuuuuucuuuuugagacggaguuucgcucuguugcccaggcuggagugcaguggcacaaucucggcucacugcaaccuccgccucccagguucaggcaguucuccugcuucagccucccuaguagcugggauuacaggcaugcaccaccacgccuggcuaauuuuguauuuuuaguagagacaggguuucaccauguuggccaggcuggucuugaacuccugaccucaggugaucugccugccuccgccugccaaagugcugggauuacaagugugagccaccgcgccuagccauaucuguucuuuuuuuuuuuuuuuuuuuuuuugagacagagucucacucuguugccuaggccaggcuggagugugcaguggugcgaucucggcucacugcaaccuccacuucccuaguucaagggauucuucugccucagccucccuaguagcuaggauuacaggugcaugccaccacaccuggcuaauuuuuguauuuuucuagagaccagguuucgccauguuagcuaggcuggucucaaacacccgaccucaggugauccgccugccucugccuccuaaagugcugggauuacaggcaugaaccaccgcgccuaguccauaucuguuuucuuuuuuuuuuuuuuuuuuuuggagacagagucuugcucugucgccaaggccggagugcaguggcgugaucucagcucacugcaaccuccgccucccggguuuaagcgauucuccugccucauccucccaaguagcugggacuacaggcaccugccaucaugccaggcuaauuuuugaauuuuuaguagagaagggguuucaccauauuggccaggcuggucucgaacuccugaccuugugauccacccgccucggccucccaaagugcugggauuacaggccugagccaccgcacccggccagccuguaucuguucuuuaaaguuguuuuguuuuccuuacucucauguucuucuugcugcuuauugugccuuguugcugccuguugugcaauuucuucccucuuguauuuuacugaacuucaucugaagaagccuuaguagccagauaaacaagcuuguuugggcuaaaaaaucaauugcugugugagaguuuguuggauucucuucugaguaaaggguaugcguuuuauuguacggacuuuguaucaccuauuuuggcuuuucaucuaggccuuuuuuuuuuuuuuuucuuuuuucuuuuuagccuccugguucuagauacaacugauacucugauacaaccuggguaaauguggucuugaguaguaaauuaucugugaagcuucuccgaacuuugccacauaaaugagccugcucuuauugugaaguaaaucuuacucuaaucuguaugugagucagugggaaauaucugagccuucggauggcuuuuguuaacugagauuaguucucuagauuuuagugauuucguuuugaacaccauacaaguaugugguccuugguuuauuuggucacuuguaaucucuuuaaaauuuuauuuuaaauuaggaaauauuuuagaaauacaagaaagucacacacuaugagauuaaacagauguuaacguuuugccccauuuucaucagacugugcaugcuuuuuuuggggggggaauaaaaugucacagauaucacuaaagcccauuuccaucucgucccacccugccucuagaaguaacuucuuucuucagguaggugcguauuauuccuuuuuauuccuauguauaguuuaaaacuuuaauugcauauuaguagccacaaacaucacauaccaauauucugugccuuuugcauuuuuacauuaaugguaauuauuuuugaccuucugcaaguggcucuuuucaauguuucuuguuagaaaacuuggcucaacuugaguuuacuaauuaucugcuucuucuugucuuuagcuauuauagaacuguuccaccaaggcaacaauuauugcuauuuuaauggugaaaucaguuuuauuaggcaaauugacucaggcuucagacuggcauuuggaauugucacacuggagauuuucuuuuacugaaaucucaggacauugacaaucagaaaaaaacccucuugagucuuacuaucuuacauguaagauauguuccugagugacuguaguaaagacucauucaggaaaauguuaucuccgauuucugccucccuaucucauaggaaacuuccauuguaaaguuguuaccaggcgucaagcugccucuuugguacagcccuuacuuaguauuuggcucaguugaagugcagucuauauaggaggccaagaagacuuaauccuggguuugaaacaaagcaaggauacacuaacauucuauccuuuaauaacaucaaguagaaaaauugaaaaugagcuuguuaucagugcacuuuuauaugccaaccuuguuucacuuguguuuuaaacugggaaacugaagauuuuaaugcugaaauuucuuugaauuauuaccuguuuuuuugauaguggaacacacagcuaauauuuacuaacaugaaggugucaaaggugggaaaucauguacuacaccaucaggucagcacuacuguuuggaagagcagcaucacaaugagcaguguuauacugcguuguagucagcacauacacuuauguccaaacagauauuuuaaauuaccuucuugggguaguacacaugugcugauauccaaagugccauauaauacaauacauaguuuuuaaacuucauaucauucugaucagaagcuuuauaaacuguuaggugaaugcuguuagaugauaugagagcacaauuuaaccuguguguguguauguguaugucuuaacaucuauuaagugaugacuacauaugaagcacuaagugcuaaaacagagacuuuacauagauuaucccauuauuggucaacuuuuuaaauaagugcaucucuaauauaagacaagaugcugaccaauuuuuaaaaugugaauggauuucuauuuuuaagauaaguaccuuuguuccuuugguuccucccucccacccuuccagaaaugguaguauccuggaaaaaaaaaauuaguaacaauucaagaaacagcuuaauucauuaguauaaauagaugaguuucccuuaaacacaggaggaguuggaagguacuuguaauuggauguugugcauggugccuuuccaaaaugcacaaauacuuucucucgaaugguugcaguaguaaugugcugugugauuuggcauguauaguguuguacagguaucuugacauugguggauuaacugcuuggcuacugugaaauucacuguagauguugauggaugaaagugugguugccuagauaaugauuaagaccaguaacuaaaccacaguuauuauuuugcuggcauaaacuucaaacucagaaagguuuuuauucauuucacccauuggagcauaccccaguaagugcuucauuucuuuguguuucugauuuuuuuuuuuuuuuaagauggagucuugcuuuugucgcccagguuggagugcaauggcgcgauuucggcucacugcaaccuccgccuccuggguucaagcgauucuccugccucagccucccgaguagcugggauuacaggcgccugccaccacgcccagcuaaucuuuguauuuuuaguagagaugggguuucaccauguuagccaggcuggucucgaaccccugaccucgugauccacccaccuuggccucccaaagugcugggauuacaggcaugagccgucgugcccagccauguuucugaauuuuuaagucaacuucugaauaggcaaagaauucuuuuuguuuuuuuguucaacuuuagugcuauaaaucgccaguuggacacaaagguuuuagugcuauuuagguauguuuuggugaaauagugugaaggaauauugcugcuuaaaagauaagccauucauuaaaugacaucuuuguuuugaaacaugaagauuuaugagaagcauuuuuuuugugagccaaaguaguuucacuuuauguguuagagauuuugaauagcucauuauagacuuuguaauuuacugucucucauuuaggcagguaauuuuaguugccagcuaaucauguuuaaauauguauugguuauuaauaaaugauuacccauauacaggucuuucaugcagauaucguacuacucugauguucuuaccuaguuuugugguauguucaguugucuaagagcauuguugaucugcacacagauuuuguuuggucuauacaguguuucugaaaacuugaauuaguuaccauuaauaaaaaacgggagacugcgcaugaaaucugaauuuguagcuuuuuuaaaaaaaauuggaagaucaggccaggugcgguggcucaugccuguaaucccagcacuuugggaggccgaggcgggcagaucaccugaggucgggaguuugagaccagccugaccaacauggagaaaccccgucucuacuagaaauacaaaauuuaccgggcguaguggcacaugccuguaaucccagcuacuagggaggcugaggcaggaaaaucgcuugaaccugggaggcggagguugcggugagccgagaucacgccauugcacuccagccugggcaacaagagcgaagcuccgucucaaaaaaaaaaaaaaaaaaaaaaaauuggaagaucugucagcacuaaaccugccagucaccauagugauaauucauuggcuccaagaaauggcuaccaucuccuccuuuuaagggguugugcacagcuuccacauggcuugcuauacuuaccugccucaggaagcauuucuuugugauuuagggcaucuguguuuuuguuauuuuagauuuagaacauucaaaugucuggaaaugaauuugaaguuuuguuuaaaacaacaaaauaaaugcauauaagcaagguuaugacuaaauugaaaaaugcacaagaggccaggcgugguggcucacgucuguaaucucagcacuuugggaggcugagacgggcgaaucacgaggucaggaguuugagaccagccugaccaacaaggugaaaccccaucucuacuaaaaauacaaaaauuagaugggugugguggugcacaccuguaaucccagcuacucaagaggcugaggcaggagaaucgcuugaaccuaggagauggagguugcagugagccaagaucgcaagaucgcaucauuggcacuccauccugggcgagagagcgagacuccaucucaaaaaaaaaaaaaaaaaagaaaaaugcacaagaguguuaaacaagcaguucacaguggaaaaacuuaauggcgcgcacacacacacacacgagaaaagaugcguaguaaccaauguuauuaguaaucagggaaauucugauuaaaccaauggacuaucaguaaaaaaauuuuuuuuuuuuuuaaauuuuugagacaaaguuuugcucuuguugcccaggcuggagugcaauggcucagucuagcucacugcaaccuccacugccuggguucaagugauucuccugcuucagccuuccaaguagcugggauuacaggcgcgcaccacaggccuggcuaauuuuuuuuuuuuuuuuuuuuuuuaguagaaaugggguuucaccauguuggucaggcugguguugaacuccugaccucaagugauccacccaccucagccucccagagugcugggauuacaggcgugagccacugugccuggccaggacuaucauuuaauacccauuagauugucaaaaauauuaaaguuuuucagaacaugcugaaagugggauuucuucauucuuugcucaugggaaugucaguugacaccacucuagaggauaauuuggcaguucuugguaaaguugaagauuuauguccaacaauccagaaaguccacuauuagguuccuuuccauggaaaaauucucucaugugugcacaggaaaacauggaccaagaugcuaguuuguuuguuuguuuguuuguuuauuuauuuauuuauuuuugagacagagucuugcucuguugcucaggcuggagcgcaguggcacaaucuccgcucacugcaagcuccgccucccagguucacaucauucuccugccucagccucccgaguagcugggacuacaggcaccugccaccaugcccggcucauuuuuuguauuuuuaguagagacgggguuucaccguguuagccaggauggucucgaucuccugaccucaugauccgccugccucggccucccaaagugcugggauuacaggcgugagccaccgugcccggccuuaauuuuuguauuuuuaguggagauggggucucucuacucucuaugucagccaggcuggucuugaauuccuggccucaagugaucugccugccugacccuccagaagugcuaggauuacaggugugagccaccacacucggcgguaagaguuauuguauaaaguuuugacauaauuuauagugucagccuucuuccucuauccucacagaaggccucauggugaguucgaugugcagguuaaaauauauaauuauugcaauauguuguaagaaauguuuccuaauuaagauuuuuaugaaauuaaacguauuuauuuauuuauuuauuuauuuauuuauuuauuuauuuauuuauuuugagauagaguuucacucuguuaccaggcuggaguguaguggcaggauuucagcccacugcaaucucugccucccggguuuaagcaauugucgugccucagcccccugaguagcuggaauuaugggccuaugccaccuugccuggcugauuuuuguauucuuuuuuuuuuuuuuuuuuuugagacguaggcucacucugucgcccaggcugcagugcaauggugcgaucucggcccauugcaagcucaccuccuggguucaagugauucuccugccccugcaucgugaguagcugggauuacaggugugugccaccagaccuggcuaauuuuuaguagagaugggguuacaccauguuggccaggcugaucucaaacuccugaccucaagugauccgccugccucggccucccaaggugccaagauuacaggugugagccgaugcccccagccuauuuuuauuuuuugagacagagucucacucuguuguucaggccggaggucagugauguaaucauagcucacugcagccuugcuugaccuccugggcuuaagggauccuccucccucagccucuccaguaguuaggacuguagguggauaccaucacacccaccuaauuaaaaaaauuuuuuuugucucacuguguugcccaagcuggucuugaauuuuugaccucaaguaauccuccugccucagccucccaaaguguugggauuacaggcaugagccacugugcccagcccuuuaauaguuuaaagucaaaguuuaaguagaaaacauuauuuuauuuggcucauugguuagauguaagugaugugaaauacuuaaacauccauuauuguuuuuaauauaauuuggaaaauaugaguugcuuuggauuauuaaaacuucauuuauuuguaccauugaugcauaaauucucagucuagguuuuagcgaagucuggauuuuaaaaaauugacugugauauuaguucaagucuuacgaacaucauuauuauuauuauuugagagacacagagucuugcucaguugcccaggauggagugcagcugcacaaucacagcuuauugcagccucaaccuccugggcucaagcaguccucccacuucaaccucccgaguagcugggacuauaggcacacaucacaacuccuggccaauuuuuguauuuuuuguagagaugggguuucgccauguuuuccaggcuggucucacuccugggcucaagcgauccucuuugcuuggccucccaaagugcugggauuacaggugugugccaacacaccuggccaaguuguauauacuauuaaucuaggcuauuucugacacuguugauuuuccuuuuccccuuaggugaggcaggcgacuaaucagauugugaugaauugugcugauauugauauuauuacagcuucauaugcaccagaaggagaugaagguaagagcuguuuuccauuuuaauuugcugucugcaugugcauauguggggugugugugugugugugugugugugugugugagagagagagagagagagacauuuucagguuaagacuucaauguuuguuacuuuagaaauggguaaauucagcugggugaaguggcucacgccuguaaucgcagcacuuugggaggcugaggcgagcagaucccugagcccaugaguuugagaccagccugggccacguggcgaaacaaaaacaaacaaacaaacagaaauauuagcuaggcauaguggugcgugccuguagucccagcuauuugggaggcugaggugggaggaucuauugagcccagguggccgaggcugcagugagccaugauugcgccgcugcacuccagccugugcgacagagugagacccugacucaaaaaaagaaaaagaaaaaggguaaaauguuuaugggaaauauugaauaguauaaccuaacaguauugugaaauaaaguaaaugucacaauuuauuuuauuuuuaaauuuauuuuuauuuuuauuuuuuuugagacagagucuugcucugacacccaggcuggagugcaguggcgugaucucagcucacugcuaucucugccucguggguucaagcaguucucccugccucagccuccugaguggcugagauuacagguguccaccaccauaccuagcuaauuuuuguauuuuuaguagagacaggguuuugcuauauuggccaggcuggucuugaacuccugaucucaggugaucugccugccucccaaagugcugggauuacagaugugagccaccacacccggccaaaugucacaauuuaaauucuacuuccaagauuaacuuauuuugugauacuagggaaaucacauuuucauaaguauaaaaugaauauaauaugcauaauaaagcugaugaguuauuugaaaaauuaaguacuuugaacaugaaaggcuccucaaagaggcuucguuuuuauguuuuucuuaaaguuuuuuuuucuuuuuguacuguaguuuaaaauugagauaagucauacuccuaauucggagaaaaacauuugcuuuaugagacaauaugaagauuagaagcuaaauaauggaguuaguuacaggggaagaacaugcuaaaaagaaacaugguauagaauguggaacuccauuagugucuauaaaaugagaacuguuuuagaccuuauaauuuuaguaugaaaguaguccauuuugacuggaaaucuuauucccguaugagcugcuuuuuaaauagacaccaaguuuggcauaaacucuuacaaguacaucaguauuggagcuggauugcuuuuuacuuuuuuuuuuuuuugagagagucucgcucugucacccaggcuggggggcaguggcaugaucucaacuaccacaaccucugucuccuggucucaagccauccucccaccucacccucccaaguagcugauauuacagguguguaccaccaugccuggcuaauauucguauuuguauuuuuuuauagauauggggggguggucuuccuauauugcccaggcuggucuugaacuccugggcucaagggaucugaccucuucggccuugcagguugcugggauuacagcaagagccaccacaccugguugccuuuuuacuuuugauuucaccuagacauuccuugucaaaaugguuauugguuacucugagacuucuuuaauauaaaauaauuuacggccgggcgcgguggcucacgccuguaauuccagcacuuugggaggccgaggcggguggaucacaaggucaggagaucgagaccauccuggcuaacucggcgaaaccccgucucuacuaaaaauacaaaaaaucagcugggcgugguggcgggcgccuguggucccagcuacucgggagguugaggcaggagaauggcgugaacccgggaggcagagcuugcagugagccgagaucgcgccacugcacuccagccugggcgacagagcgagacuccgucucaaaaaaauaaauaaauaaauaaaauaaaauaauuuacacauuugaucuuuuaacuuacauuuuauauuuugauuuccucucuccuuuacauuauacugaaaagaaguuucauuuuaaggccucauaacauuuaugauuuuuucuuaaacuauuuugucuauagaaagucaaaguaguagcaguugaacauacuauucccaagaaguacuuaaguucaauugauuguaaauuagaucaaacugcuggaagaacagauucuucaaauggacuugagugagugccagcuuuuaaaaaauugucugguaaaugaaagagugauuauuuaauuucuuuaacuguggagaaaaauagaaguacuuuagccagguauaucaaagcaacaaggcuuucuuuguugcagguagagaauguuuaaauucgaugugugguuuuaaagugguauguagauagguagaucuaguaauauaaauguguaccuuccagcuggcaugguuucagcucaaguuuguuuuuuaucuuccuguacuaaaaaugucaggauagaauucaggugacugaaaaguucuuuuuuuuuuuuuuuuuuuuugagauggagucucgcucugucgccaaacgaucucggcuugcugcaaccuccgccucugggguucaagcaauucuucugccucagccuccugaguagcugggauuacaggcgugugccaccacacccggcuaauuuuuguauuuuuaguagagaugggguuucaccauguuuguuaggcuggucuugaacuccuggccuugugauccacccgccucagccucccaaaguguugggauuacaggcgugagccacugcgcccgaccugacugaaaaguuuugaauaugcguaaccgaauguugcuaagcucauaaugaucuguaucucacggaagcccaguuaguguucuuacuaagagagucaggagagaaaugaaaacuuaauggaaaaggagauuugaagagagauucugauaaaacguuaaauuauuuuagauacauaauauauauucaaugcugggugcaguggcucaugccuguaaucccagcacuuugggaggcuguggcggguggaucaugacgucagaaguucaagaccagccuagcgaagauggugaaaccccaucucuacuaaaaauaaaaaaauuagcugggugugguggcgggugccuguaaucccagcuacucgggaggcugaggcagagaauugcuugaacccgggaggcagagguugcagugagccaggaucgugccacugcacgccagccugggugacagagacucugucucaaaaaaaaaauauuuuccuucagaacuagcuaagguacauuucucaacacuuuucuaccacagcaacgggaaaaaaccugaagucauguguaagcccacguaauuuuagaguuuaagagaaugggaaguuguaugaguuguuaaaguuugaacugggggcagccaggugugguggcucacaccuguaaucccagcauuuugggagggcuaggugggcggaucaccuguggucaggaguuugagaacagccuggccaacauggugaaacaccaucucuacuaaaaacacaaaaauuagcugggcgugguggcaggcaccuguaauuccagcuacuugggaggcugaaggcaggagaaucgccugaacccaggaggcggaaguugcagugaguggagauugugccacugcacuccagccugggcgacagagcaagacucugucucaaaaaaaaaaaaaaaaaaaaaaguuuggauugggaacagggauagauuuggccuuccacauguauguguauauauauauauaauuuaaaaaaagaagguaaaaguaaaaucagaaaauuacucucaaggcaugaaauuguugcuucuuuuaauuuuuuuuuuuuuucuuuuugagauggagucucgcucugucacccaggcuggagugcaguggcgcagucucggcucacugcaagcucugccucccggguucacgccauucuccugccucagccuccccagcaucuggggcuauaggcgcacgcugccacgcccagcuaauuuuuguauuuuuaguagagacgagguuuuaccguauuagccaggauggucucuaucuccugaccuugugaucugcccgccuuggccucccgaagugcugggauuaaaggugugagccaccgugccuagccaauuguuacuucuuuguguaaguuuuuauuugaagaaaaaggccauuuuuuugugauaugugcagucauccuugaaagaccuaugggcauguguguguuuuuuuuuuuuuuuugagauggagucuugcuguaucgcccaggcuggaguacaguggcgcaaugucggcucacugcaacuaguagaacuuacuuuuuuuuuuuuuguuuuaaagaacuuguuuuaaaauaauccuuaauaggcuuuuauuaacgcuguuuggauauuaguuauguacccuuuucucuuugcaauaaugaaagaucauuucaaguagaaauuaaagguuuguuucucaucccuuucuuuagauauaguaacaguuauaccagauauauauauauguauauauauauauauaauuuuuuuuuuuuuuugagacaguuucacucuuguugcccaggcugcagugcgauggcaugaucuugcucacugcaaccucugccucccagguucaagcaauucuccugccucagccucccgaguagcugggaucacaggugugcaccaccacacccagcuaauuuuuguauuuuuaguagagacaggguuucaccauguuggccagccuggucucgaacucgagaccucaggugauccaccuaccucggccucccaaagugcugggauuaccaggcaugagccaccacgcccggcccaguuauaccagauauaagcaaauuugcuaguaguuuagauuucuggaauugugccaacuacacaucaagagacuauuuagcuuuguuacagaagucaguaucaguuucuuguuauaagacaagaccugguuuuacagacuuuucuauuucucaauggaacuuuacucugaagauauacucuuccauuuaaauacuaguuccaaaaccuacauuauaugguggcugcuuaauaaacauuuaacauuuuggugaauuuaaaucuuguugauguguauacaugaauaacugggcuaaaagcagauaccuuugauuauugugaaacuucaaguaaauauugugugaaaaggaccccuucugucucacaaauucuggccccucagcucauugucugaacagugauucccuugcauauaauaaauucucuuggcuuauauauaauaauaaaugaaguuuauuauuuauuugaacuuuuuaccccuguaaauaccaagguucuuuuugccuaagugguaauuugugucauucaaagaguuuuuauuaaauauuauuauuauuauuugagauagagucucacucuuauugcccaggcuggagugcaguggcacuaucucggcucacuacagccuccgucuccuggguugaagcgauucuugugccucagccucccaagucgcugggauuacaggugugugccaccaaaccuggcuaauuuuuaaauuuuuguagagaugggguuuccccauuuuggccaggcugcucucaaacuguugacacccaccuuggccucccaaagugcugggauuacaggugugaaccacugcaccagaccuuaaauacucuguuuaagugauaguuugauaagugugaacgcaagucugaaauagguuucuuugcuugugagaaaguauaacgaauugccaagacaauagugacaaacagagggcauauuuuucaaagaggaagaguuuauauaguguuaacauuaagacaaaagucuuaaguuucuaauuucugaucuuguuuguugggauuucuuucuuuuuuuuuuuuuucuuuuuuuuuugagacaggucuuucucugucauccaggcuggaaugcaguggcacagucguggcuuacugcagccuccugggcucaaguuacucucccaccacagccucccggagagcugggauggcaggcaugugccaccacaccuggcuaauuuuuuaauuuuuguagagaugggguuuugcaauguuccccaggcuggucucagacuccaagacucaagcaguccuaccucagcuucccaaagugcugggauuacagauaugagccacugugcuuggcccuuguuuggauuucuaugcuuaucugugaaauauauucugguuucuaugcaggauagauccauucucaaauaaacaacccuuaaguaucauuaguucaaacuggagccaaauaaagaaaugucagcauuagaaggagcaagugauaguuagccagccccuuuauuccuuuuuagugcaaaucagagauaaagaacaugaaguuugcaguguauuugcauucuuucacuuuuacauuuguugguuuugaguaauauugaggggcugucugauaaagaaccuguguagguuuccauauggcuauauacaaaguauaugaguguagaauaguuuuaaauuuugucuuaguuauauuugguaaguuuuaaaacauuauuuaaauagccuuaaggugauauggauugcuuuagugacugcuguuuuaggaauuuaguuggcuuauugcugacuauagagggaacguuuuaucuucuuuuuaaccuccaguucagguuaggugccuaaccaagugaaacauuuuucauaauguaauguuuaauagugauaauuauaaaaauaauggugaguuuaguguuuacucuauaccaggcacuaagugcauuacauguucauauagagaacaaccguaggcacagagaggguaucuacuuuagguaauaaaacugauaaauguuagagccaggauucaaacccaggcgguuuggaucuaggguccauguacuugccacucuauugccugucauuaauauaaccgcaccauauugcaauuauuuguuugugucaugucuguacuacuuuucaauggaaucuuaagauccuugaggggcugggcacuguagcucauggcuguaaucccagcacuuugggaggccgaggcgggcggcucaccuaaggucaggaguucaagaccagccuggccaacauggugaaaccucgucucuacuaaaaaaaaaaguacaaaaauuagcuggguguggugguaggcgccuguaauccuagcuacucgggaggcugaggugggagaauugcuugaaccugggaggcagagguugcagugagccaagaucacgccauugcacuccagccugggggacaagagacuucuacucaaaaaaaaaaaaaagauccaguaauuaugauucauucuuuuucauuugugguuuucccugguaucugacauauaguagggauuuaauaaauauacauugaaugaaacgaagaaaaucuagauaaauggaguaagucugucauaugguaguuacaguaguuccuccuuaucuauggcagauguguucuaagacccccaaugguaugccugaaaccacagauaguagcaaaacuuauauaugcuauguuuuucccuauacauauguacuaugauaaaguuuaauuuuuacauuugaaauaguaagaaauuaacaaaagcuaauaaaaaauagaaccauuauaacaauauacuguaauaaaaguuacaugaauguugugugcgucucucucucuuuuuuuuuuuuuugagacguugcucugucgcccaggcuggagugcaauggugcaaucucagcucacugcaaccucugccucccagguucaagcgauucuccugcccuagccuccugaguagcugggacuacaggcgcaugccaccacaccuggcuaauuuuuuguguuuuuaguagagacgggguuucaucguguuagccaggauggucuccaucuucugaccucgugaucugcccgccucggccucccaaauugcugggauuacaggugugagccacaguaucuuuuuuuuuuuuugagauggaguuucacucuuguugcccaggcuggagugcgauggugugaucucggcucacugcaaccgcugccuccuggguuuaagcaagucuccugccucagccucccaaguagcugggauuacaggcaugcgccaccacgccuggcuaauuuuguauuuuuaguagggacaggguuucuccauguuggucaggcuggucucaaacuccugaccucaggugaucuuccccccucagccucguaaaguguugggauuacaggcaugagccaccgcgcccagccaauaucuucuuuuuaaaaaaaauuauuucauuuauuuauuuuuagaggcagagucucuguugcccagguuggagugcaguggugccaucauaucucacugcagccucaaacugcugggcucaagugauccuccugcuucagccucccaguuagcuaggacuauaggugugcaccaacacccagcaaauuuguaaaaauuuuuugugagucaggucuggcuuuauugcugaaguuggucuugaacuccuggcuucaagcgauccuccugccucagccucccaaagugccaggauuacaggcaugagccacugugcccagccucucuuauaguaucuuauuguauuauacucacccuucuucuuugacauuuccaaacugcuagcaucacuacucuugugcuuugaggccauuauuaaguacaauaaagguuacuuaaacacaagccuugugauacauugacagucaaucugauaacugagauggcuacuaggugccuaaugggcuggguggcauauauauacagcauggauaggucggagaaagggaugauuuauguucugggcagaauggaaugggaggguacaagauuucaucacacuauucagaacaguacaguuuaaaacuuacgaauucuuuguuucuggaauuuuccauuuaauauuuucagaccguaguugacucuaggcaguugaaacuguggaaagugaaacugcagauaaggggggacuugucaggucugcauuucuucaugugcucuauccuauuaacuuuauggguaacaaaauuauuucguauuugagauuauuuuguuaccagcuuuaacuuguauuuuacuucccuuuaaggacuaccaucaagauacuuacuaauuguaaagauucuuuacgguauuuuaaauauuaagaaaauggagagcauaaaaaacugcuguaaauuauguaguuuugcauuaaauguagagaaaacacugauugcauaauguuaguaacauuguaguguaugcuguucuuuuuuuuuuuuuuuuugagauggaguuucgcucuuauugcccaggcuggagugcaauggcaugauuuuggcucgccguaaccucagccucccggguucaagugauucuccugccucagccuccugaguagcugggauuacaggcaugcaccaccacacccggcuaauuuuguauuuuuaguagagauggaguuuauccauguuggucaggcuggucucgaaccuccgaccacaggugaucugccugccucagccucccgcagugcugggauuacaggcacaagccaccgcgcccggccauguaugcuguucuuaagugugaagcuggaagaguuaguuguucuccaaaucaaugcuuccuuacuuuuuuucaaggcauuaguagaaacugauguuuuccugguacauaaggaagaggaggcucacaacuggaggguaucagagaucuuucauugcucuaggccuaccaggcugguccaagggccaagggaauuauuaucuugauaaaccuguaauccauguuuggaucugccacaguuagggaagcucugcuauaguuucaaguuaauagaauuagaagggaaguuagguaguagucagggcucauuuuauuuauuugugccuucuguuuuacuuuuuuuuuuuuuuuuuuuuuugaaauagagucuugugcuggcgugaccuuggcucacuacaaccucugccucccggguucaagcaauucucuuuuuuuuuuuuuuuuuuuuuaauucaucauucuuggguguuucuugcagagggggauuuggcagggucauaggacaauagaggagggaaggucagcagauaaacaagugaacaaaggucucugguuuuccuaggcagaggacccugcggccuuuuuuuuuugcaguguuugugucccuggguacuugagauuagggaguggugaugacucuuaacgagcaugcuaccuucaagcaucuguuuaacaaagcacaucuugcaccacccuugauccauuuaacccugaguggacacagcacauguuucagagagcaccggguuggggguaaggucauagaucaacagcaucccaaggcagaagacuuuuucuuaguacagaacaaaauggagucuccuaugucuacuucuuucuacacagacacagcaacaaucugauuucucuaucuuuuccccacauuucccccuuuuccauucgacaaaaccgccaucgucaucauggcccgcucucaaugagcuguuggguacaccucccagacgggguggcggccgggcagaggggcuccucacuucccagaaggggcggccgggcagaggugccccccaccucccggacggggcggcuggccgggugggggcugccccccgccucccuccgggacggggcggcucaagcaauucucuugccucugccucccaaguagcugggacuacagauguaggccaccacgcccggcuaauuuuuguauuuuuaguagagaugggguuuccccacguuggccaggcuggucuccaacuccugaccuugugauccaccugccguggucucccaaagugccgggauuacaggcaugagccacugcacccagccuguuuuacuuuuuucuugaucccagaucuuuuucaguuuucuugcuuuuuuucucaaagaacuaaccauugcuuuguagaccucaguugacuauuauuuccuuauuaacuucugcuuccuuuggguuuacuuugcaagguuuuuuuuuuauuuuugagacggagucucacucugucacccaggcuggagugcagugacgugaucuuggcucacugcaaucccugccuucugguuucaagugauucuuaugccucagccuccugauagcuaggauuaaaggcaugugccaccacacccagcuaauuuuuguauuuuuaguagaggcggaguuuuaccauguuggucaggcuggucucaaacuccugaccucaagugaucgguucgccuuggccucccaaagugcugggauuacaggugugagccaccgcuaccaugcccggucuacuuugcagauuuaaaaaaacuucuuuaggcuggucccagugcagugguguuuauaacucaucaaucauagccaguuacagauuucuuuauuccuucuucacucccacugcuucacuugacuacccuuaaaaaaaaaacaaaaaacaaacagaagucuugagauggauguuuggcuuauuacuuuuuaguccuucuuucuaguauauucauuuaaauauaaauuuuaauccuaaaaauguacugcuuuuagcugcagcccacacuuuuuuugguuuguuuguuuugggggaaauucuccaggcaguaguuauggcuguuguugcuugcugcugcuucuuuccuauuuuuguugauagcuuugugagaguaccuguaauguugacauacuauaaaggguacauauuaaaauauguaauuugauaaguuuucucaugaauguaaccagguaaugaacauauucaucacccuagaacauuuccucaugccccuuuauaauccuuuucucuccuuuuccuugcuccuuccccaggcaauuaugauuugauuccauguuuuuuuuuuuuuuuguacagucucugucacccaggcugggguacaguggcucuaucucaacuuacugcuaccuccaccucccggcuucaagcaaugcuugugccucagccucccgaguagcugggacuucagguguacgccaccacacguggcucauuuuuguggguuuuuauuuguauuaauuaauuaauuuuuauuuauuuauuuagagauggagucucgcucugcugccgaggcugggguguaguggugugaucucggcucacugcaaccuccgccucccagguucaagcaguuuuccugccucagccucccaaauagcugggauuacaggcuugugccaccauuccuggcuaauuuuuucuauuuuuaguagagaugggguuucaccauguuggccaggcuggucuugagcuccugaccucaagugauccacgugccucagccuccaaaguggugggauuacaggccugagccaccacaccuggcccaucccccacuuuuuuuuuugagacggagucucgcucugucacccaugcuggagugcaguggcuagaucucggcucacugcaaucuuugccuccuggguucaagcgauucuccuguuucagccucccaaguagcugggauuacaugcgccugcuaccacgccuggcuaauuuuuguguuuuuguagagaugggguuucaccauguuggccaggcuggucuugaacuccuguccucaggugaucugccugcuuuggccugaagugcugggauuauaggcgugagccaccaugcccggccucuuuuuuuguuaagauagggucuugcggcugggugugguggcugacgcuuguaaucccagcacuuugggaggccgagguggguggaucacaaggucaggagaucgagaccauccugguuaacauggugaaacccugucucuacuaaaaauacaaaaaauuagccgggcaugguggcgcaugccuguaguccccccuaccugagaggcugaggcaggagaauugcuugaacccgggaggcggacggagguugcagugaaccgagauugcgccauugcauuccagccuggacaacagagcgagacuccaucucaaaaaagaggaaaaaaaaaaaaaaaagauagggucuugcucugucacccaggccagagugcagugacaggaucgcagcuuacugcaaccucaaacuccuggacucaagugaucuucccaccucagccuccugaguagcuggaacuacagauauacgcuaccguggugccuggcuaauuuuuuuuaguagagauggggucuugcuuuguugccuaggcuggucucgaacuccuggcuucaagggauucucucaccucagccucccaaaguguugggauuacaggcaugagacacugugccuggccuguuuuuucuuauuacauauuuuuguucuagaauuaauuuuuccaaauuugcuuguuuucuuuguuuugcuugguuuuggguuuuuuuuggaguuuuuuuguuuguuuguuuuuuuaaaguaacuucgcguuacuugccaaauuuuucaggauugggauuuuauauuuuugaacauaguaagcagguauaugaauaguuugcuaguaucuaggggagcuuuuguuuuguuccccguugguuacuaauacuuaagguucaucuuuuuccaaugucugggcuucagauguucagaaguuuaaucacauuccacuuguggacugcuuuucuucuuguucaucuuuccugguaggauaucacuuuuuugguuucaagcccaaaggagggggucauuuacucaagccucuugucuugucuugucuugucuugucuuuucucuucuaauagagauagagucucacugugcuaccuagauagacuguguuacuugaacuccugggcuuaagcaguccuuccaccucgccucccaaaaugcugggauuacagacacagugcccacccagccacaaagcccccaguguugauggucccuggauucccacuuuugucccuggggccuauagccucagcuucuaaaucugcuacuucucugcuagaucagcaaaugaccccagagcaaaaguggccuagaaugcaaagcuuccuccuuauggaauuucauccucuucuucaucuugaucaccuuaucuuguucuaugauucuuuuaaggagagguuuucccuuccuuccagcuuuuuuaguuuugugggugucaaguaggagagagauaauuaguuugaauuauauacucaucuauuacccaaaauaaaguccuuuaaaaaaaaaaagauaaacugagaccuagacaaauuaaguaacccuguaagaccacuuaaucaauggaaauccugguccagaauccugagugauuuuaacgaaauaguucacagucauuuauuaagagcaggggcacccuagaaggaauuuuuugguucuguugagccagauuuauauuuggcacaugcucauucuuuuuagacuuuuuagauagccuaauaagauaggaccaucacuauguuauauaaauaugaaauccauuugaaaauaugggaccugucaguauagguacugcuugaacuguaacuaugcauauaucugauuggcuuuuaugcccuagggugagaaggaggucaccuugaagcuuugcaaaguaaguuccugguuccauuuuucacuugaaucccccuuggauauccuccagaaugauguguuuucuuucccauugcaacauuauuuucagcuuuguggagaaacaaaguauguuccaaguagcagguggucacuguaggccuucuuugaacugugaacuuuauuuuuuugcaccugaacugcuuucuaaaaccacauaaacaauaugauagggaaguugcuaucugaauaaaaaaacaaaacaaaaccucacaauguguuugaucuaguacugagcuacacugguauaugugggcuauauagaauuaugugguuuagauuacuuguuuaaguauagcaguggcuuggaggaaaauacauucugaguuucaaauagauaauuuguaaaggaaaauuugaaguacaguugacuuggcacuucugauauugaaauuuuagaagauuuuguuucuguaucucaauguaaugccuaggcagaauccacuagaugcuuguauagaugguauaagcaauaaugauuucggcuauuuuuaaaaauuucaaucuuuuuuuaauguggccucagaauaccaucuuguacuucucauuuucccuauaccuccuuuuaugugauuaaguuuuauuauguauagacauaaagggggccuggcacaguggcucaugccugcaaucccagcauuuugggaggccgaggcacgaggauugcuugagcccaggaguucaagacaagccuaggcaaugcagugagacccugucucaaaaaaaaaaaaaaaaaaaaaaagauugggggggugcuaugauauuacgauauauauguugguuuucguccacaguuucugucauagaacacccauagucccuguuauuuccuaagugacuaaaacaauacacauauauuuuauugaaauauuuggccuuuuauucuugguuuuugaaguggcuucaguacagcuucagaucaauaaaagugaaagauggucuuuuguaauaauguuggggcacuuuaaaccucagaagcaggcuucagaaaacagaaucucucucugaccuuuucuugccuugcuuuuaccugcuccuuuuucuccccaagcaggccauagaaacuaaaaauauacucuaaucaucccccaacauucugucuuggagcugacagcaaagaaauuaucugaccuaccuugucugauuggaggucauaagacccccauuucagaaggcauccugcccuguacuugggaggaaagaaguugcacagagaggccaagaagacucugaacagagagaccuugcuagguuucaccacucagucuguuagcauuagguccuacuuuuguccaaucauauuucuacacgguuguccaugcuucagucgugacuguccagugaaauccuggaccagguacagagagcuuccagauagcugaacacguggaggguccuggaggguggugcacccagggaggguaugagagcucugcaccccuucccacaugccuuguucugugcaccucuucaucugcauucuuuguacuauucuuuauaauaaaccaguacacguguuuuccugaguucugggcacagcuuuagcaaauuaaucaaaccuaagaagggggucaugggaacacugacuugaagcugguuggccagaaguucuggaugaggccuagccuuacaacuagugucugaagugggggcagucuugugagacugagcccucucucagccugugggaucuaaugcuaucuccagguagauagcaugauaauugaauuggauuagaaggugcucagcuggugguaucgucugcagaacugauugcuucuuguugguggggagaaauccccacacauuuggucacagaagucuacuguguugaugauugugguguaagagcagaggaaaagcaauuugauuuuucuccacaaggggaagaaaauguuucaugauucaacuaaugauuuaccuuucauuguaagguuaucaugcucaaguauuaauguaggaaggcuuuuuugaugcagaguguguguguguguguguguguguguauauguguguguuuguagagggcuaacauuaaaaagggaaauguaauaaggaagaagaaaugguguucuaaacuuaaaacccauuucaucugcuaaaucguccuagugaaauaccaacuuuaguuaauuuaaaaaaaaguuuaguuaauuguaaaaaaaaaaaagaaucucuucauuauuuuaaaaaccauuuguguuuccuuuuucuguaauuuauucauauuuguccauuuuuaauugcaguguuauucuuguuauugauuuuuuaaaacguggucuuuauauuugagugaaauuaaccuuccaucaugaguuggagcauuuuuuccccaauauauacuucucuuuugauuuugcuuauggucauuuuauaaugccaugguuuuuuuguuguuuguuuguuuuguuuuuuuuuugagauggagucucgcucucucagccaggcuggagugcaguggcgugaucucaauucacugcaaccuccaccuccccguuucaagcgauucuccugccucagccuccugaguagcugggauuacaggcgugcaccaccacgccuggcuaauuuuuguauuuuuaguaguaauggaguuucaccauguuggacagguuggucucagacuccugaccucaggugaucugcccaucuugaccucccaaaguccugggauuacaggcgugagccaccaugcccagccuggucaugguuuuauacaugcuauguuuauaaucaaauuuuacuucuauuuaauagaugacuaacacacuuacacauagaugcuuauacccaaauauguauguuuauagauuuuaaaaugcuuauuauauuuaaaaggccuaauaaguaguuucagcaaaagcuguuauauauauguauauaauggaccaauugcaguuggaucaauaaagaacuguaagguguguuaugaucuagaaaaguguuucuuuuuuuuuuuagauggagucuugcucuguugcccaggcuggagugcaguggcacgaucucggcucgcugcaagcuccgccucccgaguucacgccauuuuccugccucagccuccugaguagcugggacuauaggcacgugccaccacacccagcuaauuuuuuguauuuuuaguagagacgggguuucaccauguuggccaggauggucucgaucucuugaccucgugauccgcccuccuuggccuccaaaagugcugguauuacaggcgugagccacuguucccggcccugaaaaguguuucuuaacaauaacuaggaacugugcuguguguuuuauauaagaguauauuauauaauuuuuuuuuucuuugagauggagucucacucuguugcccagacugagugcaguggugugaucucagcucacugcagccucuaccucccagguucaagcgauucuccugccucagccucccaaguaguugggauuacaggcgcacgccaccaugcccugcuaauuuuuguauguuuaguuuuaccauguuggccaggcuggacucaaacuccugaccucaagugacccucccaccucggucucccaaaguguugggauuacaggugugagacacugugccuggcccucaaucuuuaauuaagaagcaagugccaggcacaaugguauacuccuauaaucucagcuacucaggaggcugaggugggaggauugccagugcuugagcccaggaguuugagaccagccuggacaacauagugagacccuuaucucaauuuuaagaagaaagaauuagguaaugauaugauuuuaauuuuauagguguggaaacggaggcuuagagaauugaauaaucguauauaccuuauaagauucucucauacuccauuuuuaaaaguuuucuaucaaguuuaaguuguauugauacaugauauauagugaagugucuauguacaaugcuuaauuuacauauauauacauuuccaauuaugaauauauugcaaacuguauuagugaaugaauuauucauuuaucauaucaguauuauauauuacuauaauauauaaauauacuaauuauauauuaguauuaauguaaacauuaauuuagaaauacuuuuuucuccagugaagccuccucagacuucucauaugcaucuucaguauuuauggguuucuacccuuugaacaaucuaacaguuccagagcaaauauuaucuucuaagagguuugagauagauccuuauuugaaucaguauauuauguugugacuggaaauuuuaucccuagccaugucucuauucacauaacauuaguaaaugugauuuuucauuaauauauuucauaugaguagcauuaaugaccuccaugacauaauuacuuagucuguugcuuuugaagugauucauucauucuacagauacuuacugaacacacacuaugugccagaaacugcuagcauuggaaguagagcugugaacaaaaucaagcaucaacauuucugauauuugagaagauaggcaacaagcaaauaugugauguaaaguagugauaagugcuguaaaaucacaagaggguauagaaugaggauuguucuucaaguugauagaacagaucuuuaaagaagugauuugaggcugggcgugguggcuuacaccuguaaucccaacacuuugggaggccgaggcugguggaucaugaggucaagagacugagaccauccuggccaacgugcugaaacucuaucucuacuaaaaauacaaaaauuagccaggcgugguggugcgugccuguagucccagcuacucgggaggcugaggcagaagugcuugaacccgggaggcggagguugcagugaguugagaucaugccacugcaugccagccugggcgacagagcaagacuccaucucaaaaaaaaaaaaaaaaaaaaaaggugauucgaggcuucauguggugguucaugccuguaaucccugcacuuugggaggcugaggcaggaggaucgcuugagcucgggaguuugaggccagccugggcaacauggugaaaccccaugucuauaaaaaauacaaaaauuagucgggugugguggugggcgccuguagucccagcuauuugggaggcugaggugggaggaacacuugaaccugagaggucaagguugcagugagccaagauggcagcacuguacuccagguugggcaacagagugagacccugucucaaaaaaaaaaaaaagugauuugagcagaggccugaaugacauaaaguguuuagauaucuggagaaagacuuugcaaucagaugcagacacccugggguuggaaaaugcuuacagucugaauaguaaaagaggcaccaccagcaugacuucuaguuauugugcuacacccugcacauuuuuuucuucuuuuucgagacagggucucacucugucaccuagaugggagugcaguggcaugaucauggcucacuccagcuucaaccuccuaggcuucagcaaugcucuugccucagccuuuggaguagcugggaccacagguuugugucaccacguaugacuaauuuuuuuuuauuuuuccuguguugcccagguugauuuugaacuccuggguucaagugauccuccugccuuggccucccaaagugcuggaauuccaggcaagagccaccaugccuggcccugggcaacauuuuuauugucagucauuuaauagccuagucuaauggauguguagugauaugucauugugauuuuaauuugccuuuccuuaaugacuaaugaugcugaacacuuuuuuuaugugcuuuuuuuuuuugccauuuauaaauuuuccuuugugaaguuuaagucuugccauuuuuaaauuggguuguuuaccuuuuuauucaacagcuguagguuuuuuguuuuuuuuuuuuuuugauacagagucucacucugucuccaggcuguagugcaguggcgcaucucggcucacugcaaccuccgcucccagguucaagugauucuccugccucagccucccaaguagcugagauaacaggcaugcaccaccacgcaugauccacccaccucggccucccaaagugcugggauuacaggcgugagccacugcgcccagcccagaaaggaacauucuuaagcauugaagugauucuugucaaauuugauuucuauucaaauuuaggagcuaggccaggcaugguggcucagcccuguaaucccagcacuucgggaggcugagguggguagauugccugaauccaggaguuugagaccaggcuggacaacauggggaaaccccugucucuacuaaaaauacaaaagauuagaugggccuaguggcgccucaugccuguaguccccagcuaucccggaggcugaggugggagaaucucccgaaccugaugggaaagguagcagugaguugagauagcgccacuguacuccagccugggcaacaaagugagauccugucucaaaaaacaaaacaaaaccaaacaaauuuaggagcuagcuuaugauuguagaaauaauuuuggcaauagaagugagggaacugaguuguagucuagcuaauuaacauuugacaaaccauuaacuuuauaugucucauuuucuucaucuguaaaaugaggaagauuugauuagaggauuuauuaaaguucuuuuaaaaucugaaauuacaguuucuuaauugguuuuguagagauuuuggcuuuauaaaaaugugugaaccauagugacaguagaaacauuugaaauccuauauuugggugauucauaaaagaaaggaagaauuaugggcaucuugccuguaaaauguuauguaaucugaaucguuacccacagcauccugugacugauaaagguacucaugcccaccucuccucccuugucuuucuguaguacuuuccuuucuccccgccucaauaauagcuuuauugauguauaauucacauaccauacaugucaucuauuaauauuuaaagcauacaauucagcgguuuuuagucuauuuacagaguuguacagccaucaucacaaucaauuuuagaacacuuucugaacuccagaaagaaaguacccugccuauuuccccucuaucaccuagccccaggcaacuaugaaucuacuuucagccuccauagauugcccuguuauggacaaauauguggcugguuucuuaguauaauguuuucaagguuauuuacguuguagcaugugucagcuauuucauuucuuuuuauugucaaauaacauucaguuguauggauauaccacauuuuaucuauuccaucaguugauggacauuugaguuguuuucauuuugggauuauuauaaauaaugcuacuaugaacauuuguauacaaacauuauguggacauguguuuucauuucucuuggauauauacuuaggaaugggauugcuguaucacaugauaccucuguauuuaaccuuuugaggaauugccaaacuguuuuccaaaaguggcugcaccauuuacauucccauuagcaauauaugcuccaguuucucuacauccuaccuuauacuuuuuuuuuuuuuuuucuuuuuuugagacagagucucgcucugucgcccaggcuggaguacaguggcacaaucucggcucacugcaaccuccgccuccugaguucaagcaauucuaaauuaucaugccucagucucccgcauagcugggauuagaggcguuugccaccaugccuggcuaaguuuuguauuuuuaguaaaaaugggguuucgccauguuggccaggcuguucucgaacucuugaccucaggugauccacacgccucggccucccaaaaugcugggauuauagguaugagccaccguguccggccugauuggccagcuuuucauuuggaauggggauaggacauaguuggaaguuggucucuuugguuauuucccuaacauguccaagcauccuaaaguaucagucaaauaagcagucucuucucauuccuggcagagaguaagucaaagccuuaauucaauuugcauaccuguuuucauguaacaacaaauaauuuuuuuuuuuuugagacagaguuucucuguuguuguuuaggcuggagugcaaugaugugaucuuggcucacugcaaccuccgccucccggguucaagcgauucuccugccuuagccucccaaguagcugagauuacaggcaugcaccaccacagccggcuaguuuuguauuuuuaguagagacgggguuucuccguguuggucaggcuggucuugaacuccugaccccaggugacccgccugccucggccucccaaagugcugggauuacaggcgugagccaccacgccuggccacaacaaagaauuuuaccagaaguggguaugauuuauaucuuaguuugaauugcuacuuaccuuugggggaacagaccuuuccuugauguaucuuuaacacugaaaucuuggcaaguugccaagucucaaauguucaugaguaagacugcaauaucacaauaucauagucacacaggaaucugauagaaaagcaucacauuuauaaagccuucuuuccuguacaucacugacguuuugugaauuuuaaagaauuuguaauuauuuuuaaggagcauauuuaauguagauaauguagccuagaauaggcucauuugaaaugaaacucuugcuaauaggaacuuaauucaccaaauuaagaauauuuugcuuuuguagagauuuugcucuugaaaauguugcagucuugauuucgucuugucaguccagucagaauuguaaaguaauuuuuuuucucauuccagaaauacaugcuacaggauuuaacuaucagaaugaagaugaaaaagucaccuugucuuucccuaguacucugcaaacagguaagagacauagcuuuuguaaaaucucgugaugaauauagugacaucugacuuccuccagagaaauuuauuguaugccauuuuuccccucauuguuauuagcagauuaaguauuaagagcuuuuuuuuuuuuuuuccuuugagacggagucuuacucuauugcccaggcuggagaguaguggcaugaucuuggcucacuacaaccuccaccuuccagguucaagcgauucuccugcgucggccucccgaguagcugggauuacaggugccuaccaccacaccggcuaauuuuuuuguauuuuuaguagagacaagguuucgccauguuggccaggcuggucuugaacuccugaucucaagcgaucugcccacccuggccucccaaagugguaggauuacaggcaggagccaccgcgcccagccguauuaagagcuuuuuaaagagguuuguugcaacuuuugggccaccagcauuuccuucugcggaaguugggcuacgaaaagcaggguuuccaccuccugucacucuauauucucuuuaaacgaacaagccaagaaaaacaggacaaaaacuaaagaucauucuauccuagaauguaauguauuguuuuccaguuuuaccuuuuuaaaaauaccuuuaccuaggccgggcaugguggcucacaccugcaauccuagcgcuuugggaggccaaggcgggcugaucacuugaagccaggaguuagggaccagcauggcgaacauggcaaaaccccaucucuaccaaaaaauacaaaaauuacccagugugguggcucaucccuauaaucccagcuacucagaaggcugaggcaagaaaaucgccagaagccaggaaguggagguugcagugaaccgagaucgugccacugcacuccagccugggugauagagugggacucugucuaaaacaaacaaacaaaauaccuuuaccuagcugcaucuucuauuaauugaauccaaaucccugaagugaauggucacagaugauuuugauauacaaccagagaucaaauagguauuguguuauugagggcacagaaagaaagauagguugauauguuacuauuguuagguauaaaagcacaaagaaauagacuuucugagcuuaguguauguggaagaaauuauauacaaaucaauuggugaaguacuaagacuuugaugaaugaacaaaugaaaaggaacagauaauucaaaaggaagaaaauguaaaugacuaauaaacaugugaaaagauauugagccuccuaguaaugagaaauuuuugcuucucaugugagcugauuuuaaaaauucccaaugauauggcugccuugauaucgcugggggaaguauaaauccauguaauuuuuuugaaaagcauucuggcaguauaucaagagccuaaauauguucauguccuuugacccagcaauucugcuaauaggaauauaucccaaggaaaagucauaaauacagaaaauacuuuaugcccagaagugucugagauauuacuuaugguaguaaaaaauuauaauuaauauauuuguucaacacuaaggaaaugaucaagccaggaaugauauauaucuauauagugaaauauacuuagcaauuaaaagugagguuugugaauucuucacccuguaaagugcuuauuauaauguaaacuugaaaagcagaauauaaaauuacauauuuaagguggugaaucaugucucuaaauggcacaaguaaaaugauaguuaugucuggguguugacauaauuggugauuuuuauucuuauuuauaucuuuugucugauuuucacaauuuuccuacugagaaucuauugaauuaauauaaaauuauuuuuagaaaaaauuuaaauuggagauguuuagucuuuuauuucagugcucuuggaggcccuuuauguguaauuauuauaaaaauaaaugggcugggcgugguggcucacgccuguaaucccagcacuuugggaggccgaggcggguggaucacgaggucaggagaucgagaccauccugacuaacacggugaaacccugucucuacuaaaaauacaaaaaauuagcugggaaugguggcaggugccuguagucccagcuacucgggaggcugaggcaggaaaauggcgugaacccgggagguggagcuugcagugagccgagaucgcaccacugcacuccagccugggcgacagagugagacuccgucccaaaaaacaaaacaaaacaaaacaaaaaaugcuuugccaugaacauguauuaaaagcuauugaagaauauaauuugaaaaggaaggagauucuucugcugcauugucuggugaaucugucuagaaauauuccuauguauauauaaauuuauguauauaauuuaacccacaaauaggaucacaaaucucaguggcuuauaaccacugagauuucuuucuuuuuuacacaugggccaugaggagugcugaucauaugcagccauaucaccaacucuacuggcuccacuuggcucccaacugucuuuccaggacuaguagugagcgggcagccacucucuguaucaugcauggcagagggcagaggcucagggaaggggagaaagcuagaacacaaagacacauuuaaaacuucugcauggccaggcguggugacucacaccuguaaucucagcauuuuuggaggcugaggcaggaggauugcuugagcccaggaguuggagaccagccuaggcaauguagugagacccugucucuauaaaaaauaaaauaaaaaauaaaauuucuguaugauggugguauacuugaugucuacucacauuucauugaccaaagcaaguagcaugaccaagcccaaagucacugggguagcauuuaacagacauuugcaaaaaguuucuaaugaaagauagggcaaaaagcaaaauuauaaguauaauagaaauaaaggaaguuggaaaaagcaaagacaaaucuaaagaaaguuaaaaaaaaaacaaacaaacccaaagcuaauuacuauccuuagagaauuaagagaaagcauugcguucauuaaacaaggacaggacagaaugccaucagauaggaagaauuacagcaggaaaacuuggaaauuaugauggguauaaaaaacccaguaaaaguguuaaaagaugaaguugaggaaacuucuaagcaguagaaaaaacagauagaaaacagaaaaauagauuugagaaccaguccagcagaaccaacauccaucuagugaaacagaaagcagagaaaaugggaagaggauuuuuuuauuuucauuuuugcaacagaaucuugcucugucacccagacuggaguguaguggugcgaucucggcucaccacagccuccaccucguggguuccagugauucuccugccucagccuccuggguagcugagauuacaggcacauaccaccaugcccagcugauuuuuguauuuuuaguagaguugggguuucaccauguuggccaggcuggucucgaacuccagaccuuaggugaucugcccacuucggccucucaaagugcuaggauuacaggcgugugccacugugcccggccagaagagaaacuuucaaaaagacaggaacauuuccuugaacugauagagcaggagccuucaguuugcaaagguacaccauugagagagacuagcuuaaaaaauguaaaaauugccacacugacugaaauuuuagaacuuuugcgauaaaguaaaacucccagaaaguuccugucugggguagggggcaauaggagggaaggcagguagcauacuaccuuuaaaauuuaggaaucagaauaguccuagacuuaccauuaggaacaguggaaacuuagacucuaaugaagcuguucauucaaaauacaaagugaaucugauuuucaaccuaagauugcaugcuuaacccaacuuugaauuucggaguaaaaauauuuucagauuugcaaggucauagaaaauuugauucuuuguaaaagauauuggagugggggauggauuagcuaaagcaugacuuucuacagugaagagaaaaugucuaaaguugaaaaaugaagaaauaggccauggucguggcucaugccuguaaucccaacacuuugggaggcugaggugggaggauugcuugcccaugaauugaaggcugcagugagccaugauuguaccacugcccucgcgccugggcgacagagcaagacugucucaaagaaaggaaaagaaaaaauagcuguguaagcaagacauuuagaagucacagaguuugaaauugauugcuucuuaggggcaggguguggggaguagggccuaguguugagcagggccuggagcuuacguauuuuaaacuaugaacuauuauuuugauagaaauuuaaaaaauuuuagaguuuuaaaucuauaucauuacagacuauauauauucugcguuuacacugugaaaaaauuagaagucaauagaaaaagaaaugaaaaaccuuuuuauauauuuggaaaaauuacaccucugaauaauugagucaaagaagacuuguuauggaaauuagaaaauauuuagaacugaauaaugaaauuaccacauaugaaacauuagggauaaacguguuucauaugcagauaaaauauuagagaggauauuuaguuaagaagaaagacugaaaauuaauuagcuaagcauuaaacucauaaaaacaaaagguaauuuggagaaaguagaagaaaguuuuaagagcagaaacaaaugaaauaagugaagugaggggcagaaauauuaaaaaacugauauuuaaaaauagucccaaaagauauauaaaccuagccaguauagaaaauaaaagcguagauugaauuguuguucagcauuaggaaauaugguaaccauuuuucauuaaauuuaaaaaguuaaacauucuauauuuaucaaaaggaaucaguuuauuugcuagaauucaccagggaagaguagacagaaacuucuaacaugauagaagauauggauuacacacacacacacgacauaaucugugccaaguacuguuuuaagugccucaaaaauauuaauuuauuuaauccuuucaacaaccuuuugagguagauuuguuuugugacaaagucucucugucacccaggcuggaguauaguggugcagucacggcucacugcagccucaaacuccuggguuuaagugauucucccacuucagccucccauguagcuaggacugccuacacaugacacugcaucugguuaauuuuuaaauuuuuuuguagagacagggucucguuauguugccuaggcuggucucaaaugccuggccucaggugauccuccuaccucagagagaggaucuugccauccucccaaauguugagauuacaggcaugagccacuacgccagccagauucuguuacuucuauuuuguagauaaacuaaggcagaaaaaugauuucauuaacuuaaauaauuuguccaagguaacauagcuaguaaguaacauagcugggauuuaaacccaagcaguuuaacugaaaagucugcacuuuuaaccaccacauugugcuaucuuuauuuuucaaauuaaauauuucaaaaacauaguacauuuacauaauuugaaauucaaaugcuaugcaaugaaauuuuguuugccagucuaccgucuucuuucucagcuccauuccucaacagaaugaaaugaaauuuuccuuucaaaacuauacccugcuuuuguaagcauuuauguauauacuuuuuaagaacacagaaaucaccaugccauacauaauguucugcaccuuucuucuuuuccccuuaacuguaaauauuggaggccauuuauuauuaguauauaagagauguaucauucuugauaaggucuguuuacagcagacaugcuaaauggugaagcuauuucaaauaauaacaaacaaguuagagaagguuaugaccauucguauaguaugauuuaacauaauuuuugauauuuuuggccaauauaacaauuuugagcuaauauaacaacugauauaaauauuagaacagaaaaauuaucuugcaggugugacaauauugaauuauuauuauuauuauuauuauuauuauuauuauuauuuuugagauggagucuugcucugucguccaggcuggagugcaguggcgcgaucucagcucacugcaagcucugccuccuggguucaugccauucuccugucucagccucccgaguagcugggacuacaggugccugccaccacgcccagcuaauuuuguuuuuguauuuuuaguagagaugggguuucacuguguuagccaggauggucuugaucuccugaccucgugauccgcccaccucggccucccaaagugcuggaauuacaggugugagccaccacgccccaccgacaauauugaauuauuuaauaucuguuugaaaucauuggcuuucacauuuucccaagguuugcuuuaagaaugaaguuaaucuuuuucaagacggauugcacaagugaucuaucugauaaugaagcaaauacugagcuuaucuuaggaggacauuaauaaucuuuguguuuagccucaucaaauuuaacaguaaugcaagcuauuauacagcuaaguaaaaccuacuuuucugaaauuggcaccauucugggauagugauuaaauuaccauaauuauuguaaggucuaacaacccuagaauuaguggcugaggguccuaaggguggcauuuauauggagaaacacugguaguugucagcauuuugaagagucaaaaacaagauaauaaaaaguggugacacauggcgaaacccuguuucuacuaaaaacaaaaauuagucaggccugguggcgcacgccuguaguuccagcuaaucaggaggcugaggcaggagaauugcuugaacccgggagccgaagguugcagugagccgagauugcaccacugcacuuuagccugggugacagacugagacuccauuuuccaaagaaaaaaagaaguggugacacaaaggcaacaaccuuuauucccuuuuuguauaaauuauucucuuuauuuuuauagcauuuaguaggcucauuaaauuuauuauuauuaaaguauuucaagauuuacuccagguuuuacaauuguuauacucuccuaagcuuuaaacauuuaagguuuuugauggaagucccaauuuuucaguuguuuacuuuauaaacgagcuugauauauguuucaaaagguuuacaaccccaaacauaaauauuucauacauuggauaugaaauaagguaucuaauuugaggaagugguguaaauuauguguguugauaggcauaaaauuagacaauuuggcaauccguucauuaauaugguguaaauuugauaaaugaaauuuauuaaaaagucauuuuuucuccuacuugcccuaaaauucuacuauaugaauaguaaguaaauacuuuguaauugguaucauauaaugugacacuaauuaaacuuauuaaugauuuuuaaauacuuuaacuuguguuuuguuugaauuucagguaauaacucuuuccaauacuuuguauuuuguuuaguaugccacuuuuuggaaguggucacugucaauaucuuguuaugguuugauggccuuggagauuuaaaaccgaguaaaaguguaagcagucuuucuuauuuaguuaugaguuuuaaaaccacuuuuguuccaacuaggaaaaaaugcaaguagauuuaccaugaaauaugaauuauauuuaaaaaacaucuuaacaguugauugacuuagugaaacagacugggcaauuccacuuauggaauuguaacauaaaauuccaucauauaguuuccauuaaagguaguagguuuuuauaaucuguuagacguucuuugcaaacuuuauuaaugugaauacauuugcuuuuuuaaaaaaauuaagugaauuucuaaagaaaauagaaauuaaaaauuuuuaauuuaaauuuugcuuuauaguuuaauuuuuuaguaucauuuagaauuaucaguuauuuuacuauauucauauauacugucccaguaaccugucauucucuuuaaagaaaaaaguauucauuguccucuuuagauauuuacaaacaucugauuuuuaaaaauaaacaucacaaaugucuucaauuaagcuucaguugaguugguuuuuucucagaaugauuaagaauauagcacuuucauuaguggugacuuugcucuaaaggucugaaauuuucacuuaaauuacuuuuagaaccaguuugaggcaucaggcuagagacaguuuguaguuugucauucacuuauucuguagacucgcacuccccauaacuuuugguccuuuccaaaagcaaauucaauuuuauaagaugaagauuugacuuugagaucauucaaaagaaugucagaggggccaggcacaguggcucaugccuguaaucccagcacuuagggaggccaagguggguggaucacuugaggccaggaguuuaagaccagcuggccaacauggcaaaccccugucucuacuaaaaaugcaaaaauuagccaggcguggugaugcccgccuguagucccagcuacucaggaggcugaggcacaauugcuugaacccaggaggcggaggcugcagugagccgagaucacaccacuguacuccagccugggcaacagaguaagccucugucucaaaaaaaaaaaaaaaagagagaaagucacaacauuuugaacaaugucaaaugucauugcucuuuagcauuccaaaaugacaauuugaaacauuaguauauaaaaguuugguaugauugguuaauuacuuuauagucaugcccuaucuuugauuuguuagacuucccaugcuuuaaaucuugauauaaguagggccuuuaaaauggucaacuaaaaagucaccauuccucuacguuuuuucgugacuugauuuguaaaacacagaaugggauuacuguuuugccaugcaucuguauuuagcagaugauuacuagauaauaauuauaauuuuuuauguuauaaaaaagaaaguauaugaacucaaaaaagcucacuuuuuugucuaaauuguuuuugcucuuauacaacaauagaauacauauuuaaguuguauuuuuauuugcauuuaauaauuuauuaauuaaauguauuucuuugucagauuucaaaugauugaggugacuuguaagaauuuguuuuaugcccuguugcugaucaaaucauuggucuucccuauagcuccuuacaaaauuaugcaaucaguguuccauuuggaguaaacauuuagugucuuaucuugauagaguaauuggcuacauuucucuuucuaugcaugaaguuguguaaaaggaccaauucacauguauaauuggcagacagcaugaauucuggacuuaaacauuuuaucccauucucacuacuuacuaauuguaugacacuggacaaguuauuuagcuucucagccucaguuuccucaucugaaaaaaugaggacaauaucuacuuccagguuuauaaauaguuauauauauuuuaaaagcacuaugcacaauagcacauaucaggcauuuaagaauaaauguuuguuuccuuuccuguucuuauuuucacauauugguaguuugagacuaaguuaauaacuuuuuaggcagucacccuaaacaugacuuucaagaguuauuuuaggauuagucugccuuuuacuuuaguaaguacuguauucucuccauugccaggaggaauauuugaaaaaggaaggaaugauuugaacauuguaaauagcuaacugaauauagugucuugaggacauauuuuugguaacuguguuuaacaucuccauaaaaguguuuuuuauuuaucuucaaucacagguacgggaaccuuaaagauagauuuuguuggagagcugaaugacaaaaugaaagguuucuauagaaguaaauauacuaccccuucuggagaggugcgcuaugcugcuguaacacaguuugagguauggguuauucuucucuaaaauauuauuauucuuaaauuaggcauucugacaaagcuguguuuuauuauguggggugauuauuugaggcuaggugcccuuggccaugauuguauucacaauuuuagaauuuuuauuuuauauuuagccauuaucucuauagaaaggagggaauuaaggguauggguuggggaaugauuauauacaguuauacacacagacgcucaaacacacgacacauuuugauaccugaauugccuauauacuguguaccuuucuuaaaaucauucucuuaguauuugacaccuauggcuuuuccuacaguauuauuagcuguuuucuggaauuccuuuccuucuuugacaucuuuuguuuaucuuacuguaguaucugugcugucuuugauuuuuuuuuucuccguguguguguguguguguguguguguguguguguauacacauauauauacacacacauauauauauuugcuguccuauguaggccaggaugauuuuuauuugucaaguauuugcaaauuauauaaauuguuuugaaucugcuagucguauuuuuaaguguuaaaucuaaauuuauuucuguaaauuucaauauggauaaagaaacaauucaugauauccguucuuauguuucugcccauaucccuauauuguuugcuuguuugggauaaccuaaaauuuuuuauccaguuuacuacuaauuuguuuuaccugauguaucuucucuuucaauaauuuuauguuacuuucuguuuagaauaauauuugccacagauauuuagguuuaauucuguguuugaaugauucuaaugccuuucucuacccacuuugaacacuucauccuggaaugguuggcugauguaugucucuaaacaauuuuuuuuuaggagaagguauguggguaauguaauuccugagccuuugcuuuucugaaaagucuuucauuugccuuuauacaugaccagauuuacuggguauauagauuuguugaugaaaaaagguaaaaagagcaacuuuugacauccagagguugucuggcacucacagcuagcccauguuauucucccuauuagacauaauauuacagaauaccaacuuuagacaaggcuacuugagaccauaauaaagugagacaaaacaagggauccauaauuuugccuagguacaguacauacaggaucacuaugcuacccgcaaaauaucaaacaucuccaucucucaguuaaaaugagugacuacugcuucuuuaccaauuacgguuuuagauuugcucuagucuggccuccguauagauaagauuuauugagauacauacccauagaauugccucauaggacuucuugcagcacucaaucuagagugaaucccuguuuacuuagacccucuuccaaaucauguaaaccaaaucccaaaucguauaguggguucuuucuuacauucuuauggagacaccagugguucccuauggugugaguucucucuugccaugaguaauaggcccagcucauucaacuguaagaguaguacaaucagcuuacaauuuuucacuuucaaaagucugugaauauuguuuccaaagucuucuacaucucacuuuuucaagaggaggggucacagacuaaaauguuucuucuuccuuuguagguaagauguuguuucguuuugcuuuauuuucuuccugcuugcuuguuaaauuauaucuugauaucgaaaauuaaacuguuuuuuaaaccagguguucacuuuucauugauuuuugcuuaguacuuggugaacccuauugauuuuuagauuccgauaauuuuucagugugaaagaguuuuucuguuauaucuucacugugauauccauuccauucccuucucaguuaauacccaguuuagcucuaguaucugucucucaaauuauguuuaauugcuuuuaucacuuuguccuuuagauauuuucaaacuuaaaucuuguuaucuaugucauuaauuuccuuuaguauaaauucauuucucugcugcugcuucuaauuuaaaugcuucugugcugccauuucuuuccuuauacucucccuucuuuucagaugucuuuuuuauucauugauagaauucauuauuuauuuaauguuuuugagaauauagucagccaaguuucuucuaccucuuugguuuguuuguuuguuuguuuguuuguuuuuuagucggagccuugcucugucgcccaggcuggagugcaguggugcaaucuuggcucacugcaaccuccgccucccagguucgagccauucuccugccucagccucccgaguagcugggauuacaggcaugugucaccaugccugguuuauuuuuguauuuuuaguagagacgggguuucaccauguugaccaggcuggucucuaacuccugaccucaggugaucgcccaccucggccucccaaagugcuggaauuacaagcaugagccacugcacccagccuguuguuucuuuuuauaauacagaaucuugucauugguuccauuuuauuuacuaaauaaauggaaaauucuguuuacuaaaguuucuuuccuuuauaacugauacccugcagaaccccuaaguuuuauuuugcuuucauaaguuugcucuuuuuuaaauuuuuaaugaaagaguaaggacucaaguaggucaaguggcgacaguuuuauguguagcauauggaagugccauuaaaugaaugaccugucuugaauugauagagcaucugucuuuauucccauugcugccauuccagauaaagaacaaagcacgucaaagauugagaauauuuuuauuuuuaauucaaaaauaaaagccagagaggcaacuuaccauguuuucccaacuuugaauucuuauagcauacucuuuacuguucugugcuguguuguguuaacauuauugauuugaaggcauuugcauuaaauuugaaauguuaaaauguaaacaaaaauuuaguuguaaauaauuauaauauauuguuaaaauccauagcagacacuguuccuggauauuugcuggaauggcagugguagcaaguguugucuuuucuuucuaguuaaugccuggcuuguugccuggcacugaagagaaaguaaauauuugaacaagggaaugaaugaaugacagagggaaauggugacugcuuuaugaaauaacuuguuagguuaauucuaagguauuuauauuucauauucuuuucuuaaggcuacugaugcccgaagggcuuuuccuugcugggaugagccugcuaucaaagcaacuuuugauaucucauugguuguuccuaaagacagaguagcuuuaucaaacaugguauguauguguuuauaaguuuaucuaaaauuuuaauaggcuuuagcagauuuaguuugcugauuagaugggauaauaugaaaccaccuaccacagugcugguauauuauaggaacauaaauauuaguuuucuuuauuuucaauaagccucuuuuucuuucuuuuuuuuuuuuuuuucuguagaguuggggucucauuauguugcccaggcuggucucaaacuccuggggucaaucugucuuccugccucagcuucccaaagugcugggauuacaggcaugagccaccaugcccagccaagaccucuuuuucuugauagcuuuauuuuuggaggauuuucucuuugucaaauuccucguuaaauacauuuauaagauuaucuacuucuuuuaauuuagagagguaaauugacaaguuuaauagauuuauaguaacuaaaagcaaaaggucuugggcuggauaugguggcuuacaccugucaucccagcacuuugggaagucaagguaggcagaucgcuugaggucaggaguugaagaccagccuggccaacauggugaaaaccuguccuuacuaaaaauacaaaaauuaucugagugugguugcacacaccuguagucccagcuaguugggaggccgaggugggaggaucacuugaacccaggaagcggaguuuguagugagcugagaucacaccacugcacuccagccugggugacagagccagacccuaucucagaaaaaaaaaaaagaaaaaggucuugacuuauuaaaugucauaagaaagccagguacagugacucuugcuuguaaucucagugcuuugggaggcuaaggcaggaggauugcuugaggccaggaguuugacaccagucugggcaacauagugagaccucauuucuacaaaagauuuaaaacuuaaaaguuagccagguaugguggcacgugucuguaauccuaacuacuugggaggcuaaugugggaggaucucucgaacuuaggaguuugaggcuacagggagccgugauugugccacuguauuccagccugggugacagaacaagaccccaucucuuaaaaaaaaaaaaauaggccaggcaugguggcucaugccuguaaucccagcacuucaggaggcugaggcagguggaucauuugaggccaggaguucgagaccagccuggccaacauggugaaaccccaucucuacuaaaaauacaaaaauuagccagauaugguggcaggcaccuguaaccccagcuacuugggaggcugaggcaggagaauugcuugaaccugggagguggaggcugcagugaguugagaucgcgccacuccacuccagccugggugacagagcaagacuccaucucgggggaaaaaaaaaaaaaagguugcaacagagcaagacccugucucuuauguuuuuaaaaaguuaaaaaaauucaaaagauguagcugcguaaugaaguauauuuaggucucuggcuguuuguauucuuggaauguauucucuucaccaguguuauugaucucauucaugaacaggguaagcauuccccacuugaaguguguugucuaggacugucuuguguggggaacuuggaaaaaccugcugcaccugaaaauaacucuuuuauguauuuauugggggagagcaucccauaaauagaaugucauucucuucucacauauucuuagaagaggaggcuaauauauuaaacggaaauauucauucacacuuuaguaugagugaauuuaucaguguguucuugaauaagucuuccuuggaaggaagaauagagagagcuugaggaaacagagccugaauaggaaaaagagggagaacaccaaaggaaauuagggacuccaaagguaaaguugaaauuucuucacaaauaagcuuagagccaacuuugguagagaaugcccucgaucuagaaguuuguauccuuugaaaugggagauucuacaauuauauuauauuuauuuauuuuugagaaggagucucgcugugucgcccaggcuggagugcaguggugugaucccagcucacugcaagcuccgccucccuaguucacgacauucuccugccucagccucccaaguagcugggauuacaggcaccccccaccaugccuggcuaauguuuuguauuuuuaguagagaugggguuucaccauguuagccaggauggucuugaucuccugaccuugugauucgccugccuaagccucccaaagugcugguauuacaggcgugagccaccgcgccuagccccuauuuuauuuuuauuaauagucauuuucuccuaaacuuaugucaguugaaaaguaugaagcccuuaacuuaaaucaucccaaugccuggcuuauaauaaguauuugagaaaaguccauuccucuuuucuuucacagguccuugguaguuuuaacacuucagccuccagcuucuuaguaugaguguuuuaucagaccacuuuccuucuuaaagacagcauaaaagcacuggaugaauugggguagagaaauaagccaugcuagaauagaaagggguaaagagaugcaauaaagccuacaguuuuuggcugguauuugcucuaugguauuaauguaaaccuauuuaaauuuuucuuuuuuuuauuucuuaaagaauguaauugaccggaaaccauacccugaugaugaaaauuuaguggaagugaaguuugcccgcacaccuguuaugucuacauaucugguggcauuuguugugggugaauaugacuuuguagaaacaaggucaaaagaugguguguguguccguguuuacacuccuguuggcaaagcagagcaaggaaaauuugcguuagagguaaauguacuugaagaggauuguuccaacaguccauaacuccagguuggggaauuuacauuucuggucaauuauuaguacaguuauuuauaauuuaaucugaaaguugugcuacuugguuuauuuuuaguagaauuuaggaaaugccaaccuugguguuucauuauuuuacaaaauaauaauuaagagaauauaagaguggaauuucucuagggaauggguuggaaaauauguaguuauauuuuucauaucaaguuauaaauggauuaaaguuuggccauuguauucaaaguuuggagcuaaggcagucuucggaggguagggcuccucgggauucauuucuaguaauuuaagauacauuggcuugcaacaggauuccuuuguggguuucaauaugaauuauaauaacauauuuauuagaugguuauuuuguuuauacuuuuauagguugcugcuaaaaccuugccuuuuuauaaggacuacuucaauguuccuuauccucuaccuaaaauugaucucauugcuauugcagacuuugcagcugguaaaguaaauuucauuuuauugcugaauuguaauaacuuuuuaaaauuuugugacuuuugaugcaagaguauauauauauauauauauaucaauaaauguuuauauuuauuuugugaaggugccauggagaacuggggccuuguuacuuauagguauguuaaugauguguuacccugccuuaucuuuucaaaucacugauuucaaaagggcuucccuccuaaucacaguugaguagcuucugcuuuacgauaugguguaaauuuuucuaccuucccccacuuccgugcacauuucaagaaugcagauggacaccccucccuuuggugcuacugucugaggguguaagauuuuaaagugagcaucuggcgguaguagcauuuuuagauauauucuuggcuaaguuucucauugcaguaguuucauagcuauuuauccagcuuggagaaccuucccuaauuucauaucuucuagccaaguuuuuacaugucugucaccacaacauaaacaugugaguugaauaacuuuuaaaagcagagucugucuguaaacaaguuuuugccuucuacuuucaauugccuuuuuagaugagcuaaguguuggacagccggcucagugcuguuuuugggacuauggaaugcaucuuccuccaccacuccccucauuuaauggaaggacuuucuucucucuccaucuagcacaguaaucgcuaaucccuuagacaauguuuucccaaaauuucaggcagcuauucuaucaacaaacugauaauuaaacuugugucacaucuuugauauucuguuguauuaauucuguugggguagucuuuaaucuucgugaaacuuuuucuuuccauauuaggaaauauuuuccuaauaucucuaaagccuaacuuguccaucugacuuacugucugaaucuucccaacuuaugcaugcccacuuuuauuguuuaaauuuguuucuuuuuuuuuuuuuuaaacacagggagacugcauugcuuauugauccaaaaaauuccuguucuucaucccgccaguggguugcucugguugugggacaugaacucgcccaucaaugguuuggaaaucuuguuacuaugguauuuaauauuuuuaagugcucaaauauauuuaucuucauccuacuccacauuauuuuggcuacauaguauuucaaguuuggcugcaacacugugccaaaaaauaauugagugauagaaaaguauuauuuuaaaagguccacuuugaaaaggcuuaucagaaucucugcauugaacaagggcauauggacagucuuuauucaacagacacuuccuaaacuguucuaaaauuugucugcaagugggaaaagucaagauacuaauuugggugagagaaaaacauuccucuuagguguagaugaaugaaucaugcagugagauuccaggcuaacuguaguuucuugaaucuuauuuguuaaucugauucacagcugaaaaguaaccugaugaauaacaaacugaucuuuaauuagagagaaauguuuuuaggagucaguuuuuucauugccuaaaauguuaaguugaaauuuaaugaaauaaaaguaaacaaacugcagagugacugcagaauaaagcuguauuaaaauuccagcuguucuguugaaauccuuauaauguuugcaguaaugaucucuguccuucaguccugauuuuucacucuuacucuaaguaaauacuauuuaugaaugccaacuguguuagagcuugggagcacaggauuuaauaagugaacuagauguaccucugcaauuaaauaacuggauauucuggagccagcuagauucccugacauuuuaggcugccaaagagcagaaccugauuugaauguagauugaguccauacgucauauaaauaagaauguaagacauuuaucaacuauuacgugucucagagaguuucuacagaaagucaacccuugaaaauaaaucuuuuccuuuuauuuuggauguuuaaaauuuuacaggugaaaaaaauucuuugaaauauaauuucaggccgggcacgguggcucacgccgguaaucccagcacuuugggaggcugaggcagguggaucacuugaggucacguguuugagaccacccugaccaauguugcgaaaccccaucuccacuaaaaaaaauagaaaauuagcugggcgugguggugugcgccuguaauccuagcuacucuggagguugaggcagaagaaucacuugaaccugggaggcagagguugcagugagccgagaucacgccacugcacuccagccugggcaacaagagcgaaacuccaucucaaaaaaaaaaaaagaaauauaauuucauguggaauuauguguuggugccuguauucaaauaugugaagaaauggccuuuucuucuaaugcagcaaguuugcuacuuuguaccaaauaauuuuuuugcuugguuuugagauaacuuuaugauuuuauuuugaaacaagcaauaaauuuuaguaggggaaauguguacauucuuauuaaacaacuuuuuacugguuuuauguaacuauucuaguuauuagaacugaaauuccaagggcuuagggauagguuggaaaauaaguuucauuuuaugcuaguuuauuuuaggaagcuacuaggcaaauagccacuuaucacuuaauaucaaaauaauuuuuuuuuuaagacagagucucacucugucacuuaaacuggagugcaauggcacaaucaugguucauuacagucuuuaccucugggcucaagcaauccuccugucucugccuccugaguagcugcaauuacagguguguggcaccaugcccagcuaauuuuugcacuuuuuguagagacaagguuucacuguauugccuuuuguagagacaggguuucacuuuguugccuaaacuggucucaaacuccugggcucaagcaauccucccaccucagccucccaaagugcugggauuacaggcaugagcuaccacaccuggccuuuucuggggggacugguuggggauggagaaugggaucucacuuugucacccaagccggagugcaguggcacaaucaugggucagugcagcuucaucuuccugggcuuauguaauccucuugccucagccucccaaguagcugggaccacaggugugugucaccaugaccagcuaauuuuuuuuuacuuuuuaauuuuuuuagagauggagucucacuauguugcccaggcuuaucucaaacuccugggcucaagugaucuuccugccuugaccucccagaguauuggcauuacaggagcaagccauugugccuggccugcuuucuuuuacuaauaggcuuaaucaacuuuaauaaaauuuagauuaagaucuuucaaauuuuuuuaaaauugauuuuaucugucacucauauucuuuguccauuccauuuacuaugcauucuuauuuaacaggugauaauuuuauauuccauaagugcuuaaacaccauucauuacugaacugcauuuuuguuuaauuucacauaauuuuuauauaagcaguacucuuucucaguuucucuugaacauucaacucauuagugagugguuuuccccugucauuuccauuuuucuuuauuuggcucugauaguuuucuguuuuuguuuuucagagauaauccuuuacuauacuaaauucuacaugauuauauuuuccaccucuauuugccuauauuuaucuguugucuuuuccuuuuccauauaugggcuuuuuuuuucccucuucuuccuuuucuaccuuugguauuuaaaaaguuacuuaggacugaaugcacuggcuuacgcguguaaucccagcacuuuggcaggcugaggcgggaggauugcuugagcccaggaguucaaggcugcaguaagcuacgauggugccccugccacuccagccugggcaacagaaugagacccugucuggguuugcgggagaaguuauuuacaauguuuugaaaauauccuuuagcccaggcaugguggcucacaccuguaaucuuagcacuuugggaggccgaggcagguggaucacuugaguucagaaguuccagaccagccuggccaacauggcaaaacccccucucuacuaaaaauacaaaaauuaggcaggcauagugauacaugucuguaaucccagcuacuggugaacacuccagccuggugacaaaacaagacuuugucucaaaaaaaaaaaaaagaaaagaaaggaaaagaaaaugacccucagauauaauucucauaucaccaguuggccuuucuugacaucucuuuuagucuucucucuuuuucagaaaugugaguucuuugccaaauguuuugaacugaauuuuaggucauuaaauugugaguuugggaauauaguggaagggacaugugaguguuuuagauuaguagaaugacaaucauuucauuuucuuuaaguauuuucaucuuuuguuuuuaggaaugguggacucaucuuugguuaaaugaagguuuugcauccuggauugaauaucuguguguagaccacugcuucccagaguaugauauuuggacucaguuuguuucugcugauuacacccgugcccaggagcuugacgccuuagauaacagccauccuauugaagugagccauacuuucuaaccauuagccuaugacugcucucauuuacaaugaaauacguaauuuguuacauagauacuuuggacuuugaaaauaagagaaaauagcaugggugauuuuacugguucauauuucuagucuugaaaagcuaguaagucuaaguucuaauuaacauuucuuuuuaagguaggcaguaaaaaaaaauuggucuggccaggcgcaguggcuuaugccuguaauccuagcauuuugggaggcugaggcagguggaucaccugaggucgggaguuugagaccagccugaccaauauggagaaaccccgucuuuacuaaaaauacaaaauuagcugggcacgguggcgcaugccuguaaucccagcuacucgggaggcugaggcaggagaaucacuugaaccugggaggcagagguugcggugagccgagaucgugccauugcacuccagccugggcaacaagagcaaaaaacucugccaaaaaaaaagaaaaagaauaguaugggagaagucauaccuauuggguaacacuaugguuccauuguuuaugucaaggaaaauucuggacauauuuuauugucagggucuguuuugugaauacuuuaauucucuugacuuagccuaucccuacuucaguuuauauauauaaauuuuguaucuaaagaacuagaguuauaaugcuacuucaacauauuuaauuaggcucccauauaauuguaauucauuacaauuagugcaagaaaucuaauguucuucaccuccauaucuuccucaucacuccucugcaacuaccccaaaaauaaacagaaccauaguggcuucuuucccagcagaacaaagccaggacuggaacccaggcucuaagggaugacaggaaucauguucuauucaacuuuauuauuauuaguuacuacauuuuuuugaggaccaucguuauacauuaugagugaguuaaaggcagaaaaauguaaguuagaaggguuuuccuagaaagcguuuuauguaauucaguauuacaggcuaucugcuuccugucauaacccugaaucacacugucugccaggucagugugggccauccaucugagguugaugagauauuugaugcuauaucauauagcaaaggugcaucugucauccgaaugcugcaugacuacauuggggauaagguaaaaaaaaacuuuaaauauuucauucuuuuauggugaaaucauaagaguuuugcaugaaaaaaagucucacuuuauuuggauuaaguucccaaauaguuucuggcuugucauuuuuuuuuaaugaccaaaaagaaugagaauucaauuauuugaaguugacuacucuggucucuuagaugagugaugugcagguguguuugggaguggaaaugggaggcuguuacaaaacuuaagagcaagaauagaaggcauagaguacgcauuauuaaauaaaaggcaguaggcaucagaaggauauauguguuucaguguaucugauacuugaguauuugaguaaauuuguuuuugauuacugauauacaaauauacuauaaauucugagaucugacuucccuggauuuuaaaaauuguguuuucucaggacuuuaagaaaggaaugaacauguauuuaaccaaguuccaacaaaagaaugcugccacagguaaucucuaauagcuugagauagaaauggagagaaaguauugucacucuauccaggcugggacauuuuauuuuuguucugaauacuuaaggucaggauccauguaauaaauaaauuagccuuauuugaagcuguguucagguugaauaucucuaaucucaaaaucugaaauuugaaaugcuccagaaucugaaacuuuuucuuuccuuucuuucuuuuuuuuaauuaaaguucuagggugcaugugcacaaugugcagguuuguuacgucaguauacaugugcgggccauguugguuugcugcacccauuaacucgucauuuacauuagguauuucuccuaaugcuaucccucccccagcccccuaccccaugacaggcccuggugugugauguuccccgcccuguguucaaguguucucauuguucaauucccacccaaaaucugaaacuuuuugagugccaacaugaugcucaaaggaaaugcucauuggaacauuuuagauuuuggauauuccaauuauagaugcucagcuaguaaguauaaugcaaauauuccaaaauccaaaagaaauaugaaauucaaaacauuucuggucccaagcauuuuggauaagggauacucaaccugcaguaagucauagggucaacaugaaucaggacucguuaucccuuuggucauccuccagcauucugcuuuccauaacugaguauuuugccaacuuaaagagucugggccgggugugguggcucacgccuguaauccuagcacuuugggaggccaggaugugcggacugauugagcccaguucaagaccagcuugcaacauagcgagaccccaccucuacaaaaaauacaaaaauauuagccggguguggugguaugugccuguagucccagcuacucaggaggcugaagugggaagggucacuugagcccaggaguuugagguuacagugagcaaucauggcaccacugcacuccagccugggcaacagaacaagauccugucugaaaaaaauaaaaaauaaagggaauacagucauguguugcuuaacaacagggauauguucugagaaauauguugucaggcaauuucaucaauaugugaacaucauagaauguacuuacagaaaccuacacaguauguccuaggcuauguacaccuagccuacaugguauauacccuguugcugcuaggcuacaaaauaccuguacagcauguuacuguacugaauaccauaggcaauuauaacacaaugguauuuguauaccugaacauuucuaaauauagaaaagguacaguaaaaauaugauauuaaagaugcuccaccagcuggcugauaugccuauaaucccagcacuuugggaggcuggggcagguggacugcuugaguccaggaguuugagaccagccugggcaccaugccaaaaccucgcuucuauaaaaaguacaaaaauuagcugggugugguggcaugugccuguagucccagcuacuugggaggcugagguaggaggaucacuugagccugggaggucaaagcugcagugagcugugauugggccacugcacuccagccugggcaacagcgaaacgcggucucaaaagaaaauaaggugcuacaccugaaugcagcuuauaggacaacuuauagagguuguucuaguugagugaguggugagugaauaugaaggccuaagacauuacuauacacuacuauagauauuauaaauacuuuacacuuaggcuacacugaauuuauaaaaauaauuuuucuuucuugaauaauaaauuaaccuuagcuuacuguaacauuuuaaauuuacuuuuuaauuuuuuuaacuuuuugauucuuuucaauucuuuuuuuuuuuuuuugagacagaguuucgcucuuguugcccaggcuggagugcaauggugcagucuuggcucaccacaaccuccgccucccggguucaagugauucuccugccucagccuccugaguagcugggauuacaggcaugugccaccacggccggcuaauuuuguauuuuauuuuauguuauguuauguuauguuauguuauguuauguuauguuauguuauguuauuuuuugagacggagucucgcucugucgcccaggcuggagugcaguggcgcgaucucggcucacugcaagcuccaccucccggguucaggccauucuccugccucagccucccgaguagcugggacuacaggcgcccgccaccacgcccggcuaauuuuuuguauuuuuaguagagacaggguuucacuguguuagccaggauggucucgaucuccugaccucaugauccgcccgccucugccucccaaagugcugggauuacaggcgugagccaccgcgccuggccuauuuuauuuuuuuuaaagacagggucuugcucugucgcccaggcuggagugcaguggugcagucuuggcuucguugcaaccuccgccuccuggguucaagugauucuccugucucagccucccaaguagcugggauuacaggugugugccaccaugcccagcuaauuuuuguauuuuuaguagagacaggguuucaccauguuggccaggcugguuucgaacuccugaccucaggugacgugcccaccucggccucccaaagugcugggauugcaggugugagccacugcacccagccuaauuuuguauuuuuaguagagauggggugucuccauguuggucagacuggucuugaacuccagaccucaggugauccgcccgcuuuggccucccaaagugcugggauuauaggcaugaaccacugcguccagccuggauauuuuuaaagugagguuaauugaauggguauaacggucuuaaguuugucagugauuguuuaguagugaucuugaacacauuucaauuucuuuguuucuccuuaacucaucuguuuaucuuuuauuauaauuuguaauuuuucuuauaaauuagaaugauuaaguauaucucagaauaaaagaccaguuuuggccagguguuaugacucacaccuguaauuccagcaccuugggaggcugaggcagguggauugcuugagcccgggauuuugagaccagccugggcaacauggugaaaucccaucucuacaaaaaauugcaagaaauuaugggccaggugcgguggcucaugccuguaaucccagcacuuugggaggccgaggcaguggaucaccugaggucaggaguucaagaccaaccuggucaacauggcgaaacuccaucucuacuaaaaauacaaaaauuagcugggugugguggcacaugccuguaaucccagcuacucaggcaccugaagcaggagaauugcuugaaccugggaggcagaaguugcagugaucuuagaucauggcacugcacuccagccugggcaacagagcaagacuccaucucaaaaaaaaaaaaaaaaaaaaaaaaagccagguguuguggugugcaccuguagucccagcuacucaggaggcugaggagggaagaucaccugagucugggaggucgaggcugcagugagcugugauuaugccacugcacucuagccugggugaugaaguaagaccguaucucaaaaaauaccaguuuuuaugauagaauuuacuuaguugcagaagagggguggcaaggggaauguuaauuuggcucacuguuuccugaaccugaaagaaccaaagaauuagcaguguagugucaaaaguuaaauaaaauuucuuuuuuguuuaggaaaauaaaaauauaaacauuuuagauuaucauuguuuaucuucuagaggaucucugggaaaguuuagaaaaugcuagugguaaaccuauagcagcugugaugaauaccuggaccaaacaaaugggauuuccccucauuuauguggaagcugaacagguaaacauauaaagucuuuccauuugucugauauuguauuaaaugaaguucaguacaguguaucaaguuugcuuuucuguacuuuaaguuuucuagugacauuuaaaccagcccuguuacucuuuuaucaguaauuuuacagcuugcaucauuaaaauuauacaugcuuaagagagaaaacaaaauguuacuugcuugucuagucuccagggaaaauacuguaaaauuugauauaauucuaaaaccaccaaauaugguuuauucuacaaaugcaagguugguuuaacauuuuuuaaaaaauuaggccgggcgugguggcucacgccuguaaucccaacacucugggaggccguggcggguggaucacuugaggucgggaguuugaggccagcccggccaauguaguaaaacccugucucuacuaaaaauacagaaauuagcugagcaugguggcacacaccuguaaucccagcuacucuggagacuuaggcaggagaauugcuugaacucgagagguggaaguugcagcgagccgagauugugccacugcacuccagcuugggcaacagagcgagacuucgucucaaaaaaaaaaaaaaaucaauguauugauuuauaaucacuacauaaacagaaucaaaugcaaauagcacauaaucacugacuagauguagaaaaaacauuugguaaaauuucauacccacuuauaauaucaauuguguaaaguagguuuuuaauguugguuggauggcagugugauuuuaauuaggauugcaauucauuaauugaacuguuaccugaauucagagaggaguacuuugguaugaguuauacuucaaaaggacugagaauuacacaacauccuuuaaugccuaccaaaaagugaucuuaacucgguuucauuaaaugaaauuguucucuucaguuuauuugccaugguuuugugagcugcauggggaauuaauuccuguucauuuuuagggaaguggauucauaguucuuuuuuaguauguguuuuuucuugugguccuacauuguccacaaagcuaaguauuuuuuuauuauuacuuuuauauuuuaaaaaauugggaugaggucucacuguauugcccagccuggucuggaaccccugggcucaagugauccuuccaccccugccucccaaaagugcugggauuacagguaugagccacugcacacccagccaaagccaaguauguuuuacaaauaauuucucaauguggcaaucuaaguuauaaauuugcuuuucugcacauuuguauucuaggugacauuuaaaccaauucuugcacucucaaaaugcucccaaauuuacauggaacauuuucacguguaagcuugcagauuacccuuucagagccaaaucuuaacuuuaaacaugauuggauuuuacacuaaagugugcacacuggaggaccucucaguuagauuggcugcaauaacuuggaaaggcaauuuagggaaugcaauugaucauguuuggugggaaagaauaccuguaaguuuagugaccugccacugugaccaguucuauuucuuugcagucuuuuuucugcacuugggacuagucuuguuauaggagaugacuaauugaauuugauguugacacugcauauagacugacucuuuuaagaauauuaacauacaaaaauuauuguuacuucucaucugagcauuucguucccucaaaacuacugaacuauuggcugggccaggcacaguggcucacgccuguacuuagaauacugggaggccaaggugggaggauugcuugagcucaggaguucaagacaagccugggcaacauagugagaccucgucucuacuaaaaguaaaaaaaacuagcugggcaugguggcacgugccuauagucccagcuacuugggaggcuuaguuggaaggaucgcuugagcacaggaggugugaaggcugcagugagcugugauggcagcacugcaguccauccugggcaacagagcaagaccauguauuaaaaaacaaacaauuggccaggcgcaguggcucacauuuguaaucccagcacuuugggaggaucacuuguguucuggaguuugagaccagccuggguaacacggcaagaugcugccucuaccaaaacaaaaaaacaaacccaaaacuauugaaauguuaaugauuacacauaaaacagauuauuaagccguaauuuuuucuuaaagcagaacacacuuuuaagaaauaauaguuuaucaguuagaacagagaacaguaaugccacacuucucaguguuacugaaacuguuuccauccaggggcuuucaaggucuugcuuucuuuguuuucuuuuuugucuacaggcacggccaaacucauccuccauuuugcauugucauaaaaggccaauggccuggugcaguggcucaaacuuauaauccuagcacuuuaggaggcuaaggcaggaggauugcuugaaccuaggaguuugagaucauccugggcaauauuauagugagacccugucucuaaaaaaacuaaaaauaaauuaaaaauauauuaaugaaauuaaaggccugucuguugcucuuaauucuuuuaagaauaggagagcuguguaacauaucuugauuaugaucuguuucucacuuuacauuccccaaauuuaaauauuuuugcucuaauucugaaucaauguaaaagguuucaacuuucucagggaaaucugugugauauauaacugauuauauauauaauuaguaucuaguguuaacguucauuaauaguuucccuguggcaucaaaguggccauugcuuucucacuuaaauuuuuucuuaguuuuucaauucuauuucuugcaguaaguuuauccaugaaacucauuagcccaauuuuacauuugauuuaggugaucuuaagucuguguuauuugaaauccaggaugugguaacuaauaaaugacacaaaugacugcauauuguugaaguauuuuguaaacacauguacuuaccauuguugccucuggcuuuuuaguuauuuggacuuuucucuuuaguauuaccgucuucaucacaauugcauuuuguauacucaugagacauuugguugugcucguuccagcauuugucacagaaauguugucucccuccucuucaaaaacaaaaaccaaaaccccagauggugucaguacuauuauagccuuuguuuugcuucuuuagguagaagaugacagauuauugagguugucccaaaagaaguucugugcuggugggucauauguugguaaguaaauggcuguaagugagauaugauugaugaauuuggauauuaacuaauaccaguaguauuccaacuaauaggaaauuuuucuuuuuuuuuuuugaggagucucacucugucgcccaggcucgagugccauagcgugaucuuggcucacugcaaccuccaccuccuggguucaagcaauucuccugccucagccucccaaguagcugggauuaacaggaacaugccaccaugcucggcuaauuuuuuguaucuuuaguagagacaggguuucaccauguuggccagacuggucuugaacuccugaccucgagauccgccugccucagccucccaaaguguugguauuacaggugugagucacugugcccagccauagaauuacucuuuuaaugaauauaucuaacaaagcugggcacagugguucacgccuguagucucaguacauugggaggccaagguggucagauugcuugagcccagggguucgagaccagccugggcaacauggcaaaaccucaucucaaaaaaauaaauaaauaaaauuagcuuggcaugguggcaugcaucugcagucccugcuacuugggagccugaguuggagaauugcuugagcccaugagaucgaggcugcagugagccgugauugugccauugcauucuagccugggugacacggcgagacccugucuggggggagaaaaaauaucuaacaaaucagaugacaguuuuauuauccaaauaaaucuguacgugucacaguugccguuuucugccucuuaccuauaauccacauuguaguacugacagguuuuucuaauacucugugaccaguagagguaacauuaaaacuugcaguaucccaauauuggagaaauuuuacuuugugguuuaaccugauagcauaaagcuauguaauuuauuaaaguagcuccauuuccaugaauguacugggcaaggacucuuuuuuuguuuggcaucuuaaugccaagucuguuuugcugucugauauguaagacaguguuucugccuuacaaaagcuuuggcuuguagauaugacuccucugugacggaacauaacagcuuccagguuguauccugucuaucacaacaauaaaaauuaacccuucgauauuucagcaguguguauaccuguuaaggacugcaccuuagaauuuguuuuuaaaugauauaugaaggcugggcgcaguggcuuauaccuguaaucccagcacuuugggaggcugaggcguguggaucccuugaggccaggaguuugagaccagccuggccaauauggcaaaaccccaucucuacuaauaaaguacaaaaaaauauuguauauuuuugggcaugguggcacacaccuguagucccagcuacucaggaagcugaggcacaagaacuucuugaacccgggagguggaaguugcagugagcugagaucacgccaccgcacuccagccugggcgacagagcaaaacucugucuccaaaaaaaaauauacauacauauauauauauauuuuuuguuguuguuguuguuuuuuuacuuuaacaguaaaauugcugucuuugcucucuagggggaaaaugauaauuaaguuuaagucauugcauuugugauucuacaagugaguuaacuguuuucuuuuuuuagacaacauguugugauuuuguuaguaaaugaucccuuccuuugcacugauacuauucagguuaucuggaagaguucauguaccacuaagaaugaacuauugacuuaacaguuuggcuuaggcuccugguuagaacaccaccacuccucucuccaccuuaccuucuguuugucccagugcaaaauuuguuuguucuucucuggcuuaggugaagauuguccccaguggauggucccuaucacaaucucuacuagugaagaccccaaccaggccaaacuaaaaauucuaauggacaagccagagaugaaugugguuuugaaaaaugucaaaccagaccaaugggugaaggugaguucagaaucuuaccuaaacagauuucucucacuuauacauuuuauggccgguuuuaaauucugcuucaguuuaguaguuucaaagaaaaaaaaaaaccuaaacuuuucuuugugaaacuuaggacgaauuuucauauaguauuguccagacauuuguccuuauguuagggaagguagugguagagaagcagauccaaaggcauaggacuaaggaggagaagaaaaaaaaaaaaguagacugaguguaagcauauaugaaccaaaauauguguagucucacaccuucaaacuccccugucauuguaaugaaagguuaacuucaaugauguguugucaccauauguguacuacuguaaucuaaugagagcagacauacauaauaaucgguucgugucacugaaauguaaaauuccuuaguugguauuucaaaaccauuucacaaaaauaccaauagguaagaauuauuuuucauuauucuguacucuguaccuuucauaaugaaaguauuuacuacagacucuuaauuguauguuccuaauaggaauuauacauuguaucagacauuugugcuuuuuuuuaaaaaaaagcccgccgaacgcugugguagcacuuugggaggccgaggcagguagaucacuuucggaggccgaggcaggcagaucacaaggucaggaguucaagaacagccugaccaacauggugaaacccugucucuacuaaagauacgaaaaaaaaauuagcuagucgugauggugugcaccuguaaucccagcuacucaguaggcugaggcaggagaaucgcuugaacccaggaggcggagguugcagugagccgagaucgugccauugcacuccagccugggugacagggugagacgccaucucaaaaaaaaaaaaaaaaaaagccauuuuuucuguuuaucaacuucuuuuuuuuuugaguuggucucacuauguugcuuaggcuggauucaaacuccuaggcucaugugauccucccaccucaggcuccggaguagcuaggauuauagucaugagccaccaugccuggcauuguuuuacuuuuuuaaauauauauuuaaaauauacucacuggaauauuaccauuugaaauuauaaucuggaagauuauguuguagcaauaugaaaaauuucuuauaaaugagaaaaaaguuauguacacuacaauuuugauuagguuaaauaaagggaaucaauaaagugauaguugcguuaaaauuguaggggugguuuuaaaaauauuuacauauaaauaguaaaauauuuguaucuuacuguuuuaccauuuaacuauuuugaauauaaauguucucaaaacuauuuuuuggcuauugguaaauagccuauagagaauaaugcaguugccagguguaguggcucaugccuguaaucccagggaggcugaggcgcggcggaucaccugaggucaggaguucgagaccagccuggccaacacggugaaacccugucucuccuaaaaauuacaaaauuagcugggugugguggcgggugccuguaaucccagcugcuugggagggugaggcacgagaaucacuugaaccugggaggugaaaguugcagugagcugagaucaugccacuccccuccagccugggugacagagcaagacuccaucucaaaaagaaaaaaaagaauaaugcagucaguaauuaccucacgccaaaaaucuuaugaaauugccuuuuagguccauguacuucuuuaaaauuggaaucugaaaauuguuauuccguucagucucugugcuuauaagaucaauguuuguaaaggccuaagcuuucuuagagauuccacuguccagguguuuucauauauauuaaguauuuucuguaaaccuaaaauugagguuagaaauagaaacccacauuauuuugucccuuccuuguucuuucuacugucccucacuuuggcccucacaauuucaaguuucccuuuucuuuugucugugcauucauucugucuugauguguugucuuguuuuaauccauuaguuggcauagauggucuuaauuguuuuucauccagauauaucuaaaaccagaacuccuuuuaaacauacaaaagguugauuuaaaaaauuaauggagcuguuuaauaguacuuacuggauaucuuugcaguuaaacuuaggaacaguuggguuuuaucggacccaguacagcucugccaugcuggaaaguuuauuaccaggcauucgugaccuuucucugcccccuguggaucgacuuggauuacagaaugaccucuucuccuuggugagcaucugugacuuaaguaauaugauggauuuugcugauuaaaagauucuguuuuuccuggagugucugaaacauaauuagaagaauaugggucuucaugaugguuaaaaacaccuuugggacuagagcaaaucacuguuuuuaauaugacaagauugaggcuauauaauuuaaaucccauuucacuacuccuaagccagcuuucugaaacucuuaauuaaacuauccuuuguaaggcaaaaaauuccuuucuuuucaguagaaauaaauauaagccuugaagaaaugacccuacugauagguuuuuaaaauaauuaagucagagugauuuuauguuuuucuaaauagugguuguacuuugcugggaaagccauaauuuuuaaacauuguguucuuauuucaaauuauaucccauuagcuuuagaauuauauuuauauuuggcuuucuuccagaaaggauuuaaagcagcaauuaguauuauuuucuuuaugacuucagcguagguuagguaauuuccagaugucuuuaugauaaaauugucauauuccuccuaguauuucuuuaaauuggacuggaaauuuucccuccccucugcagucauugguuuuggauucugccuuuguauaaacacagauuagcauugaugcacaaaaccucacaucugcugaucuaauugcugagagagaccugucccaggagagugagcuguuugugcagcuggcugcuguaacagaaguucuuuuuccuaacucuguuaguucugaaaggacuuugaauuuguagugccuucuaguuuauguucuuuuagaaaugaguaaaggagaggcuuaaguugacacaguuugcagguccggcuuugaaagaauguuugucaaaaaccaaagcucaaacuauuuuugcaguuuuucugaaaguaugaaaaauuucaaaacaguaacaaagccaaguccccagaaacugaguagaaauagaaguuaagugguuuguuguuguucucaaauuguugggacucuuaguguaauuuuuaaaaguaguucuuguauaaauagcaaaugauucauucuaauuuuucuguaaaaagaaaaagaaaaaaauaacaaaggauuaaagaaggaauguugucugaauaggauuuuuaugcuaacaguguucugagcuuauacagucccauuuccuuaaaccaaagaaauugcuagcaguagauaaugccaaaaaugcaugcuuauguuuuuugguuuuguuugaagacuagguuaauuuauguuuuuuccuaucccaggcucgagcuggaaucauuagcacuguagagguucuaaaagucauggaggcuuuugugaaugagcccaauuauacuguauggagcgaccugagcuguaaccuggggauucucucaacucucuugucccacacagacuucuaugaggaaauccaggaguuugugaaagaugucuuuucaccuauaggggagagacugggcugggaccccaaaccuggagaagguaauggauauacuaaauggagaaagaauuacgcagaaguugguacuuuuuuaugugguuaacaauauaauuaauaucaucuuuguaucuacuggauguuacuauauauucagcaagccagaaauuaagacgugagucuuuuaagucugcuggugaaguuacaugggucaacaacauagaaacaguagugguuauguguguucgaugcuaaauauaauuugugcacaugguggaaauaaaagucuuuugcagaauuccaaaggccuauuuuuagucaagaaaagcuaaagggaauuuuagguuguuuuguuuuauuuauuuauuuauuuauuuuauuuuuuugagacggaguuucauucuuguugccuaggcuggagugcaauggcgcgaucucggcucaccgcaaccuccgcuucccagguucaagugauucuccugccuuagccucccgaguagcugggauuacaggcaugugccaccacgccugguuacuuuuauauuuauaauagagaugggguuucaccacguuggucaggcuggucucgaaccccugaucucaggugauccgccugccucggccucccaaguuuuauuuauuauuaccauaaauaccaggcaccuuuauguauaacuuguaaaggugcugagagacacaggggucagcuuuuuuaauuaaggaaauuauuugcuuucuacauguguucucugcucugauuauuucuauaagcauauauuuacucuuuuugcucucauuuaaauauuggggaugauuauuuaaagguuuuacauaucauuauuuuuuaucaucugcuaauaacuaaaggugguguuuccuccugaccagucuugacccagaagucuuuuguaauaaaaauaguagcaauaccuagagcucuaugucuugucuucuuuuuuuuuuuuugagauggaguuucacucuugucacccaggcuggaacgcaguggcgccaucucgguucacugcaaccucugccuccuggguucaagcgauucuccugccucagccucccgaguagcauaccaccacgccugccuaauuuuuguauuuuuaguagagacgagguuucgccauguuggccaggcuggucuugaacucugggccucaagugaucugcccgucucggccgcccaaagugcuguauuacaggcaugagccacuacagcuggucccaaacaaauauuuauguagcuaguaaaugccauauacuauucuaagagcuggugaaacagcagcaacccaaauauugccuuauauggcuuacauucuaaugggagacauagcaaauaauuaaauguauaauggucuagguggcaggaaguaucauuaagaaaaauaaaguugccaggggugguggcucacgccuguaaucccagcacuuugggaggcugaggcggguggaucacaaggucaagaguucaagaccagccuggccaagauggugaaaccccgucucuacuaaaaauacaaaaauuagccaggugugguggcgggugccucucaucuuagcuacucgggaggcugaggcagagaauugcuugaacccagggggcagaggcugcagugagcugagaucaggccacugcacuccagccugggugacagggcgagacuccaucucaaaaaaaaagaaaaagaaagucgucagauaauaaggagugcugggccacuauuuuauagagaguguuuggggaaacugucucuaauaaggugauauugagcauaaacugagacauggagagaguuuugaggcuaccuagaagaaaagugguugagacagaggaaacagcaaguacaaaagaccugagaugggagcaugcuuaggguauucgaggaauaacaagaaagcugcugaguucaggacaagaaugagugggagagggcaaugggagaccuuucugauccuguagaaccuguuugcuacagugagaaguuuuuugacuuucacauuuagugauaugacaugcuaauuagagaguuuugggcaggggaacuugauuugauuuacucggcuuucugaagaacagacuaagagaagacgagaggaggcagggagaccauucagaaggcuauuuuagcaauccaguugagaugcugguugcaacuagaacuuacaggugguaaagucuguguauauuuugaaggugcaacugaaacuauuuggugaaggauggacugugugguggaaagaaagagaagugucaucaaauuuuggccugcagaacuggaagaaugaaguugccauguacagggauagggaagacugcuguagaaacauuuuuuucuuuuaaagauacagagucucgcucuguugccgaggcuggagugcagugaugcagucauagcucacugcagccucgaauuccuggauucaagcuauccucccaccucagccuccugaguauuugggacuacaggcaugcaccauacccagcuauguuuuuuuuuuuuggaaaagaugagacuucacuguguugccuaggcuggucuugaacuccuggacuccagaaauucuccucccucagcaucccaaagugcugggauugcagccaugagccacugugccuggcauagaagcauauuuggguguaaaagggaaucaggccaggcgugguagcucacacccguaaucccagcacuuuggaaggcugagggggguggaacaucugaggucaggaguuuugagacaagccuggccaacauggugaaaccccaucucuacuaaaaauacaaaauuagcugggcaugguggcacacgccuguagucccagcuacucaggaggcugaggcaggaaacucacuugaacugggaggcagagguugcagugagccgagauugcgccauugcgcuccagccugggcaacagagcgggacuccgucucaaaaaaaaaaaaaaaaaaaaagugagggggugggaaucauaucacgcauguggcucacaccuguaauccagcuacucaggaggcugagacaggagaguugguugaguccuggaguucaagcccagcaugggcaacauagugagacucaugucuuuaaaaaacaaaacaaaacuggaugagaucaaccagugacugaguguaaguagaagaaaguggucugaguucaggauuuagagauuguguggaaaaggaagaaacagcaaaagagauggacuggccagugagguagaaggagagccaggagagaggggggguaucccagaauuuaaauaaauaguagaugaaaagaaacaguagaugaaggcagagggaaugugaucagcugugucagaugcuacuacacuaagucaaacagaaugaugaaggcuaauucaauauuacauuuaacaaguuuuguggaguaguggggaacaauaaugaauucuccacuuuuggagcagguucuuuagaauaggaggagaggaaauggagacaacacacuuagacaacuuuuuaaaggaguuuugcugagaagaucagagaaaagggguagaugagagagacgugggguaaaggaaggaauuuuuuaaguugggagauuuuauauuacauuuucugcaacuauuugaacauaugcgguaguaauaugcucaggaggcugagacaggagaaaauucauguuuugugagagagagggcuuauugcuauagugacagcugaauaaucaagaggaguugagguccagugcagaaguuaaggaguugguuuuagauaggagcacagaugaauagugacaggauaggaguacauggacacagaugcagguaaauuaauggauguugcacuuuucuuucaugaugauaacgugacacuuuuugacuucaaaacuaucuuuacaauauagggagaaugccuucaauuuccuagcuauacagaugggagaaugaaacacggcaaaauaauaaaauguuaccuugcaucacacagcguguuaguaccagagccagaauuauaaauuacuucuuguaagaaucaucacaacaauguguaguuaucuauugaucucugaugguuuucuuaaaauuauuuuugguuaaauuaugauuuaaguguagcaaaaugaauaaucuaaauguuacaguuccaugacuuucggcaaacacauaccacauuuccaucacccagaaagcugcuugggcuccuuccuaauuggucccugcuacuugagccucccgugccuaccccacacaggcacaugccauucugauuucuuucaccuagauuaauauuuaucucuucuauuuuauauacauagaaucauacaauguguguucuguucuuauaccuggccucucucacucagcguaguguuucugagauaaucuggguuguucauugcuuuuuauugcugaguaguauuucaucauaugaauauacuacauuuuauuuguccauuguacugcugcaauucaucagauuugugugccauuaacuguuuuuuuaaucaaucauuuauuuccuggauguuaacuuuuuuugagagauaauucacauaccauaaaauucacccuuuuaaaguauacaauucaguauuuguuaguauguucacaagauugugcaacuaucaccucuauauuuccagaagaauuucuucacccuccccacucucagccccaccccacccccccaaaaaaaaagccuuguguccacuggcagucacucuccauuuccuggcaaccacaaauuuacuuucuauuucauggauuuaccuauucugaacauuucauguacauagaaucacaaaauacuuggccuuuuauaucuccuucuuucacuuagcauaguauuuucaagauucaucuauguuguagcauguaucagucuuucauuccuuuuuuuuuuggggggggguaacagagucucacacuguugccagguuggagugcaguggugcgaucucggcucacugcaaccuccgccuccuggguucaagcaauucuccugccucagccuccccaguagcuggggcuacaggugcacgccaccacgcccagcuaauuuuuguauuauuaguagacaugggguuucaccauguuggccaggauggucucgagcuguugaccucgugaucugccugccucagccucccaaagugcugggauuacaggcgugaaccaccacacccagacccccggcucucuuuuauaagggcacuauucccauucaugagggcuccaguuuucggcuauuaugaauucuguuaugcacauuuguauacaaguuuuuguguagacaugcuuucauuuauuuucaagauaccuaagagugaaauugcugagucauaugaugacucuuuuuuuuuuuuuuuuuuuuuuuuuugagauggagucucacucugucuccagguuggagugcagugggcaugaucucagcucacugcaaccuccgccuccuggguucaagugauuccccugccucagccuucugaguagcugggauuacaggucugugccacuacaccuggcuaauuuuuuguauuuuaguagagacaggguuucaccauguuggccaggauggucucgaucuccugaccucaugauccgccugccucagccuccuaaagugcugagauuacaggugugagccaccgcgcccguccuuuuguuuuuuuaagagacagggucggcuggguggcaguggcucacgcuuguaaucccaacacuguggcaggccgaggcagguggaucaccugaggucaggaguucgagaccagccuggccaacauggcaaaacccugucucuacuaaaaaugcaaaaauuagccgggcgugguggcacaaccguguauucccagcuacucagaagacugagguagagaauugcuugaaccugggagguggaggcugcagugagcugagaucaugccacuguacuccagcuugggcaacagagcgagaccacaucucaaaaaaaaaaaaaaaagagacaaggucuugcucugugcccaggcuggaguacaguagugugaucauagcucacuacagcuucaaccuccuugcagccucaagcuccugggcucaagcgauccucccuccccagccuccuguguaacugggccuacagacauaugcuaccaugcuugguuaauuauuaaguuuuuuguagaaacagggucuugcuguguugcucagguuggucuugaacuccugggcucaagcgauccucuugccuuggcaucccaaagugcugggauuauaggcaugagcuacugugccuggccauaacuguauguuuaaccuuuugagggacugccagacugauuuucuaaguggcuucaccauauuguguucccaccagcaguguuugaggguuccaauuuguccacauccuugcuaacacuugcuauuaucuuuuuuauuauagccaucauaguggguaugaauugguaucucauugugguuuugauuugcauuuuccuaaugacuaauguguuaaacaucuuuuuaugugcuuauuggcuauuugugugucuuggaggaauggacccaucagauuuugauuuuuaaaaucuaagauuucaauuuauuauacaaagagcauacuaguuccauaugugaucuuucuuugaaccuugggucaaaacagcaugauguaagccuguccuuuucacacauaauccuuagcagaguaguuaacuagacugaguaaacauuuaguaaacucagauaguuugcauucgugacuguagauaaagucagcaacuuuauuugcuugucuagucuguuuagcauaucacucuuaugauuugauaaauguaaaacgaguauucucucagguauuaaguuaauugaguguguuuguucaagaccauagaauugguauagcacaauuauaagauauccaaauggcaaacuuauaaaaauaggcuuuuuaaguagucuuaugucucuuuuacuucucaaaucaggucaucucgaugcacuccugaggggcuugguucugggaaaacuaggaaaagcaggacauaaggcaacguuagaagaagcccgucgucgguuuaaggaccacguggaaggaaaacagauucucuccgcugaucugaggaguccuguagguuuucaucauaaauucccuugacuuauagguaacaucauuuugugaagcauggaacuuuuuuuuuuuuuuuuuugagacagagucuugcucugucgcccaggcuggagugcaguggcaugaucucggcucacugcagccucugucccccgaguuccagugauucuccugccucagccuccuggcuagcugauauuacaggcgccgccaccacgcccagcuaauuuuuguauuuucaguagagacgagguuucgccauguuggccaggcucgucucgaacuccugaccucagguaauccaccugccuuggccucccaaagcgcugggauuacaggugugagcuaccaugccuguaacuuuuuuuaaaaagccuggaacauuuuuuaauagccaaaacugaccuaagaacugacccacaaaccacgucuaacucuauuuuaauauauacuauuuaagugguuuauaguccucuucuuauuuguuuaaaguuucucagucaguguugcagugcugaaaggugauuagcugugcacauuccccugaaagcugcugugcucugcugguacaacaugccauuuaccuuugugguugcucacaggcacugcuagcuccuuaacuacaguuuguaauauucacauuuauaauauuuacuuuuuuuuuuuuuuuuuuuuuuuucugagacggagucucacucuguuacccaggcuggagugcaguggugugaucucggcucacuguagccuucaccuccuggguucaagcaguucuccgugccucagccuccugaguagcugggauuacaggcaccugcuaccacgcccagcuaauuuuuguauuuuuaguagagacaggguuucaccauguugaccaggcuggccuggaacugcugaccucaggugauccgccugccucggccucccaaagugcagggauuacaggcgugagucaccgcagccggccaacauuuacaauauuguuuacuugcuuucugucuuuucuuaguauuagaauacuugaaacaagguacauuuaaucaaaugacuuauuuuuugucccuuguaggucuaucugacuguuuugaagcauggugauggcacuacuuuagauauuauguuaaaaguaaguauauuugagaaggcucccauuuccugcuuuugaacuuggauagacacacaguaaaccucuaaaugguuaaaaaaaaagacaguccuagaaaagaaagaugcauauuguagacaugcaaguauuuuaaaacugugagagaauuaugucuauccauauauguuauaucaguauuaucaguaugaugccaaagacaucuuacuuuuccccgccuuuuuuacucacuuuuugcaucugaaaucuuauuauuauuuuuuuuuuuuuugagacaaggucucacucugucacccaggcuaaagugacauaaucauggaucacugcagcaucaaccucccaggcucaagugauccuccugcgucagccuuccaaguagcuggaauuauaggagugugauaaccgcauccagcuaauuuuuguguuuuuuguagagagaagguuucaccaugcccaggcuggucucaaauuccuggggucaagugauacacccaccucagccucccaaagugcugggauuacaggcaugagcuacugugcccagcugaaauuuuaacacugaaauaaauguucguuuugauuaacaagucacuuucuuuaaauuuuaucuucaguguaaacuuacuugggguucugcccauuuuaagcaaaacguuuguuucugugcuuagguucugugcuuagguuuguuuuugugcuuagaaaagggauagacagaugaugaucaagugucucaagcauuugagcuauggcaggguccuuuauuaauagacaggaaauuaauucaccugccuucauagccucucuaguuuucccagaguaauuggcauauaauuaagcucugacuuagacaaaauauagauaaaacuuuccauguccucauaauggcagcaguguuugcaacuuugaaucaauaguaguacugugaagcaaaugcuaucuccagucccuauucauacaguuccggucuauaaagaaauggcuugagugcacuggcuacauuagagguggagguagccgaaucuacuuuuuaaucauuaaauaaaaugugcaaaaugugccuaaaaacccauuuguuaaaagauccacgcuuaggacaggaguggaaugugcuuuacugucucuaccuuucauggauuaacaacacucuucugacuuacagggaguucaugauaaucagcuucacuguagaaauagcucuaaugaucauaauugcagaucuaaauucugauauuuugguuuuaaacaaauccucugaaaaaugauuaggaugucugaaaauaaaaacuuuaagaaacuguaccucaaaauguacugcuuuacccauguuguaauagguuuacuuucuuucuuuuuuuuuuuuuuuuuuuuuuugagacggagucucacucugucaccaggcuggaguguaguggcacgaucuuggcucacugcaaccucugccucccggguucacgugauucuccugccucagccucccaaguagcugggacuacaggcacccgccaccacacccagcuaauuuuuguauuuucaguagagacgggguuuuaccauauuggccaggcaggccucgaacuccugaccuugugauccacccgacucggccucccaaagugcugggauuauaggcaugagccaccaugucuggccugcuuucuaagaauauaaaaguuauauuugggagagcugggcacgguggcaugcaccuauauuuccagcuucucaggaggcugaggcaggaggagcgcuugagcccaggaguucaaggcugcagggagcuaugauugugccacugcacuccagccugcgugacagagcaagacccuaucuuaaaaaagacccuaaaaaaaguuaaauuuggguuuacuuuccaccugaacauuaaggucccuucucagucuuaauauucugugaaccuguauacuauaaaugauauguaugaaaugggauauuugauuuuuuuccaucuauuccaugaugauauggaaaaaaauagggguucuguaaauuucauggcagauacauugauauuuucaugucauggcacuuuuaagauuuuccacaaguauguguauuuauucagaguuugcauuuauuuaacacaagagaguucacgauaaucagcuucacuauggaaauagcucuaaugaaggccgaaucaugguucuucaagaagccacuugguaagagaugaggaggguugucuuaugaugguaauuuaggaauaauguggcagaguuaaaaaacauuaauucauaguauauuugaaaugugguguuagagugccaucuaguggacuagaauaacaguucucuauggaggaaaacgcuuccugaaagccagagguucagaccuugaauauuggagcugaaaagggccuuagaaauuaucuguccacccaucucauuuuacacauggggaaacugagacccagagggaugaaggacuuagucaagaucacacagcuaguuagaggcaaaacugggacuagaacccagaucucccaagguccugucuauuuuacugcacugcugcuuagaguccaaaggggccaggcguggugguucaugccuguaaucccagcacuuuggaugggaggaucacuugaggccaggaguucaagaccagccugggcaacauggagaaacuccggcucuacuaaaaauagaaaaauuaggccaggcgcgguggcucacgccugcaaucccagcacuuugggaggccgaggcggguguggaucacaaggucaggaguucaagaccagccuggcccaaauggugaaacccugucucuacuaaauauacaaaaauucgccgggugugguggcgggcgccuguagucccagcuacucaggaggcugaggcaggagcauugcuugaaccugggagguggagguuguggugagccgauauugugccauugcacuccagccugggugacagaguaagacuccgucucaaaaaaaaaaaaagaaaagaaaaauuagcuaggcgugguuguagugagcugagguaacaccauugcacuccagcaugggcaacagagcgagacuccaucucaaaaaaaaaaaaaaaagagaccagccuggucaacacagcgagaccccaucucuacuucuuauaaauuaaaauuguuuauugaaaaaaaaaaaagugucgaaaggaagaggaaacugagagcuuugaugaggucuccagacacucuggucaguguuaaaucuuaagggguagaaaagaucaaaagagucuaaauugucuuggagacauagcucuuauacauuuauaguucuaauuuuuaagaauuacaacauuuuguuucuaugaaaagauuuuauauacauauauacuauggaagauuuagagacuagaaaaguauaaagaggaaaauaaaacuuaccuauaguuuagaaagcagguagcaaaaacagcauguauaacaugcucucuuuccagauuuguuaauguacauauaguaguaauuuuauuuuuuucuuuaugcuucucugucuuucagauauucugcauucaguaugugcugcuuuugcaguuaaaaagugugaagaugcauaaucccacugaucagaaaccaucauuaauuaauacuaccauuuugauguauuuccagggguucucccccacccccuuuuuuuggaaacacagucuugcucuguuguccagacuggagugcagugguacgauaugggcucacugcaaccuccaccucagccuuccaaagugcuaggauuacaggcgugaaccacugugcccagccauauauauauauauauuuuuuaggauaauucugcuuugucugcuuucuucacuuaaauauaagaacauguuuaugauauauucuuaaaauauaacuuucaauaaugcauuuuuauaaguacaguauucauuuucaauuuuucacuauuauaaauuaauuugaugaucugguauaagaacacuaaugauuaguuuguucuucuaaaacagaacauuagccagauaucaaugauguaaagaauuuggcuaugauagauuuuaccucuuagaucuugauguuaaacuggucugaacuaaugacaggcuguucaucugguagcauuuacaucuagugauuuacuuacuguaacagcagaugacaaauuuagugccaaagcaucauuuuuuuuuucuuuuauuuuugagacagagucucgcucucuugcccaaacuggagugcaguggcacgaucucagcucacugcaaccucccagguucaagcgauucucccgccucggccucccaaguagcugggauuacaggugggcaccaccacgcccggcuaauuuuuuuuuuuuguauuuuuaguagaaacaggguuucaccauguuggccaggcugaucucgaacucuugaccucaggugauccacccgccucggccucccaaagugcugggauuacaggugugaaccaccgcaccuggcccaaagcaucuugaaaaguauucucuuucuuuaauauaaugcccugccauucuuaccuagugagaauauagaaccuaaguuuuaccuuacuggggaagaagcucauauaaucauaugcagaacauccaagggagaguuaacuauuccuaucuuuaucuuuuuuccuguagcuucauaaacaagcagauaugcaagaagagaaaaaccgaaucgaaagaguccuuggcgcuacucuuuugccugaccugauucaaaaaguccucacguuugcacuuucaguaaguuacggugaaaacugcauuuagaagugaaucguuacccaucucugagaagugucucugauucagcucugauccucuugagcugccuuaacccuaacuaaagcuuccuuuuccagaguaacuggcuugaguuuuuguuacugacuucuguuuuucucccacuaguggcgagaaucagaauaguugggagaguaaacaaauugucucuccagaauggaaacuaugaggacagggacucuugaaaacugggaaacuggcuuaugccuuugcuuacuuugugucucuuccuuucuuaaaccuauaggcuccuaagcaaguaucuguugagcagucugucugucugaaccugucucaguaccucauucucauuuugguuaucuuuagcuuaaacauuaucuucuuugcugagaacuucugguuccaguuauuccuaaaacaaggaauaagugucuucagugugauuacuucagugucacaguauggugcacuuucugguaccagaauauguuuuugauacacuagacuuuuagcucucuuucuuuuuuuaggaagagguacguccacaggacacuguaucgguaauugguggaguagcuggaggcagcaagcaugguaggaaagcugcuuggaaauucauaaaggacaacugggaagaacuuuauaaccgauaccagggaggauucuuaauauccagacuaauaaagguaugugaaaaacuuugaguagcuugcuaaucauggauauuauuuagugacauccaugauucacuacacccauacauuguggucuuugcucuuuaaauguuuccuguggccaggugcaguggcucacgccuguaauaccagcacuuugggacgccgaggugggcagaucaccugaggucgggaguucgagacuauccuggccaacauggugaaauccugucccuacuaaaaauacaaaaauuagcugagcgugguggugugugccuguaaucccagcuacuugggaggcugaggcaggagaaucgcuugaaccugggaggcagagguuguggugagccgagaugaggucauugcacuccagccugggcaacaagugugaaacuccgucucaaaaaaaaaaaaguuuccuuaaauaguuacuggcuuuauuuaaggacuucuccaucucccaucacacauccuuuauaacagacugaaguuggcagagaacagaaugauuuauuuuuaggguaaauggaaguuuguucucagccucuugguuucacuuacuguuuaaaaccauuguuuugcagcuaucaguugagggauuugcaguugauaaaauggcuggagagguuaagguaaggaaaauacuguuuacucuucacuuuucagucuaguaaguaaaaacaauaaccugguuguaauuauaguguugggauaauguacuguagcaucucuguguuuuuguuuagagaaagacaucaugcagggcuguauaggccauauuaagaauuuccuaaaaauggccaggcaugguagcucacaucuguaaucucagcacuuugggaggccgagguggguggaucaccugaggucaggacuucaagaccagcccgggcaacauggugaaaccccaaauuagcuggacaugguggugcacgccucuaaucccagcuacucgggaggcugaggcaggagaauugcuugagcccgggagguggagguugcagugagcugagaucgugccauugcacuccagccugggugacagagcgagacuccugucucaaaaaaaaaaaaaaaaaaaaaaguccuaaaaauggaaagccuucgaaugguuuauaaacaaggcagugccuugaucugauuuguguuauaaaaauuucagucuggcugcaauguggauaauaguuuggaauggggaagagaagauguugggaagcuaacucuccuagcaagaaugauagaauagcuuacaguaggguaguggcaguaguggaggagauggaauaauggagauucaggggcuugaauuuguuaaccauuuaguucaacaauauuuauugauuggcuucucuguugugagcauaucugggagaggaagaaaaacaagccaggauaauccccagguuucugguguauaaauguugguacuacucugcgauggaauggaaaaagacuugaggcccugagaacugaaccaugauuaggagccuuggaacaguagcaauugucaucuguguaaauaagguuauugauuucuaaaaggucuauguuuaaucagauggauuagucauucugucuuucacaccuguggugacuaauucaaaggaaaagcccuaucauuuugccagcugguguuuaagaguugcuuuguuuucugugaaaccagguguacugcauuagaaaaguuuauucaacuuuuaaucauuaagcauugugauaaauuguaaacuuagaaauuguuugguuuacuguauuaaaaauguuggauuccuguaauuccagcauuuugggaggcugaggugggaggauugcuugaguucaagaguucaagaccagucugggcaacaugguaggaccccaucucuacaaaaaggaaaaaacaauuuggccugggagugcacgcuuguggucccagcuacccaggaaguuaaggugggagguuuacuugagcccagaagguugaggcugugaugagccaugaucguuucauugcacucuagccugggcaacagagugagacccugucucaaaaaaaaaaaaaaaaaaaagaccaugggguguuaaauuauuagggcauagcagcaauuuaaacuucuuuguauuaucaucccuuacaaauuaaucuuuauuugaagcagccaaaauguguugaauccuuaaguacucugugcuagguauuuugucaaauguuuauauggauugucucuuuaaucuucuggaguagauauuuucucauaguugagaaaacugagacuuagagcaguuaauuuucucacagucacaagcuaguacaugacuaagccuggauucagguuccaagucuucauuccaaagacuauauuuaccacuacacaauuagccuaaaagaaaggcaguagguucugucucuuuauuaacuuuugauuagguuguuaagcauauaauuaaggggagaauuccuauaugcagguccaaggaguugcuuguuuucuuuuagccugaggguggcagugguaaauucucaugccugaagauuaugcauccuucauauagaccaguggguauuuuuucauaaccuguaauauuaacuucuuauugcuaguaaugauccugcauucuggguuguuuuauaccaggcuuucuucgagagucacccagcuccuucagcugagcguaccauccagcaguguugugaaaauauucugcugaaugcugccuggcuaaagcgagaugcugagagcauccaccaguaccuccuucagcggaaggccucaccacccacagugugaauccugaggugccgccauuggcgguucugcugcuucgcugcagggauaagguggagcuaccgaacagcugauucauaugccaagaauuuggagucuucuuucaaaccaguggggguuggacaaugaauguaguuaacugguuccugcucacacuccagaauuaaauucuauugaaaaaggaaaaucagcaauucagcaaaaaauaaauaaaaaauaaaaauguaaauaugauaguaauaaaauagagcauaacgaaacugugaaacuuucugaagccuugucagugguuaaaaguauuuaacacucuacuguuaaugacagauguucuguuuuuauaaccuaccaaaaggaaacuagaggcuucuuggugaagagcauuuuugugaaguggguucugcaaggagccuauaaagccaagggugguguccauuucugggaaugguuaaacacaaaaggcugauagcugguaucacauaguuggagucagugcauaauuccaaguggcuuuuuuuuuuuuuggcacggggacugaucaggaagauauauuccugcauaacucaaucugaaccaaggauuguaguuuaguuuuccuccuugccuucccuucugugugaccgaccccuuggccaaaaaaaaacaaaaagcaaaaaacaaaaaccuacccuguucugguuuuuuuccucccuuuaguuccacccccaacccccauucccugguguccuucuuagagaugaagaaauaauaaggaaacaucuuucauagccacauuaaauaagagaaacugauauacauuauuuuuuucuuuuuaaagaugacuuauaagaacccugaaauuuauauaggugagacaauagaaauaaaaagaucuucagccaggccuuucugaaggaguuauucugcuaaaaauggucuuaguugucugaaaagccagcucuugaaccucuucacaacaguaucaacacuggcuucucccgguucauuuuaugcgugcgagaagucagugguaacugcugcagggcuuaauacauuagugguaacugguuuaaaaaacaaagacuguaagccugugugugccacuguuugcuucaacaguauauccuaauaagccucaccuauuuaauccaaugaguuuuaaaucuaaaucucauucccuucuucuuucccuaccuuuuuuuucuuuuuuucuuaaaaaaauauuuuguguuauuaacagaaauucauauuugguguggcuuaacgguauuucagaaggucaucagauugugagacugcuuccuugaaacauuuuugugcuauuguuuuaaaaaaauaauuaaaaaacaguuggcguuaauaaaaaugucaaugugaaacuga

SEQ ID NO: 192302 - RNA, 83909 nt, Homo sapiens
cugccacccgaugaauggagucgccuucugccuggucgggaucccgccccgcccggagccccggcccccacaggugagggugcugggccagggaagugggcggggccgguagcugcuggggagcgggcugccaagccagggucgcugcgaccccgcucgcccugcacagccuggggcgcacggugggcgcgggcaccgcgggcaccgcugcggggagauucagcugguggcaggcccgggagggggcccgagcaagagcuguccgggguagaggggugggaaggacggaagcaggcaaggggucgggacgggcacggggcugucaggacagggggcacagacccagguggcggugccaggcccccagcggcugggcagcgggggcgggaggcccgcggcuuuuguucggguuuuucaggcggggcgccugccgccguuuccucugcccgaguuuucguuuuccguuggcgaggccccggcacagcuggagggagagggggugggggaggggguuccggagcgggacguccuccacuaaggcguccggacacccccuccccgcgccacacucgcccccugccgggucggacugcgggacggguugccaggcgcgguuccgccgcccuccuggauccuggggaaguucuagacacaggcccaggaccccgggcucugccggcgaggcugcccuccccucugcccucuccgaccggcugugggugggucagagcgcggggugccaggggcauuacucagcgcugggcugcucugccuggguucuuucaucugccagcugcugaggcuggggaggggccagcaggggccucccagccccauccccccaucagggccauucccuuaccucugagccuggcugcccgcccugcaggagccccccagcaggccucccugcuccuaaguugaaggguugaacacugucaggccaacaguuucccugagcucggaaaagaaauuccccgggguccagguugaggucaaggccagggcugaggccuguuccucuuuagacagggcugaaagacuuggggacccuccuccccagcuuucccggcaguguugaaggugggaucuggugcuugcaacucuuuuggagacugguguguuccuugguugcuggauguguguucaguucucccucaaucugcaucucuccccgacucccuucagccaaaguguguuuccuaauuaugaacuugaaauucaggauggacgggggguggggguggaggucaugaauccaagcaugagucccuuggauucaaucccccaccagcaacacauacuucaucucuauccccugcaccccucucugucuccaccccaacccugcggccuagcugggggugaguggcuuuugaucccaugugguucuccccucugccagggcaacagaccccauuccccaaagugacagcucucacugccaugugcuccuuggcaugcgauuugaaucucgauuauauaaccagucauuucgccuccaaaggcagcccaaaggcccccggccccagcggcuucuuccacuugcccacagugugguuggguccaccccaagguggcugggaauuccaagauccugcaucugaggaccugaccucuucuugggaaccaugggagcaguaaauccucuacauucagugcuggauucaaaggccucaauaauaauaaacaggaagaaugggagugggcaggguagguguuggugucccauuucacagagagggucugagccuauguagugacagugcccaggcaagaacccaggacacuugaggguagucagggcacaagaugaagcuuggggaggaaagcuguuaggaaggugucugacuacgggaauaggucaggcuuguguggaucccagcccaagcagagaaggacuggguggggggaagaggcccugugcuugugccccucuccucgggcugacccuggcucacggggaagaagugcagcauucuuggcauggaugggagugggggugagggagggugcugguucugagcagagcagugcaggaguggguaguggauugcuucauccuacauugcagggauacucagaaggacuucuugauguguaagguuaaaagagagacuacaaagcagcagcguggaagaaguuacagugugagggacugcaguuagauacucaggagaacuucuagggaggggcuugugacccacagcaucccaggcuagccaugcagggaaguuuccuccaguauagugggucaaguggauucuugugaaguuggauuccaauguagaaaccuggagauggucauuggagauaucaaauauuccagcaaauauauucaaaugagcacuggugccuggaaacaaaaaauguguuuuuaaggaaggggaguugcuuucacaguauagcucauaguuaauacacagacagcaaaaacuccuggccaguauuuauaaaaacuaccucauuugauccucacaauaccacuaagagguagauaccauuauuauccccauuuuacaguugaggacacugaggcauagccaauauugcagcccaaaucacacccccagugcacuguggagccaggguaggaauguggcagucuggcucuagagucuggcucucacccucacuaucuggcuucucaggaccugcuaugucccgcugucacucccaccccaaauccguguccauuuucuacacagcccaagaucaaggucagcuucuggcuggauugcagcuuaguugcuugucuuuuguucuauuucuuuacuccuccaaucuuucccacccugccccaugcuagcccauagcacugggccagggcucgguucacugguguuuuccuuccaaaggggcaugaagcccugcucuguuggcugcagggguucaaagguaagauauuggcuuggucagggauuuggacaaagccugguuuuaaugauccugcucucaccaucucgggagagagacaugaauagggccugugggagcuggugcugccuuuccccuagcacccuccacccgcuucaaacaacccgccuucagauccaggccccccuguuucuugugaaauugugccaguuugucagcagggcaguaccaaucugugccaggugggugucuccucccccauugccucagugggacaucaggcugagauggccuuggggcuggacuuuggggagauuuuaaagcccuuuuggguugggguguauuuaccaccugucagagugggugaggaccaaaggggugaucguguccaacucuguuacgcuacaguggggaaacagacuggggagugcccaaggucccucagccucggcagacaaggacccaucuucugacucccagcucccaggccaugccuuucccucugugguugguucuguccuucguggccccccucagugcaggguucauggacugggcuccaagagggagaggggagggcagggagcugcagggaugaguggacaauguauccuguucaucucuguguccccaguggccagcacagagccuggcacagagcaguucuccauaaauguuugugaaguacaaaccagggaacagccccgccuguggccccccagggcgccccaugcccagcucuaccccugacacugugauguuccaucucauauccgucuacccuaccagguaggaguuauuugaggccgagaaaaaugauaauagcaacuucuuccauagugcuuaccacuauguugguauauuaccaucaccccacuugacagauuaagaaacugacacaggccggguacaguggcucacaccuguaaucccagcacuuugggaggccaagguaggaggaucacuuggacucaggaguuugagaccagccugggugacacaaggagacccaauaccuacagaaaaauuuuaaaaauuagcuggggccaggagcaguggcugacaccuguaaucccagcacuuugggaggccaaggcggguggaucaccugaggucaggaguuugagaccagccuggccaacauggugaaacacugucccuacuaaaauuacaaaauuagcugggugaagugacacacaccuguagucccagcuacuugggagccugaggcaggagaaucgcuugaaccugggagagggagauugcaaugagccaagaucacgccauugcauucuagucugagugacaagagcaaaauguagucuuaaaaaaaaaaaaaauuagcugggcauguagucccagcuacucgggugguggaagugggaaaaucacuugagcugggggguucgagucugcagugagcugugauugcaccacugcacuccagccugggcaacauaaugagacccugucucaaaaaaccaaaccaaacgaaacaaaaaagcucugccugccuucagccugcugagguccaaauuuuagauguacuccuuguucacugugugcccuuggacaaguuacuucauuguuuuagccucggcuuucuuuuauucuuuugaggcagggucuuguucuguugcucaggcugaagugcaguggugugagcuugguacacugcagccuugaacuccugggaucaagugagccucccuccucagccuccugaguaguugagacuacaggugcaugccaccaugcccagcuaauuuuuccauuuuguauuuuuuauagagacaggguuuugccauguugcccaggcuggucucaaaauuccuggacucaagugauccucccacuuuggccucccaaagugcggggauuacaggugugagccaccacaccuggcugguuuucuuaucccugaaauaaucccucaaaauuacagagagggcuaaaugagguaguauugguaaaguggcugagauuuaguaaucucaauuauugguagcaacuauuauuaaaaaaaaucaauggauagaaaugagaacaaugcacuuuugccucaguaaaaaguacugaccuuuauggucagagcaaucuaaagagaaagugaccugccucuggagguaaugaggcccccaucacuggaggugcagugaggucugggcaagcacaggcuggagaaugaugugcacuagagagaauucagcaaaggcuuggcacaggaaacuuuaagggcccugccuugggaucagcacuauaugauaggaaauuagaggagcaggugaauccuacuuccuacuguggggcauugaggagagcaggcagagauguccccagccucugggaacaucagggguuggcugcuaugguuuggacugugaggcuccccagaggauagguaguccugagaggcugccuggaggaggccugcaaggguggguaugguucugauaggugggaaaaugugggauuguauucuaggcccaggaagggcuugguggccgagggacagagaggagccugggccacugguccugagguuggccccgggguugcgucaucauccucgugccucagucuccugggcugcugggauuacaggugugccacuacaccuggcuaauuuuuuuuauuuuuuuagagacaagguuucggcauguuggcuggcauguuggccaggcuggucucgaacuccugaccucaggugauccacuugccuuggccucccgaagugcugggauuacaagcgugagccaccgcgccuggcuggauuuugucaucauccugggugcccaagggguuuggguguauggugguggcaguggggaaacuaguaauucccugucccgccaaccccccagcuucuccuggaggaggagccagggcuacucccgguggcaaggagcccgggcccguaaggagcggaacuggggaaagaaagacuucuuaugcccagugcauuugggggcguccgggggucggggaacaguggggccuuuguccccaaccgcugggaaucuggccgaggagcuggcccugggucuggcuaggcccucggaaggcagguccucuuugaagugacccuuucaaagcucggccugaaucccugggaggagagacagcauggggcggggcguggggaugacugagacccaagggccgaggccugagggauagaaacagacccggccuuggccucuugggguguggagguuggucggaggugugugggccggaggaauguggugggcugggagaccgcgugggagccaugugggaggacaaccacgcaaggggccuuagccccaagugggggugcaccuaggcaggggccgaguucauucuggcccgagaguguuucugucuccuaucugacuucugucuggcucugugcuccuguaucaacagcugcuucuuccuuuuuaauuuccccaaaagugugagagcuuggaaagaaucggguguggacgccagacucagagcucuugggaggagggagagguggggaccugggcaauccagagcuuuuccugcuucugagagcccccgaaggcuggaaggagaggcuggaggggacacccccaccucccgcauagagucucccuuaugcucaagguggaggaacucuguauuguuccugaaaagggacagaaggaggaggaaagcuacccagagaggggacaucuuccuuugcuucagcuggaggaauaucagaggccacccuccuucccugucucuccauuugccucauggggaaacugaggccuagagaagggacaggccaaggggauagagcagagaggaagggaccagcaagaguggaaggaagccagcccugugugguuggaacuguagggacuaugguggcucacaccuguagucucagcuacucgggaggcugagacaggaggauugcuugagaggauggaugccaagugggaggaggaaggggccucagguuguugaguugucauaagaggguuguagagaagugcccagagucccuucagcucugaccugcggugauuccaugaaaagagggagaggaaggagugguuccugcuggugaguucccaagguccaaguagaaaggggcaccccaggcuuuuggacugagcaaugcacaggggagccuuuggcagcccaagggagaaccuugcccccgaaucugaugcuguuuguacuucuugcccuggaacccgaucucuccuuggccucacggcagucucuguacuggggaaaauuuuuuguuguuguuguuuucgagacagagucucgcuuugucacccaggcuggggugcaauggcgcgaucucggcucacugcaaccucucccggguucaagagauucuccugccucugccucccgaguaguugggauuacaggcgcccucuaccaugcccggcuaauuuuuuuguauuuuuaguagagaugggcguucaccauguuggucaggcuggucucaaacuccugaccucaggugauccgcccgccucagccuuccaaaguguugggauuacaggcgugagccaccgugccuggccugggaagauucuuauaaaucucccuuuccucuucuggagguguggcccugggcuccuccccaagagagguggaggagggggcggaggccccaggcugcaauggaggcugucugcgcacuguuaucuugcacuggcaucacagagcugagcuucauuagcucuaaugaagccuuggcacugugccccucccacacagcaccuagacguuucaaggaaggcgagggggacagcugagguuggguccagagcccaggagauggucggggggauguuugcaagaggagaggguaggaggcagaaaauggggaccacacaaccaggcugggguugccaacaugagggagaaacagccccucuuccuuccccacugggagcuuuuucuucuccaguggcccagaggccuagguacccccagugcuagggaaagccuuaucugagagacgggauguggucuggggaugcugaggauauuccccucagcuaccccuacccccccaaaaaaaacgcugaggagagugccccuccugcccucuccguaauuucagccgggggcaggagaaggcccugaucccagcaugggaggcccagggcuugggaaaguccgccagugggcuggagccgaaucgaacccacugucaguggugaucacugguugcucaugcucugcguuccaggcucucucuugggaccuggaugaaugagaaacaacccugcucucaagggccuccuugucugcuuuuccuaccgcccaaaagccagacaaaaagucuccacaaagacuguagaaccaugaguucuaagauuugcauccagcccaucgaucaguccagaacaccccucaggggcccccugccaaaaauauuaauguaaaaacggcccagucugacuggggugauggaccugcagccuacacaagccaaugucuucaccaugguaaucguuggaaagugaguguggucacaaaggcgauaacgggaguuuaaaacuggaagccggaagcuggguagaauugccacagggauugguuaaaaaccaguuggugauaugauuaaucuccuuucucucaucuguuuccaaaucuaucauuaaccugaggauucuauagugaaauccuuuuugaucgauuuucaagugccgucauaaaggggguguauaauuacagaugcaacgacugagaccuggagugggcaaauaacuucacucaaggucaccaagcaucaaauuucaagcugggccaggcaugguggcucacaucuguaaucccagagacuugggaagcuucgacaggaggauugcuugacgccaggauuuuuuuuuuuuuuugagagaggguuuugcucugucacccaggcuggagugcaguggcacaaucaggcacacaccaccaugcuuggcuaauuuuuuuguagcgaugggggucucccuauauugccuaggcuggucuugaacuccugagcucaagugauccuccugccuuggucucccaaaguauugggauuacaggcaugaaccaaagaucaauuugagaccaacaugggcaacauagcaagacccugucucuaaaaaauuagccaggugugguggugcacaccuguagucccagcuacucgggaggcugagcugggaauauugcuuggacucaggaguuugaggcuacagugagcuaugauugcacugcugcacuccagccuggacaacagagcaagacccuacccaccccuaccccccccaaaaaauauuaaagcugggucuuucagaauccuaggucugucauuguggugacugcuguauucucugacaacaaggagccugggaggacaccccucacccagggaaguuagacccucuuuuccacagcugagcccugaaauccaagcaaagguuggcauaacgaaggggggggagggcagauguaauggguggugggugcagagagauguagauuaaguucugcuucucugugucuucugugauucaguguggagucuggauuugcucgugaguggcgugggggaccccaggguucugucaauaaacauggcugagccccugccuccuccaaagaugguccagcucucaggggaagaaggcuucacuguggggagaugaggcuugccaaagcuugaaagauguuugcuagggccaggcacgguggcucacgccugucaucccagcacuuuugggggccaaggugggcaaaucacgagggcaagagaucgagaccguccuggccaacauggugaaaccccaucucuacuaaaaauacaaaaauuagcugggcgugguggcaugcgccuuuagucccagcuacuuggggggcugaggcaggagaaucacuugaaccugggagguggaaguugcagcgagccaagaucaugccacugcacacuccagccuggugacagagugagacuccgucucaaaaaaaaaaaaaaaaaaaaaagauguuuguuggggcaagaaagggauggaggagaagggagagaagggugugccaggcagagggaccaagcauuagcacaggcaaggaggcaugaaccagcuuggccucuuaagggauugaugaauacaaggcccagaauagagggaggaggucagguuggcaaggccaaugagaccagaucccgccccuucccucccccaucaggucguaucccucaugccauacugaggaacuugcucccauagcuacuuuggagccacacaagggucucgggcaguggaggcagcagaccaggugaaaggagaugggagcugaaacuggagguacaguuggaaggguaggauaagaguggaguauguuggcugggcgugguggcucacaccuguaaucccagcacuuugggaggcugaggugggcggaucaucugaggucgggaguuugagaccagccugaccaacauggagaaaccccgucucuacuaaaaauacaaaauuagcugggagugguggcacauaccuguaaucccagcuacucaggaaggcugaggcaggagaaucgcuugaaccugggaggcagagguuguggugagccuagauugcaccuuugcacuccagccugggcaaauagagcgaaacuccaucucaaaauaaauaaauagauacauacauacauaaaaauacaaaaauuagcuggguguaguggcgggcaccuguaaaucccagcuacuugggaggcugaggcaggagaaucacuugaacccgggagguggagguugcagugagccgagaucgcaccauagcacuccagccugggugacaagagugagacucugucuaaaaaaaaaaaaaagagugggaguaugucacccucuuccccuuuccagaaacuugcuguaccgucucuuucccuugucuagaagggccuucucugccuuuuccauuucuccaacuccuauuccucuuucaaugcccaguucaaauaucuuccguaaagccucccuccaccacucaaauauauggcgacuuccuccucugugcgcuagaccuugugccccgugaggguagggacuuugucuuguucacugcucuauauccagcuucuaggccaggcccuguugagugaacgcugcugacugaugaauugaguguucccauagcacuugacacugcauugcccaccaauaauaauaacaaugggaguauugguuauagcaaacuuguauugcgggccucagggccagacacugcugugcugagcacuuuacacacaccgucucuuuaaucugcacaacaaucccaugggcgauggauuaucucuauuuaauaacuguggaaacagaagcuuagggagguuaguaauuuguccagugacauacagcuaggaagugggccugagucaggauucaauccagcuuccucugaauccugcuuaggaacuuuuuuuuuuuuuuugagaccaagucuugcucugucacccaggcuggagugcgguggcgcgaucuuggcucacuucaaccuccaacucacagguucaagcgauucuccugcccggcuaauuuuuguauuuuuaguagagauggggucucaucguguugaccaggcuggucuaacuccugaccuuaggugaucggccugccucggccuccuagagugcugggauuacaggcuugagcuaccgagcccagucggaacuuuuuuuuuuagacagucuugcucugucacccaggcuggagugcaauggcgugaucucugcucacugcaaccuccuccuggguucaagcgauucuccugccucagccucccgaguagcuggaacuauaggcacgcaccacugcaucuggcuaauuuuuguauuuuugguagagacaagguuucaccauguuggccaagcuggugucuaacuccuggcuucaagugauccuccgaacucggccucccaaagugcugggauuacaggcaugaggcacuaugcccaggcucugcuuaggaacuuuuaaacacuaugcccuacagcaccuuuauuuguugcaugucuaugucuuugguuuuauaaaaccagggacugcuuuuguuaguuuuugaaaauccucagacuacgggacugauuuguugagcaacuucuacaugccaggcacucaaugcugaguccucuccaggacccaguuuacagcugaggagacugaggcuuggagagggaaaggacuugaccaaggucaugcaguugggaccugaaaccuggccucugacucgucuucccuugugucacuggccccccuagcccggugccaggcccuugguggcacccagugaacaguccuagaaugaaagaaagaggaaccggcucugaaggugacugcuuucuuugggggcacacaaguggccggacaggggccguggacugggccuccagccucuaagcccagugugugucccaccgggaucacugaugaggagagggaucuagaggccgggacuggggaugucguaauuuccaggugcccagcugucugucagaccugugagcuccaaggagaggcugaccuggugcugggguggucagagaugguguccagggcaggcagagccuuaccacgaccuuuagaggccuccagaggcugcacagcgucagugggauuuuggccacgggugaccagaaggaaccuccaagccugggaaaugcagcugcaguggccacagcgcaggugggcagaggcccuggguugugcugcagguugggcacugccuuuugcugagugaccauucggccuaugcucccagccccacagggauccaccaaucagaccugccugcugcuguguauuugcaucucacuugcaugacaacaccccuugcucuguccccaagugugcuuccccagcccaugccccauuccccauuucaggcccccugugcagagcucccgugggaggggcagaaaggcccaccugggcugccagccuggcgcacuauucauagcucagggcuggcguacuucacauacuuggcguuucucaugucuggcuggcccaaggcagccaccccucuguuguccuccccucccuccucucuucucucuuucccccuuccccuccucccuuaaccucuucccccaccuucuuccucucaaccaaucuuccugaaaucuacagauguccaagucccucaucauggaagagcccacauaaggaaacugaggccccagagagggcggggacuggagggagaaaccaguagugaugaggcguauaaugagguggccgagagucugggcucugcccacagcuucaauccugagcugacauuagcuguggcaccauggcagauuccuuagcuugcuaaguuaaacaagcguuucagaaagucaagcugagaccuggaggguaaggguugagucaagggaagaaggggacggggagggggcaggcaggcacuguauuauaguccagggagaggggaacuuggauguggggagcaggcucugagucucaggacaagggcuuggcacguugcagaacccacgaggagggcucguggcuggaguguggccagcuggggugagggcacagagaugcaaagaggauugaagcagcuccccccuuuuuccccaccccuuucucccccacuccuuuuuuuugagccuggaucuggcucugucgcccaggcuggaguacaguggcacaaccauggcucacugcagccuugaacucuuggcucaagcaauccucccaccucagccucccaaguagcugggacuacaggcgugccccacggcaccuggcuaauuuuuacuauuauuuuuguggagauggggucuuacuauguugaccaggcuggucucaaacuccugggcucaagggauccuccugccucugucuccccaaguucugugauuacaggcaugagccaccacgcccggccccccuuucuuccuuauuccagcacccccgacuucuggaucugguucccucugaggaagggguggggauauaaaaagccccugccucugccagaccccuccuggggacaggguucugguuaccucuaacucucugaggaaaggcucauucauucuccaacauuuagaaacagugugcagagcacccacccugggccaggaaccagggauuugaccaccagcaaagcagacaugguccuugccuuccaggaccuacagcccuguggggagauguuggucaaaauaagcucauaaauaaguagacacugacaagagggugcacagguaacugaccuggucuggggccagaggaggugugccuggggaagugacauuuuuguuaagagcaacaggguggguaggagugaaucagggcauggguugcauuccagaaacagcaugugcaaaggacccgaggcuggaagggugccugguccucacaggagguggaaggaggccaggguggccagagcacagaggaagaggguguggugagugugggggccaaggcgcgucccacagggccugguggucauaauauuaaaauaaucaaucuggacugucagaugccagagaggugacugccgcuuggagcagggcaaugguguaaugaagugagcagacuccagagacaucuaggaagcagagucuacuccgauggggggauggagcgcuggggccauaauaccugauucuugguucucagcaacuuuuucaggcugcuaucucugucuuuauuuuauagcugaagaaauaaggaaacuugagugaccuugagugaugaucuugaggucacacagccagaaaagggccagggccaguaccaauggcaaguguggccuuuucucuguguuagccuucuugaugccaggacaguggucacuuucucaccauccucccuguccccaagccucggugccccugcaggucacccagcauucccugccuagcacccaacccgguggagagccaggaguugcagguggugggugcugggugcuaccuucauuuccagagguugguuaaaugaguuagcgcaucuaacagcagcugccuggggcauaguaagcacucagcaaguauucuugacuguguggcuguuauccuguccccaaauguggggccaggcaaacuggcagggggaggcgggaggaggaucuggagugaggaugaugccaucugucuucuucugaccagagagcccagcccagggggcucccucaugguagugacccaggggaggcuguuugucccugcagagccacugucccugccaccuguccagcugccucugggcaucacagacuggauuagggagugguucaguucauaggcagggccacaugugugaaggggaaggcagggguaaccgggagggaugggcagggcuggggugagggggugggugguuucagggguggggcugacagccucucccugaagggagccccaugugcccccgggagacuuucggaaucugcugagaccugcccugggaggggacauggucuuagcuugacugggacccagcucuugccugaaggaaaccagugugugcaccuguuaccucugcccaggcugucagacaacaggaagcacuccuggggggcggggggcaggcggagucacaccuagagcuuuccccuagucuccucugaaaugcacuguccagcgugagaccaggggauggaucugcugaccuuagagaagagucauugcaggcauuccccugccucuaggaaugacugcuccagucuagucugaaaaggggcucuggccucucuccuugaccaaagggagaccccgagauuccacaguugcucuguccuucugcaggagauucuucuccuuuguaggagauggggaggggaagaucccagggcagguuggagcugaggggccuggggagcgagguugagggaaugaggacccuucugcucgcucuggguugucaaggagacgaggcaugccagcgcugggccagcagggggcucugcuggccacgggaccugccugccaggcagccgagaugugcacccuucauugugcgggcucauuuccaggagugccugagaggacgcggcggugucucugugggcacacccuuguguguauguuacaggugggugugagcguguggcgcguuggaaugggcaugugugugcuugguggguuugagggcccccacacugagccagguuucugccaagaaaacucuuccaaguuccugccggcagccuuggaagaguuugugcaugacuggggauggcagccucuguggauggcaggcccccaucaacgccaaggaccugaugcgugccagguucaggcugggcgaucccccugugcggggaccucuagggcuccaaagaugacaguagagacucugaggaggugcaguggagaagggacggcagggaaaggucuuccaggcaggaggugcccagcuccugggcaaccucugugggcagagacuucuccugggcaccaaggagagaccuguucauuuguuucaucuuucaacauuuuuuuuuuuuuugagacagaguuuugcucuugccguccaggcuggagugcaauggcgugaucucggcucacugcaaccuccaccuccuggguucaagcaauucuccuaccucagccuccagaguagcugggauuacaggcaccugacaucacgcccagcuaauuuuuguauuuuuaguagagaugggguuucaccauguuggcaaggcuggucucaaacuccugaccucaggugauccaacugccucggccuuccaaagugcugggauuacaggccugagccaccgugccuggccuuuuauuuuguguguguguuugauuucugacuuggccuuuuuaaaaaaaucacaaaauauauaauacggccgggugcuguggcucacgccuguaaucccagcacuuugggaagccgaggugggcagaucacgagaucaggagaucgagaccauccuggcuaacacagugaaacccugucucuacuuaaaaaaaaaaaaaaaaaaaaaaagauagcugggcaugguggcucgcaucuguagucccagcuacucaggaggcugaggcaggagaaucgcuugaaccggggaggcagagguugcagugagcugagagcacgccauugcacuccacacuccagccugagcaacaagagcgaaacuccaucugaaaaaauauauauauauaaaacaaaauuuauaauuuuaaccauuuuuaacuguaaaguggcauuaaguacauccauauuauuguguuaucaccauaaguggugauauuccacuaucaccguaaguggaauaauauaauauuuauucauucauuccuuuuuuuuuuuuugagacagggucuugcuuugucacccaggcuggagugcaguggugugaucacggcucacugcagccuugacgcccugggcucaagggauccucccaucucagcuuccugaggagcugggauuauaggugcaugcuaccacgcucugcuauuuuuuuauuuuuuguagagacaggguuucaccgugucguccaggcuggcccuggacuccugaccucaagugauucucccaccucagccucccaaagugcugggaauacaggugcugggauuacagaugugagccaccaagcccagccaauauuaauccuuucacuuagcauaaugucuucaagguucauccacauuguagcaugugucaaauaucuuucuuuuuuuuuuuuuuugagacaaggucuggcuccccuaggcugagguguaguggcgcgauuucagcucauuguaaccuccaucuccugugcucaagccauccucccaccuuagccucccaagcagcugggacuacauguaugugccaccacaccuggcuaauuuuuuuuuuuuuuuuuuuuuuugggagagauguuguuucaccauguugcccgggcuggucuagaacuccuggguucaaguaauccucccaccucagccucccaaagugcugggauuacagguguaagccaccccgccuggccuucacuuauuuuaaaaggcuaaauaauacaauuauuauuauucauaucauggauggauuauauguaauacaauaauacagacaauuucauuguauagauauaccucauuuuauuuguccauucauccguagauggacacuuggguugcuuccauuucuuggcuguugugaauaacacugcuacaaacauggguguacaaacauuucuucuaaucccugcuuucaguuguuguggauauauacccagaaguggaauuacuggaucauaugguaauucuguguuuaauuuuuuuuuuuuuuuuuuugagacggaguuucacuuuuguugcccaggcuggagugcaacggcgcgcucuuggcucacugcaaccuccgccucccugguucaagcgauucuccugccuuagccuccuguccauguuuaauuuuuugagaaacugccauacugauuuccauagcaacuccaccauuuuauuuauuuauuuuuuauugcuuuuuuagagagggagucuuccucuguggcccaggcugaagagcaguagugugaucauagcaucauagcucacugcagccuccaacuccuggguucaagggauccucccaccucagccucccaaguagcugggacuacaagugugugccaucacguuuggccaauuuugcauuuuuuauaaagauggggucucuauauguuucccaggcuggucuugcacuccuggccucccaaacacugggauuacagguaugagccacugugccuggccacagacacaccauuuuacauucccacagcaauccaauuucuccacauccucaccauuaagaaauaauuuuugagcugggcaugguggcucaugccuguaaucccagcacuucgggaggccgaggcggguggaucauuugaggucaggaguucgagauuagccuggccaacauggugaaaccccaucuccacugaaaauacaaaauuuagccgggcgugguggcacgugccuguaaucccagcuacucgggaggcugaggcaggagaaucacuugaacacaggagguggagguugcagugagccgagaucucgccacuucacuccagccugggcaacagagacuccgucugaaaaaaaaaaaaaaaaaaaaaaaaaaaagaaauaauuuuugagagcccgcuaugcacaaagcucucuaggagggcaaauccauucugaaaacccagcagccauuguccuuagggagcucucagucuaagggggagacucaggccaggcccuugggcauccuccaaucugaggggaaagacacaggccaugccuuuugggagacccuagacugauguggggcaaaaaucccuuguuuucaaggagcacacagucugauggaggaggcauagcuucuucccuuugaggagucugcagacaggccuagagaccagaauggagaccccagagacagccaagggcugcugaguggguaaaucagggguacggagggguugugguaagcccugucccaaugccagccugcuguugccugggcaauggcccugguguuuacuuuguggcuggcuagacgcacccuuuucuguaagugcucauuucccaccaagaggaaagaggcuccucuuuaguuuccccuuccucuguugucccugagggaggaacuggcccuccucuggcacuggagacccugccagccuggcaccuuugccaugcuccuugccugcugggagaggccccauccuggggucucauguugcccaccccuucccuacucccagagggcccauaagguagugcucugggcuugccaaaguucagccaaggaagugggagauccuacugaauccucccugcuugggaggaacuggggcacgucaagagccuguaggaaccugaggcuggcagugggaggugggggugaugccgggaaggaugagcuugccugggucuaugagcguccacaugugucaccgugucuuuguguauccauggcugagugucugcaugucugaaugucagugugacugugaugacuauccaaaaagccgucgaaacagccugcauuuauuaaaucccuacuaugugcucugagccugugcuaagacuuucuuuaauuuacuuaauccucccaacaaccuuugagguggaaauacaugucauuaccauuuuauugaugaggaaccaaggcuuaaagagguuaaguaacucacccaaagucucauaucuagaaagugguagagauagggcucugacucagccuccagaggacuccagaucccgugugucagccccugagcugugcugccacugaaagaacuuggggaguuuuuuuuuuuuuuuuuuuuuugagacagggucuugguccgucacccaggcuggagugcaguggcgcgaacacagcucacugcacccuugacuuccugggcucaagugaucuucccaccuuagccuccugaauagcugggaccagaggugcacgccaccauccccgauuaauuuuuaaauuuuuuguagagauggggucuugccaaguugcccagccuuuuuuuuuuuuuuuuugagaccgggucucacacugcagccuugaccucccuggguucaggugauccuccccaccucagccuccugaguaguugagaccacaggcaugcacuaccacaccuggcuaauuuuuauauuuuuuguagagacgggguuucgcuguguugcccaggcuggucuugaacuucugggcucaagcgauccuccugccuuggccucccagagugcugggauuauaggcaugaaucaucaugcccagacagauuuugaggauuuugugcauuuggcauuaucucagcccaccucccugaugguggugggaugucuggagugacaagugcuuccucaucucccuucccaggcuuccguggcucuggccuaguuugagggagagggagcacaguccauccuaacccugggcaagaguggcccuacaggggaagagcacugggucuggggagacccugggaaccauccccuacccgugggccagacauagugccagugcggggugcccagguucccggugauggggguuauguguacauggagggcgcugcggagacacaggcuugcuuggccggcucaucaacuuggccugcuggggcuugucaggcgggagucucuacccaagcaaugcugggaaccaggcaucugaauggggcaaaaggguggaagaggccugagggggccgccgcccuugacugaggagacuggagcaggguucagaggcccaggcgugggcggggcgggcaugugucaguaucgcauugccugcaugccugggaugcacggaucuguggugggauuugcccugucugugugcgagguuguggaguggucaugggucugcguuugguggugugcaacugguguacaggaccagauggagcuucaaacaugcuggaugacucucuuggggugggggcauuguuugucaccuggcaguuuggggcccacauucugggaagagugcugagcaagcuggaggaaggaaaagcaggcagaaucgacccugagccccucucucacuuccuuaaccacacgcccugcaacacgucaguuuccuucuugcuccuaucucugacccuugggacucaggacgcucuccuccccuuccccagugccuacuugcuucuacuccuccaguccagaccauccucuccugugagggauagccugggaggugucuggccccacccucaaaaaacugucaccucccagagagaagaggcccugugcaccugagagcagggcucccuugguuugugggggucucccuuggugggggugaaggcagccggcuuuggccagagucuagaacuuggggaucccuaaagguuucaggagcugggacaauauuccugaaagacucuccaaaguaucucagcuccuggcccacagcagguacucaagaugugguuaaacaagaggguaauggaaaaggaucugguaagcgguuagaacccugggaucuggucccagcuuagugaaaaugaguccuugaacuagucacuuguucucuuugagccucaguuucuuuuuuaaauuuuauucuuauuuauuuauuuauuuugggacagggucucacucugucucccuggcuggagagcaaucucugcucauugcaaccucuaccucccaggcucaggugauccucccaccuaagccuccugaguagcugaaacuacagacacgugccaccacacuuggcuaauuucuguauuuuuuguagagaugggguuucgccauguuccucgggcuggucucaaacuccugggcucaagcgaucugcccaccuuggccucccagugcugagauugcaggugugagccaccacgccuggccaagccucaguuucuguaacugaaaaacggguaucaaaaaaaucucugguuaucugauucuuagggugucaaaugagaacaagugaaagugcuuucaaaugguaaaagacaaugaucucuuggaaggagggaagacuggaugcccucccuuuggggaugcagccuucaagccccuccccagggacccucaggaagaugagguugaauggauuuugcaagcuggucaaacuagagggggauggaaggggcagcucagcaggguaauuucugaugcagggggaggaagcugggcagggcguggggggaggacucaugcuaggcaggaaggcuuggaauagaaucucagcuacgccugguauuucccagcccugggcccccuccgccaccacccucuggggcccaccccacauuccuuucccagaggaaaugggggagggagcggagaggcuccccaggccuggaggaucauuuauucaagcuacauaaccuuugaggccccacugugugcacucucccccugaaguccccacagaggcagcuggguguggaggugguggggguggggaaggaaggugugguuuguguuggaggaaucuguuaccuccuuggcugggccuugcuccccugccagguuagagggcaggaaauggacauuguauaugguugauccuuuccaaggucucugcagucugaacacagaaaacccauguugcgucuccaccucucuccucccugcugucccagaacccucagcgguuuugaauuccgcagagguggauucuugaucugggcacacagcagcaccuguuggccaucagaggcuccaugggggaugagaggggagagucauuccauuuccuuagaaccagggacuggacuagcagcaagaggaaugcaaguuaggcaccugaaaggacuuacuggcugcuugcugggaggagaggccagacuuggagcugaagacaucugguugcccuccgccuggggccccagagucugacauggcuggggacaucuugauggugguuccagcuggucuaggagggucuggccuuuggagaguaugacggagucacagggcaggucagggcaggaguggucccaacaccgaauccuuaguuuucuagcgauggaaguggggcgggagagggugccaauggagauggcgcguccugcucuccccggcugcaguccuuucccgcucucccccuaagcucuccugacucagcucguggcagccucacucuucccaucuggcuuccgccagggugggggugggggguccagcucuugcacggagggggagcccagcaaacaggaaacaggagaacaaaaccagcucccuggcugacacaggcagccgcccccacacgccucacccucacccuuccucucucuuccuccucccucccuugaucccgaccucccucgugguccgcucugcucccuucccccuccccucccaccuccguccccuaggcucccuucccgucccuuugcuucuccaccuucugacacuuuguugucugcugccuuccccucccucugcccccaggccccuccccaucucugucccuccaucucccccccaacccccuugcuggauuuccuaccuccccauugggccacccucccgcagguucuugcuggggacaguggaugguggaaugggagggaaggggagcugcaucugcuuggugcucccuucugguagcugccucaaaaaggcccaacccuuaugacgcuuccuccuggacuccuccuagauucaggagugggguugggcuggagcugccccgcuuuccuggcugcuggcuaggauuuugguguaggauagaaguugggaugagaggcccugggguuggagucccggugcugccauaacaagcuggguccucuuggaccucaguuuccuucucuacaaaugaggccauagaaauggccccgggccacaguaaguggcuguggugauauuguuggugaacagucaagugggcuagaaauggugauggugauuacacauccacuagccaaggccucugcuagccccauccggauggggccugggaagagcaagagccaggaaggcgagcagggcaggggcuagcacaacauggcgcuucccaucuggcucacaugccagggggugggagagggggcagcuuugaaugauugucagcuuguagugacccucuagguagagcuaauggguagggaguccugggaaggagggugguucccacagggguguuggggacuccaucugcgcuuaagaguguguggcugucacucugugcagggcaguguguguagcacucgaggggcuguggcauccaugccuggagugccugagcugugcagugugugcguggcaucugccauguugugggggucccugugggguauguguggagugcguggguggguaaaugugggucuggugugcuugcacaugcaucucucugaguauguggaccguauacacuugggcggaugucugagguguguguauacgauguggaagaguguccugugugugugggggggauaguguguuucugggguauguccacauagggugagugugugugggcagguggauguguguggugcgggucuguacagaguggguagggugugcagcagagugagggacaccuggagcauguguggcuguuucucuggguggauggggcugaugcgcgcgcguaugcgugcgugugugugugugugugugugugugugugugugugugugcgcgcgcgcgcuggaagggugcaaggugugcgggccgggggagagugcgugucuggguccagggcugccgucugcgugugagggugcgaggguguggucgugcgggggacuguguagugcccuggcguguggggugugagugugagaucugggcggccgcggacaggggccgccccggagggggaggcgucagcccugcgagacucgcgggcgugucggggcucgggcgccuucagccgggaggcgcaggaggcgcggagccaauccagccguccugccgccguccgcgcgggccguccgucccuucggggcccccgggccccgggcccgcggcuccggggggcgggcggggacccccggggcccgccggccgcccggggggucgaggacgccgucugccgggcgccuagcagcggccccgggcccccgcgcggcgcgcgcgucuccggaagcccggccuggggcguacuggggccggggcaguggccgggcccgggagcccccgccggccgcggagcuggugggcagcgccguguggcgcguggagcgcgcgggggccgggggcuggcgcugggagcgcgccgucggcguggacugcagcgccccggaaccgcgcugccucuggcugcccugccucagccacagcgaccgccgcgcgcccgggccgcgccgggccagggugagagccgcggggccggggccggggccggggcaggccuugucggggucugagugggacugggucaccaacucccugcggccuuugagcugugugcgcccugcauuccaggacugaugccccuggaacggggagugagugaggcacuugagagauggggcugaggguggcaggauuuguggcuuggagcucugccagggcuucugggaugacaacccccagucugggucgaggccuccacggggcucagcccucucgguuuccaggcaguggaaggauggaagggaccagagcguuugaagagacgcuggggcuucuaggaaucccagaggguaugggugggcagggaccccgaguuccgaggcaggcagaggcaccacugaauggagcagggcccacgacccaccccaccccugguaggggaccuggacacggcacacgaggguuuccuagugggcagaggaggcugaguggcagacgggccacugcagguagugagugcucucagggcugacagggcugggcugggggacugccguguuucugauguccgggauggaccaggcugguagggugugagucacagugggcgccaugcccggccugaacacugugcucccugcaaugaccucuuuaugcucccggggggaggagcagggcuccuggguucuaguuucuggugcugccaacccaccacguguccaccucugccuaauuuguggccuaaggccgucugcccugcugucaccaucagcugguauuuuuggacgucucuuucuuuccugacaugagggugggaguguuuggaaauagauccaggccaggagaauuuaaucagcaaugucccuguguccccugagcaacucccucucaguccccuugucucugugccuaagucagagaggcagagcugugugugugagcugugcaccuuucuaguuguuaucaauggcuccuucugugguuuuugcaccuaucacuucccccaccucaagaugagaacaagacucaguucugucccaggucacaggggaggagaggaaacaugcauguauuauagcaugaaggauugagguuaaacaaggaagaacuucccacaggggagaugccagcucuggcuuuugauggguguccuggugucuccucuucaagcaggugugugguagcuguggcugugugguagcugacauucucaagagccuaguuggaagaggugggaggaaggggacuggaaggaaggaacagaggaaagggagagguagagauaagggagggaaugcugguagugcuuggugaggaggggacccggagaggaaggcaugccuccuacccuggauuccaugcaggcccucccagggagcagcccccccaggcagcuggcagcuccaggcaggaugugugcugggggaggggcggggggcgugcggggaccugucccagccacuucucgucacuggggcagcugguggcuugaaccuuaauccaggacagcagcaaaacaaugggcccugcaaacagccucagcucugagccugggugggggacaggcagggggcagcccacacuggggaggagcaggggcuucugguaggagagggcaguuggugaggggacccccagacccuuuucgcucccugaucaguuccuugccaggucagcagagaugggaaauccgggggauuucagaccucagcagaauucccagagaauuuucuccucugggcuccccaggcccccaugggggugcagggcaccgugggagagacugggcuaaagcuacagguggaagaugcuggacuaccccugaugucaaaaccccugcugagaccuccuggacugggggucuuccagcuuuuacguggccccugucugguagggggcacucauagccucaucuggguaguuuuccagaccguauaggaguagaacagucuagaacggucugucucccuugccuggagcuccacucagccucuuguauauuccaccuggcucuguccccuggggcuguaugaagcaagccuauagccuauugucucugucacauuuuucuuuaaucuucugagaugggaggaucuagccucuuccccagaccugcucgacagcagccaggcucucccccaugcggaaauccuuagcagagggcagcugucucccuccacuggguguguggacaggaggguggaugguccaugaaugaacuuauuggcaucaggacauuugagcuuucuccagcuacgagaaggggacaaaaggggauguugcuagugaagcgggagcuccucacuccagaacugaugagcuucuuccuccacacccagccccucagccuuucuccugucagcugaugcuuccugccuggugccgaggaggaguugaggggaguaaggaguguugguggugagggcuuuuugcccucugaggggcuuggacuaggggcaacauagagguuaggccacaugauguuauggauuuaagaguccucuagggguccucuuggcuuuucaaagccaggcagcuucuccguggcucccaucuuccccaguugggcuccgugagcacccucuaucugacacccuccugucacccaccuucccucucugugucccaaagggagcccugucucaggcacuguuuuucuucuugccccagaaacagaccugugugcccccuccaaacucuugucuucagauacccucugccacaucaucuuggagaauccugagaauuuugggaggucugacaggaggcuuuagugucucugaaaccuccagccuuuuuuuuuuuugagacgaagucucgcucugucacuaggcuggagugcaauggugcgcucucaguucacugcaacuucucccuccuggguucaagcgauucuccugccucagccucuugaguagcugggauuacaggcgccagccaccaugcccggcuaauuuuuguauuuuugguagagacaggguuucaccauguuggccaggcuggucucgaacucgccuuggucucccaaagugcugggauuacagguagagacaggauuuuaccauguuggcaaaggcuggucuccacccgccuuggccucccaaagugcugggauuacaggugugagccaccgcgcccagccaccccaagccuuucuggugaaccagccaggccucugggcugggcucuggagccucaggaagucccuucaggugucugauguccaguccgcucccucuuguuucuugguucccccuguguuccugcugcuguucuugaaggaugcgugugugccggucugcugugcauguguguaucugcaugucugugaugcaugcgcaugcgucuguaugugcauugugugugcaggacuuugauucugugcaacucugugcauaucuaugugucuacaaaagugugcacauguguacucauuuguguguguguaucugugugucugcauauuugcacaugcuugucuguauguuugugguauguuccgucuacaugaguguauguggcuggggcugugucugcauaaguaugugucuaucugggagugcauauaugugugcaugugugugugugagauugugcaugagcuaagacaacgacaggcacuuccugggcaggaaggcuguauccaggguccugcacauaguaggugcucagugaacauuugcugaacucagcugaacugaacugaaugaacuugcuucagugaguuauuuucccaagggcaaagacauuaugaggggacugaggggaaaggaaagaaggaaaaagcuauugggcugaugaaggugggagaguaaggaaggggugaggaggaggucaugggcagggaggaugccuggcaacccuagggcgaaagaccccuucuggugccccuccgguccugugggcugcaggagguggugcaaacagccagaagugucagccacacgggcgcucagccuggccucucugucucccacagcugccacugggcccaagagaugggugcucuccuaggcgccccuuccccuggcaggggccgaggacgcugcugcuguacaaaaguccccaggacggcuuuggcuucacucugcgccacuucaucguguacccacccgagucggccgugcacugcagccugaagguaugcccggcucgccgcugcccuggucuggggaagcuuucaugagggagggagacucuuuugugccaguccccuucaugguccuuucacccucucagagaggcaguccuuccugggguccggccugacucccuucugcuguggccuggggaggaggacugcagggaggcagugccagccuuggcuggguuauuuguacugugugaccguggacaaacacuugaaucacuguggccuggggcuucucaggagacagggagggguggcuggugcagggcaaggaccuugcaggugggcagccaggaugcucaccucacacccccagacgcuugucucuggcaggugaacaguugucugggaguuccugggaccccugaucuaccggcugcuucugagcugggguugcuccuccccucuccagcgugagcucucaggggccuagcccaccugugggagcccucccagcacgccccuggccccugcuggccacagcucagugcgcuggaaacagacccaggcugggacacaggagcccagaguuccgguccugggacaacuccucacucauugugaauuuggggcugccuccccaucucugggcuccauuucuccugcuggaaccugaggacauuuaucaacuugaccccucagagucccuccugcccuaauguaaacguuguguucucugaguccaggaaccagggguccugaccccaauccaaggcugugagcuagggggaggggucccugacagcgaagcagaagugugggaagaagacagaaggggccccagggagcaaccaaagcccccgacuagggcucugcucccaucaccacuucuuuuccagcagggaggagacacugauuuugcagugaaugaaccccucuauccacuuucccuaggaccgggaucugccuguacagcuauugggggacucccccuuggucccaccuaucagagaaccaaacaggggacuucacugucuguguucgugugcucacaugucucucugugugcaucgcgugcuggccauggacaugcauguguguaucucucugugugcauauagugucugcaaauacaugucauguguacauguaacugugcagcucucacaugcaugccggaagcucuggggcuccugcauaacuguucucauuggcuacagcugugcugaagaacauaagugggggcugauggaguguggagggggcacagaccccuacuucaugcccaaggacaccagccccuuaguucuccggaacccccaguacuuccuucacucuuuccccagaaugccccuccugcugcccccagcaucuucucucaggagacccugcugaagcgugacagcauagagucuagggcuggaagaccuagggccaggcaagccagggacaggcugccucuccuuuccagaaccugcccagggcugggaggggccuuuggccuggaggcaggaggaggcuguguucucccguccuucaugcugccaccuggcagccugcagggagcucagccguccaaaugcaucugucugccucugccacucucucgcagugcugucagcuugcaucagccggagugcaccccacacaggaggacgggggcagagugcuugcuccccagaagggcccagcagcuuuccugugacccacccuguccucauuggggugccacagaggccuggguuccagcccuggcucugccacugagucucugaguggccuugaacacaccauacccugcgagcuauacaauggguacauguguggagaggguuagaagagaugacgcugaaggucugauccagcucuaaaaugccacauccagcugacuuagccuguuccucugaccuccaugcccuccuuccucauucccccacaaagucuagugccaucaccuaccaggugaucccagaggccucccaguggguccccuugacacccugcacccaggugccagaauccucuccccuaacucucauuuucaccuccacucucucucacagaagaacuuccauuggcucccucuuucuguccuguaagccugagugcuuuagccugaguauugucacuugcuguuguugacuuucuccuuuaacucagcgauucagccccuggugugcugugagcgcuuaucccugccagccagcgucugcacaccccgccucccuuguccacagugccuucuacccgccacccucagaugucuuuugaguccccuccccaggaggacucuaaucaguccuccccuugguauucccuggagcugauagcuguaguuugcgcuugucacgugccuaucugugacugcccgcgucuucugugugugugagccugugugaugccucccuuguugggcugggagcucccccagggaaggggucuugggucacuuguuggauugcggguucccugaugguuaggguguugaggcgaugggagcacaugucacuggggaacuuggccucggacuuggugccccucggacaccccucccgcacccuccccugcugggcuacuugggaggagauaagggguggcgggaaccugaaggggcccugcccacuggagcugggccaccccuggcugcugagggcuggacugacgcccacacccacuccucuguucccugcaggaggaagagaauggaggccguggaggagguaagggaggacuggcgggcgcuggaccugcacaggacuccucuuccagcuccugucucucccuguccuccccuaagacugccuguccuuuucugugccccccucccuugacuccuguuccugccuuugcuccugucugugccccuggucuggcccccucugggcaccuccuccucacucucucuguccucccccuuucuuuucgcacauuugucucccuugggcauuuccuccacagaaguuugcugagcucggcacacugugggcggcacucuggggcgcagaugggugucugccaccuggccccugcccucaagcugcucccagccuagaacaaggcagggcagggcugcagggccugggggcugguggugggagcgcugagcaaaggcuguccuuggaggcggagacaguggaguccugguggaagucagggaucccccaaggucuuucucucauaugaugugagccugacuccccuugcuguggcucuugcuccccagaggccccugguggacacccaggcccccagguuauucaaggcagagugccuucucuggcagccuuccugcucugccacuggggcuuucgcugggcagccauaggacacuccugcauccccauccagaggccgugaugagggaggagcccgcugaccuagagcggcccauuucucuguuagcuuagaguuagcagcacuuaggagcagagaaacuuuguuggggugcaaugcgauuugugcccacccuaggggccucggaccucugcuuggagucccugagccuggggaagggaggaggugggggaugugaguauuaggugucuugcugggucugcgggagugggcaucccugugaggagggcgucugacucugccacaugucuucagaacuguuauggccucuuguauggcgcccuuuccucugucucgugacuugugugugcugcacaugugugugugagaaucugccucccccacuggacagggagcucuggaaggacaagggcugugcuuguucauccuuuuuuuuucuuuugagauggagucuugcucugucacccaggcuggagugcaguggugcuauccgggcucacugcaaccuccaccucccggguucaagcaauucuucugccucagccuccugaguagcugggauuacaggugcccgccaccgcgcccggcuaauuuuuuuauuuuuuaguagagacaggguuucaccauguuggccaggcuggucuugaacuccugaccucaugaucugucucggccucccaaagugcugggauuacaggcgugaaccaccgcacccggccuuuuuuuuuuuuuuuuuuuuuugagacagugucuuacuuugucacccaggcuggagugcaguggcacaaucccggcuuaccacaaccucugccucccagguucaaguguuucuccugccucagccuccugaguagcugggauuacaggcaugcgugccaccacacacagcuaauuuuuguauuuuuaguagagacagagauucaccauauuggccaggcuggucucgaacuccugaccucaagugauccacccgccuuggccucccaaaguacugggauuacaggcgugagcuaccgugccuggccuguucauccuuuuuaguguaguuuuuagcacaugaagaggacacaggagguguuuacggagugacucuuuguauguccccauagguuuucuuucucccaggucuguguccuccuguuggguucugugccuccauggaccuguccaguguccucguggauguuugagccugugcauguuugugaccggacgagugcaaucauucucugaguguguguccccuguguguguagcugugcaugggugugaccuuccccagccacccccagcuaaccuggcugaugcccacuaggacccuccccccgguaccgccuggagcccauggacaccaucuuugucaagaaugugaaggaagacggcccugcccauagggcggggcuucgcacaggugagcuggcccaguuaccugggcucuacuuucuaccuucuggcuaggauuuuauucucagauccagguguuggggaggcuccuguccccacaguguuagccaugccugguacagggguucucagauggggccuuugaugcccuuuggucaccacucaugcgcuccuuguccccaggagaccggcugguaaaggugaauggggaaagcgucauugggaagaccuacucucaggucauagcucugauccagaauaggugagugucccugaccccucgucccauauuaucuccccuccccuuugcccuggggaugcccuggagaccaggaucccuuccuccuggacccuguuccuugacccagccugacguucugccugucucuguagugaugacacucuggagcugucuaucaugcccaaggacgaggacauccuccagcuggugaguccagccccuguggccugagaggagaccccugagcccuggggcagcaccggcuccccugggaggcagagaaggaaguguuuggagggcacaggccgacauugcccaguuggggaugccaggccccucccugggcuggggcugguuguugcuucauucggagcugcucugugcugggggagcgggagaccuggccuuggcaggcaggauuccugccaggguaucuggaaggaggguggcccagcaggcucugccagccuggcacguucuugucagcuccuaggagagaugccucuucccugcacccccucccugucuggcccugagugagggugucucugguggguguguccacacaggcaccgagcacacaucgaacacugcucagcacacugcaccccacccaccgucaugugcaccacacaguacccgagcaguacacagccacacagcacagccccacagucccacccucuguauagcacgaagcacaccacaacacacaugcagcaccaggcacgugccgcaauacagacaaccacacaagcacccacugccacaguucacccucauacagcgaagugcaccacaacacacacccacaaacauuaaaacacgacacacucaccagccccuuggcucccugcaguacaaacagcauaguaccuugcacacucggaccuccacaacuacacacccacgccgcacuaucacaacauguaugcucgcaaacaccgcggcauccuccugcccaucucagcacgugcgcccacccgugucacaggacuccaaauuuauacauucgacaccucagcauaccuagaagacagcauccagccugccacacagagagcguggcccagacacugcacgaagcaggcccugcacucccaagcauacccuuccacacacacacacacacacucacacucacacacugccucuuugugccuggagccccggcgguccgcuuugcccagugcccaccucccuggucucaugggucccagccagauggcggcuuacuugccccugaggucacugucccuggggaggcccugggagccgcugugcuggcuucugccuuggacgcacucuccuaaucacuguaaucacagugccaugccuggcaugaugcccuucuggaaaccuccaccccugaccucgauuguccccuugcucuuccuggggagagggaggaaggagggggggaucugagguggacugcuuaccccaagucucaaggcccugccuguacagcucccccaggcugaggcgaggccagcuaugggggagugacagggugggacccuagggugucccccacucucuccaguuggcaggggcaaggagugggaagggcaguagccucaaguucugcugcccaggcuggggugggcuggcagcgccagaugacagcaucugggggccuccacuggcccccgcaucucugccagccggaggguggggcccaggcauuccugugguuggaagccaaggcuggaggccaaucgggccucggcagcugcugacgccaccaccgacgcggcgaggccccuccacacccauccucuccucccuccuccucccgccagccagccgagagagagucgggugggggugagggggagccgcagggagggcagacggagggggaccggaggcccuggccagggcaacacaguggucaguggggggguuagccggagcugggggugggcggaggcgggcugggaugcugccgccgccgugaugaugccgggagccuggggagacggcgggauggcaggagggagagguaugugugugccggcccugugccagcuggagggggcugagugugcgggggugugguuuagcuuguccucaucacaugauguuugugccugggacuggagguguaguuauuuguguguguuucauuguguuuuacugugugugugugugucucuggguguguaucuuccagugucuccucguagugugguguguguguguguuugguuucacccucccacccuuugguucuuugccuugaguuaggcuccugggcagcucagcaggggccaggcugggcccaggccacaaggccgcugucccugggagcugacuccuuuuuuggcugggccugggcgcuggcccugucacuccuuagcaaugcagcgucagccucagcucccagugccaaauuccaggcccagggguggcagaagguggcucaaguccccuccuucaagccuggcaggaggugggcaaacuccuucucaccccuguggcucaggagccagcuccccauucccggggauggagggacagcugggcucugccagccucugccccacccagacacaccccuagccggcuuucuucucucaucugccaccuugacuggucucggugggguuuuccggcuccacccgaggagcuuugggcauugguggacauaagggggcaggcaggcgguggaggccaggacugggggaggaccccaggaaacagaugcuggaauguuuguggcuagggcaguccuugucacagucuuagcgaaaucccacuuuugcuggaguuugccugcgucucaaaggcuucuugcuucuucuuuguucucucccuggaccugcccuuccacccccacccacuuaugccucucccucguuccccccaccgcuugguccucucccuucauuucccuccugggcuccuugaccuccucgggcugccguuccccuacccugugggacuugucuggcccugcuuaccugucucugugucucuggccaggccuacucccaggaugccuaccugaaagggaacgagccguauucuggagaggcccgcagcaucccagagccaccgccgaucugcuacccccgcaagaccuacgccccuccugcccgggccuccaccagggccacuauggugccugagcccaccucagcacugcccagugacccccggaguccugcugccuggagugacccggggcuccgugugccaccugcugcccgugcccaccuggacaacucuuccuuggggaugagccagccccgccccagcccuggugccuucccccaccucuccucggagccccggacgccccgugccuucccagagccuggcagccgggugccccccagcagacuggagugccagcaggccuugucacacuggcugucaaaccagguaccccgccgggcgggggagagacggugcccagccauggccccccgggcccgcagcgccucccaggaccgguuggaggagguggcugccccccgcccguggcccugcuccaccucccaggaugcuuugagccagcugggccaggagggcuggcaccgagcucgcucagaugacuacuugagccgggccacccguucugccgaggcacuggggccaggggcacuggugucaccccgcuuugagcgguguggcugggcuucccagcguucgucugcccgcacccccgccugcccaacucgggaccugccagggccccaggccccacccccgucuggccugcagggccuggaugaccucggguacaucggcuaccggagcuacagcccaucauuccagcgccggaccggccuccuccaugcgcucuccuuccgggacucacccuuuggggggcugccuaccuucaaccuggcccaguccccugcgucauucccaccagaggccuccgagccacccaggguuguacggccggaacccagcacccgggcccuggagccuccugcggaggaucgcggcgaugaggugguccugaggcagaagcccccgacgggccgcaagguucagcugacccccgcaagacagaugaaccuuggauuuggugacgaguccccagagccagaggccagugggcgaggggaacgccugggcaggaagguggccccuuuggccaccaccgaagacucucuggcuuccauccccuuuauuggugagugaugguacauguggcuguccuggaggacuuagcugucggcugucuguguccugcuguaccccaucugccugucugccaugggcagaauucggcugggugcuggugggaucaucuuguuucucugucaauucauucaucuguucauccauccauccaucuguucuuccaucuuucuuucuguucucugucauccuuucuuccauccuaccucucauucauuuauccuuucagcaucuuuccaugcacucuuucuuuuuucccucuccccauccauccauccauccaucaucuguucuuccuuccuucuuuccuuccucucucccuccuuuguucauucauuuguuccauccauucauccaucuauccauccaucuauucuuccuucuuuccuuccucucucccuccuucuuuuguucauucauuuguuccauccuuucuuccacccauucauccaucuuucuuuccuuugacucuuccuuccauucucccauucuuccuuccaucuucccuuuguaucuuucccucuuuguccuuuccauccacccuccaucccuccaucgacucaacagauauuugugucaggcccugugcauggcuccaugcucuccuggacuggauggcccagcagaggguguuggacaugcagggacaauccauugggaugggcgugucgugggacagggagcuugaggagaagggcucagagaagggcuauggugagaaucuuggagaaagaacauuugggcuaagacuugaaggaugagaaggaguuuaucaggggaagaauauucaaggagagggaauagaauaugcaaagacccugaagggagagaggcaggacccccuuccagguugugaggacccuuucaggcccaagggucucauuagucacugggguuggcuuuugagagcagagggaacccucuaaggcuugccuugccuucgacuggaugcaggagagggagaggcaagagaguagaguggcugggugaugcccagguuucuggccgggcuuggggguggugccucacccccguguugggagugagagggggacaaaguucaggacuguugaauaugagguguccaagagggagcaggauagacggggcuggggagaaagagcaagaugcaggguaauggagagggauggugguagaugggagaugagcucacccuaccagacagugagagggaggaggccuggggcagggggaagacacagcccuggcucccccagccagccuucgguggagcagagacacagccccuucugcuaguaaggaaggcucuaggcuguggccgggagaggcagucucuucuuccacagcgcagucuguuugagggggagaugucaucucugcccuugaggagccccagcugaugggggagcuuuugcccuuaggaagcucucagucugauggggaagacacugccccugcccucaggaggcucuuggucugagaggggagacauaauucauucucucugagugcccucagucugaugagggagacaccgucccugcccucagcaggcucccagucugaugggggaauauuggcucuguccucuggagcccggucuaaggaggguggcucagccccacuccugaggguaaggauuccauggccacagucuggacagugggccagucaugcuugacagugggcauguugccagcaggacccuuugggaugugucugagccuggaggcgaguggcacgggggcuggcaaggcuaggguggaggcaggcaggcuccgcugucugcugccuucacaccuuucuccuuccacaugcauagaugagcccaccagccccagcauugaccuccaagccaagcacgucccugccucugcuguggucuccagugccaugaacucagccccuguccugggcaccagcccaucuuccccgaccuucacuuucacccucggacgccauuacucgcaggacugcagugagcacuccccacacccccagccccacccucucccucgcugcccagucccaggggucucuguugggccugcugcuugaugucuggccucuuccucugguuuccgcuucuccugcggccccuugggagagucaccuccugccccugcccagaagggagggcucugggaagccccugaccugcugccccgcugacccugaggcccgaugugggcggcuuugcaggcagcaucaaggcuggccgccgcuccuccuaccugcuggccaucaccacggagcgcuccaaguccugcgaugauggacucaacaccuuccgcgacgagggccggguucugcggugaggcccuguccggacacggggugggguggccacagccaccguggccagcugcucuggggcagggcucuuggcccuggggguccucuaugcaugggacagugugccucccccgcuggaaggcuucugggcuugggguuuggugggugacgagauagugaggucccagcuuugcugcccacaucccucacccucgacccucgcuuuccaggcgccugccaaaccgcauacccagccugcggaugcuccggagcuucuucaccgacggggugagagcugcaagugugugugcgugcgcaggagcgaggguguggggagagagggugucagggagguggggccacagccucggcauggggguuccugcuccagcuccugccuuccuccuccucccugcaccccucacccucguguccaccgcgggacccgcccucugcugugggccccgacaucccugaaugacaccaugcagccccgcccaugggcccucgucuggacugccucuuuccagacccaucccccauagccacaugacucacuucuccccugucuucgcggcuuuuuaggucuucccugaaauuccagccuccgcuccugacauuucacgccucccuucgcuacucuauguuuuccuccucagcacgccucaugcacaauugguguuucccuuccucccugccuggcuccccagcuagaauagaagcucccugaacuuauauuuggggcuucauuuguuuccuucacuacccucagucaguauuugcaucgcgucuugucuucaugggauggggucgggguggacacuggaaagguguggccgggacacaggguugagacugguggacagguagaguucccagccucaggaccuggggaggcaggaucaggccugugauagcccuggcuguuuguuuguuuugagacagagucucacuccauugcccagucuggagugcaguggcaugaucuuggcucacugcaaccuccaccuucuggguucaagcuauucuccugccucagccucccgagcagcugggauuacaggcgugugccaccacgccuggguaauuuuuguauuuuuaauagagacuggguuucaccauguuggccagacuggucucgaacuccugacgucaggugauccacccaccucggccucccaaaguguugggauuacaggcgugagccaccgcaccuggccucaaaugauuuucuugcuucggucucccaaaaugcugggauuacaggcauaagccaucacaccuggacauauuuuuguuuuuaaaaucauauauauauuuuucaugcaugauuuuucuuucuuuuuuuuuuuuugagauggagucucacucuauugcccaggcuggagugcaguggcacgaucucagcucacugcaaccuccaccuccuggguucaaccgauucucgugccucagccuccugaguagcugggauuacaggcaugcgccaccacaccuggcuaauuuuuguguuuuuaguagagaugggguuucaccauguuggccaggcugaucuugaacuccugaccucaagugauccaccugucucagcuucccaaagugcugggauuacaggcaugagccagcgugcccgccccaccuuucccuggcuguuuuugauuauagauggacuggaaaagccaucuugaugucaagcgcucugucucauugguugguugaacacccuggugauauuggcaccuagcuuauuucuuaucacuuuuucugcuuacuuaacucucccuugacuugcgcccucuggcuggaguccuguugagacugucacuuccucuguuuaacuccucguggacaugacuaccugcuccacucacucagccuuuguugauguucccacuuccccuguuuauuuaacuccucguugacacgaucacuuccuccauuuccuugauucuucuaagucuauaaaguuaugggaggcuccgaauuggcuccuguaguguggugaggcguguggucugcugacaggucguagccuuuccuccuuucuggcuucuccuuuauguacgucucaugaccucaacacaagugguccagagaggacaagcaaugcccaugaggucgcacagcacaucgggguguagcacagacauauaucaggccugugcggccacaagugguccaugggguuccugagaugcuggcauugugggagccacccuaaauuguccucuguugucucccugcaguccuuggauagcuggggcaccucugaagaugcugacgcuccuucuaagcgacacucaaccucugaccucucagaugcgaccuucagcgauaucaggagagaaggcugguuguauuauaagcagauucucaccaagaaggggaagguaagauggguggaggaaugagguggaagcuggcuccagcagaacccuccagccucuccuaggccuacccugacagccucuggagccagagagaaccaguguagguuguugcaugaaggauggagguuagaugcuaggaagaacuuccuggcagggggauuuaaagaacuuauguaaaagaaguuaacaagagagguggauuuugcugugggauggaucugaucgagucaugcuuggaauauucuggcaaaaccaucccacacgggcccuggcuugacaggccauccugaagauggccgcuggggcucauggaaaacaaggagcaaggccggggugauuuccguaggagagcuaaggcccaagaagacgcaggcaagccagcaaagggcuuaguguucauccuaagggcaaccaaaagcucucgggggcucuugccaagggaguuacagcuuuaaaauauucauuuggcucccugggagugaguuagggaggggccaugcuggaggcaagaagaccaauuaggagccaccguggagauccagaugagaggcgaagggggcuucggggaguaguuggggagggccugggagggaaccagcaggacucugagaggagaagggcagggccccuggauccauggggugcaaauccuggccccaggcugcgcugugggcuggagaagugggaggagagaccacugccuucccuccuggcgauuaggaugaacccggguuugacucuugacugcaucacccauugcucugagagccugggugacucaccuggccaugacucaguguccucuccuguaaauggagcuaacaguaaucccuagcucauaagccuauugcuaaggauuaaaugagaugaucuaaguaaaggguuuacccagugcccggcacuugaagcugcuguacuucugcuuacugcuauuuguuuucuuuuuuugagacggagucucgcucuguugcccaggcuggagugcaguggcgugaucucggcucacuacaaccuccaccuccuggguucaagcaauucuccagccucagccuccuggguagcugggacuacaggcacucaccaccaaacccggcuaauuuuuuuuuuuuuuuuuuuuguauuuuuuuaguagagacggaguuucaccauguuggucaggcuggucucgaacuccugaccucaaauuaugugucugccucggccucccaaagugcugggauuacaggcgugagccaccgugcccagcccgcuuacugcuauuugaauuuucuacccugccuucuggggucuugggggucccuggaaagaacauaagcuuugaagcagacagacuuugaguuccuauccggccacauaucaagcacguggcuuugggcaccccacuuaccuucccugagccucacuuucugaucuguacgaugggaacaauguuauccuaccccaagggcugcuguggauuaagugagggugaagucgaggcgggacuggcgcuccucuguggagaaugacuaaggccgcccugcucgggagccuccguggagguucuggggaguuagugguaagggagccagggcagcccugcccuccuggggcuccugucgcuccuguugagcagagagaacgcauguggcgucaugguuccaagugcacagacugccgugaugccggggugcgggggcgggugggcguggguagggagguauccagaggcugagacacgaaagggugagaagccacaaaacugggagacaguggaggggccugacagggaagaugucuccuuagaggguccuggggagaggggugcugggagccagggcgagagguggaagaugagcuggggaauugggugccugcccagaguguggggccuugauacccaggaagagccuguccaggguuuuauuauuuuauuuuauuuuaucuauuuuugagacggaguuucacucuguugcccaggcuggaguacagugguacgaucucagcucacugcaaccuccgccccccagguucaagcaauucucgagccucagccuccugaguagcuaggacuacaggcgccugcuaccacacccagcuaauuuuuguaguuuuaguagagacuggguuucacuauguuggccaggcuggucuugaacuccugaccucaagugaucugccugccuuggccucccaaagugcuuggauuacaggcgugagccaccgugcccagcucuguccaggguuuuaaaugugggcuggggauggcaggagacugggguuaugucugugacaggaggagccaaucccauugcccuuguccaggugagugaggcugggggcccugacccaaggcaguggugugaggccggguggagcagacacuuuagagagagauuccaggggaaggagggccagggcuugccggcugcugggagguauggaaggaggaggaggcgauaagguuccuggauuccuggcuugggcugagggagggugguggguggugggacccucccugggccauggcauacuggaggaacagguuuggggagaggaagccaaguggcuccacuggggcuaugugagucugagggcccugggacagaccccaguggagguguccuggggacagaggcucugagggcguggcacuagagggaggcccaccuggggauggccuuugucugucagcaccgacgaguuaccugugccucugugcaggggcuugaaggaagaaggcaagagacccggcugagccuugagagaagugggggggccggggaggcugacagagaccaaaaagagccagcaaguuggcagugacccauggggugggagccaugaggcaaggagggaccagccaugugcacugugcgaggagagccacgugugggccagcccuuccagucuaacgugugagccacaugaaggguccuugugaggguggcuggcucccccugccggggagccugacccucagcuccugggggcccugagcccaguucagggacaggagcuguccccuuccugcucacuggccaguucuggaggaccaggccuccacucccuugcuggccaaaacccgauaucacuuguucucuuggugccguggccuggacguuagaggagagucuucaagucagccucaggcccuugguccacccaggccgugggcacccucucugugcucccucccagccccagccucuuucagagacacggacugucaggcagaggagggaaagggacagugacuuguccccgcagccucagccccagcaugggagcugcaugcagccuuggugaccaacucucucacucauuuaccagccggagacacugaggccugggagugcgguugacuuguccuagguuaugccucugguuuagccucagagaggugcccuugucaccaccucacugucacauuaaaauucucccuggagggcucugcugucuccugcucugaaugucccuguccccauccagcaguucugugaugagcagggcucacagcucaggauccacacgaugggaggccagaugugggcugugcccaucugccagccacggggucucuuugucugguuuguucggagagcugaggccugugcuggauguggagccaccagccagcagagaggagcucuuggucugaugggagauggagcuccugcccucagggugcuccaaggaucauuaauucauuuauucaacaaauauugaugagcccuugcaugcugcugcuguaggcccugggauauggaaaugagaggacggacaagcucccuguccccaggacagccugaggcugcaguaaguucuuggaaaggaucaagcugaucagaagcgggagcugcauugagggaaaaauauggccagagaaggccucacugaggaggugacguuggugaugcuggagcucagaucugaaggggaagaaggaagcagccacauauagaagugagggagggggcuuaggcaaaaggaacagcaagcggagaggcccugagaaaggaaaggcuuggcucgcucaccugcaagggcccccuggcuugacauagugagaaaggugugaagaugaauuuggagaaaggcagggacagaccacaggagaccuuagauuugauucugagggcgaugggaucccuugagaggaugcugagcaggggagagaugugaucuccuuuucauucuaacaugaucgcugcagcugcugcuggagaaugguugcaggagcgagaguagagacugggaaggucugugcauccucuaagcaagaggcguugauggcguggaccgggugguggcaggaaagacagagacgggauguuuuggaggcagaauaguugugacuuccugauggaugggaugucaagggcgaggaaaagggaggagucaagggcagcucccagguuucugggcaacuggauggauugacugggcuggaaaagauggggguggagaguggagaagggguuugaugguaagaaaucacauggccuggcaaguauugugcaaagugcccaugggaccugcaaaugaagccacugagcagggugggggugccgggcuguggcugggagagacgcugggcuugggaauggccaucagcagauggaccuaguuuaaaggcacggcagaggugacauccuugagggaggugugcagggagaggagaggagaggagagucaggacaaaguucuggagcuccgccuccuuuagggcggggucucuuacccucagcucugcugacauuuugggccagauaauuccuuguugggggaggcuguccugugcauugugcaauguuuagccgcaucccucagaugccauagcacacccuccagcucccuccacacaaaugucccguggggacuagucuccuggcuguuuaacuacagguguagagggugggggagggcaaguagagaagacuaggaaggagccaguggcauuaggaagaaagcugggaacguggggucucaggugccgagauagggucuggagagggaaggaggggcuggcugugucagaugccgcugagggguuaaggcaaguuggggagaagcagccacuggcuuuggccacauggcgguucugggugucccugagaaggagcuucugggcaaguggagucuugggugggcggcaggaaaguggggagaacaacccucuaagagugcggacggcuucugagcagguuugcugggaugaggggcagccuggggaggggcgugggcugggaauggcauccccaggauuucauguauggagggccaugcugggugucugagcauugccaccgcucggugaguguugaugcugguguuuagagggggagaggguuggggucugcuggggggcuuuaggaugauggguaggggugucuaggcaggcaaggggcugagaaggcauuggugggcugugggcaggaggcugcccaggucuagccggguggagcagggggcuccugguaggcagcgugggguccauccccuggcuguccucugucugcuacucugagagcagugggcaaaacuggccucucaccauuccugucucccccaaccccgugucucccugcagaaagcgggcagcggccugcgccaguggaagcggguguacgccgcgcugcgggcgcgcucgcucucgcugagcaaggagcggcgggagcccgggccggcggcggcgggggcugcggcggccggcgcaggugaggacgaggcggcgcccgucugcaucggcuccugccucguggacaucuccuacagcgagaccaagaggaggcacguguuccggcugaccaccgcugacuucugugaauaucucuuucaggcugaggaccgggaugacaugcugggcuggaucagagcgauccgggagaacagcagggccgagggcgaggugagggcccggccagcccggcagccacagagggcgggcgggguggccucucaccggcuguggaccugggaugcccgcucugagccucacuucccucugcuagaaaggggggcugacaggagugcaccucgugauugugucccccaagguuucggggugaggagggugcacaggcagggcucacgggggaccuggcguccucaggugcggggaccggcagucaccauccugacccuaaugaugacagggaugauugugacuguguuaggaucgccuugagcaggcuccgguguggaguggucagcuccaggccagucucagcuuuucucagcaggcgaggaaggcaggggccuccuauggaguguguuagggcaugaguguccccgcaccagaacugcacugggcuggccugucugcagaaggaugagcacauugaccuugugaggaggccgagaggcuuggccuuuggccacaggugggcagggguggagccaagggccucggcagggauuuugggauaauuuuuuuuuuuuuuugaggcagagucucgcucuguugcccaggcuggagugcaguggcgcgaucucagcucacugcaaccuccgccucccagguucaagugauucuccugccuuagccucccgaguagcugggacuauaggcgcaugccaccaugcccggcuaauuuuuuuuuaguagagaugggguuucacuguguuagccaggauggucuugaucuccugaccucgugauccucccgccucagccucccaaagugcugggauuacaggugugagcuacugugcccagccgaagaauuuuuuuuaauggugcccauuguggucagccauagcuacacuccaggggccuagguagggauuccucccuguuuacuucuuuggccaggaaccuacacagaagugccuugagacacccacacaaagucaugugggcgucccaggccuggggucucugccaagagggcagugggccugggccugcuguggccgugggagggggugcuagugcauggccucuugcugaggucacauccucuuacugaccaggcucugcucucccgggaacagcuuuccccacugcagggaggaaggcaccuggaauuugggccuccuccucugggggccucucuuggcuguccccaacaaggcuuagucaggggaucccaagucaccaucacuauggcaguagcagucccuccuggggcaccuccuccaugccugcucagugucugccaggacgguggcgagugcugcaugauucugcacccggcccugagccuucccuguuagccccccauguuuauuaccgaggagacugaggcucagagaggcuaagaggcuuccccaaggccucagcuggugagagggugcuggggaguccaggccuggucuuucucacuccagggucugggcuguccaccuggcagguggacaagaggggaagcagggcuagggaugagcccuggggugggcuggcugugggcacugacaugauccgcucucuccucuccugcuucaggaccccggcugugccaaccaagcucugaucagcaagaagcuuaacgauuaucgcaaagugaggugaggcccagcccucguggagcagucuccucugugggggugguagggggcugaaggcaaaggaugucuuccuggcccaccuccagggcugcccucugcugggggaagggguauccagggucuccaggcugcaguuaggcauggaggcauugccucaggguggaggggaggucccgaggggcgggaggccaggguggguggccugcuuggccaccccaaaugaagaccucuccucucccccuuuuuccuacacagccauagcucugggcccaaagcugauuccucccccaaaggcucucgcggccuggggggccucaagucugaguuccucaagcagagugcggcacguggccucaggacucaggaccugcccgcagggagcaaggguaggaagguggccacugagacaggguggugugugggggcagggggcauggggaggggagggcacgcguguguguguugggcugugucugcucaugugugccugacugugugccagggcuaccgguaugucugucugcgugugcaugccugugagggucuaggggcucucagggucucgggguggaagggccuggagccugauucccgucccugacaucccugcugggugguccucuaaucuuugcuggugucucugcagggaugagaggcccacccuuuccaagagcaaccuuucccauuucacucaccuuuggcuguuagaaaguucuuaccuggcugggcaagguggcucacacguguaaucccagcacuuugggaggccaaggcagggcagaucaccugaggucaggaguucaagaccagccugaccaacauggugaaaccccaacucuacuaaaaauacaaaaggccgggcgcgauggcucacgccuguaaucccagcacuuugggaggccgaggugggcggaucacgaggucaggagaucgagaccauccuggcuaacacggugaaaccccgucucuacuaaaaaauacaaaaaauuagccgggugugguggcaggcaccuguagucccagcuacucaggaggcugaggcaggagaauggcaugaaccugggaggcggagcuugcauugagccaagaucgcgccacugcacucuagccugggugacagagcgagacuccaucucaaaaaaaaaaauacaauaaaaguacccgggcgugguggugugcgccuguaaucccaacuacuugggaggcugagacacgagaaucacuugagccugggagguggagguugcagugagccgagaucacaccacugcacuccagccugggugacagagugagacccugucucaaaaaaaaaaaaaaaaaaaaagaaagaaaguuguucccuugggccagcagacaugguggcugacaccuauaaucccagcaucauuuugggaggcugaggcuggaggauugcuugaggccaggaguuugagaccagccuggguaacauagaaagguccuaucccuacaaaauauuuuuuuuauauauuauuuauuuauuuagagacagagucucauucugucacucaggcuggagugaucucagcucauugcaaccuccaccucuuagguucaagcgauucuugugccucagccccgcuaguaacugggauuacaggcaugugccaccacgcccggcuaauuuuuuuuuuuuauuuuuuuuugagacggagucucgcucuguugcccaggcuggagugcaguggugugaugucggcucacugcaagcuccgccuccuggguucacgccauucuccugccucagccucccgaguagcugggacuacaggcgcccaccaccacgccuggcuaauuuuuuuguauuuuuagcagagacaggguuucaccguguuagccaggauggucucgaucuccugaccucgugauccgcccgccucggccucccauagugcugggauuacaggcguaagccaccgcgcccggcccacgcccggcuaauuuuuguauguuuaguagagacaggguuuugccauguuggccagcuggucucgaacuccuggccucaugugguccugccggccucagcuucccaaagugcugggauuacaagcauaagccacugugcuuggcaaaaaaaauuuuuuuuaauuagccagguguggugguaugagcuuauagucccagccacucgggaggcuggggagggaagauugcuugagcccaggaauuugaggcugcauugagcuaugaucauaccacugcacuacagccugagcgacagagacucuaucucuaaagaaacaaaguucuauggcuuccgccuuguaguuuuggcccacgagccacacggaaguccuugcauugcucugggccucuccuuugggguaagcauccuccccuucaggccuucucucuugccauacaaugucccaucagcccugggcaucugguuucuucucugauggaauccccauacguccaaaugugugaauguggcagugaaugugugugacccuccuggauaccccagcucacucuggcucugucucccccacuucagaugacagugcugcagcccccaaaacccccuggggcaucaacaucaucaagaaaaauaagaaggccgcuccgagggcguuuggggucaggcuggaggagugccagccagccacggagaaccaggugagucucugccacacgccagagcaggcccagcagggggagaccgaggcacagagggucagagcagcaagggacauggaaccagcucuccaccucauuguacaaacacagcugggaaaacagcccagagaggggaaggcccccgccugccccgggccucccagggagggagcagcagggcugaggcugagcccggcuccuucucagaccauggcgaggcuuuggugucauuuuuagcucccagacuggaggcagcaagggccuuuuguuccccccaaggguuccuggcagcagcucugggccuugcauuguccccuucuuggccuccccagcuccucuggccccuguccccccuaacaccccucccauguguccccagcgcguccccuuaaucguggcugcaugcugucgcauuguggaggcacgagggcuggaguccacaggcauuuaccgagugcccggcaacaaugcagugguguccagccuacaggagcagcucaaccgcgggccuggugacaucaaccugcaggaugaggugggugaagcuggggggucuguggaagaggggcugagaugguguguggguggugcuccgcuuggagaguucuguggucuauuguguugcaugcauugugcccuaugacaugcccggcauugguccagaacaccaagaugggcaagaugggaccugcccccgcuggccagcccggggaugggcaucaccccaggcugaagcugaccaaguaaaugcagucauggccuggggagcucugaggcagaggcucacagauggcaguuuuguccgaguguuuaggaugaguagaguucaccaaaggccggugaaagccaggugagggcauuccaggcagcagaauggccugcucaaugguguagacgcggaaagugugccaggagucaaccagcuuucucuguagaaggcagaggguaaauauuuucugcuguaguuugcucuguugcguuccccccuucucuuccuccuccuucucuuccuaauccuuuaacaacguaaaaaccauacuuagcucaagggccauccaaaagcaggcuguggcuagauauugccuacagaccaugguuuacaaaccgccggcuuagaaaaaggggaauauaugauguuuucuagaauggccagcaauuuggguggcugcaacauggaaagagaaguggcugaucaggcgagaugagaccagccugugaagggaucugcaaucacacuuaaguguuuccagcaaggccggcgauucucaaaggguguuccccagaguccuaggguuccccagaggggccuugggaggccaggggcaggucaggacccccuguccuugcuagagcaacccugcuuugcccugucuguuguacuggguuuucauguacaauuuuauuugcccaaaggggcucugauaaaaaagauauuuuggaaaaccgugaacgugggcagugaugucccacgaaucacacacgugaaggcucauggaauacacaagucuuccuguccuuggagaaugaggagcugagacaagugugugugaaauuguggacaagagaaaaagaugaucucucaucagggaccacacugugaugaggaaggagagggugcucaggcuggagcaggugguggcuggaggguuugaguauuggaggaaugaauaggagggggcagguggacgggaagccuuucggggugugagacgauggcauuuuccaaaaccccagcaagggccggggagggcuugaggguuaggacagagaguggaucuaccuccugggcuuggagguggggagggugaggccccagggggacagagaaggcauuugauggcuucacugaagacuucgaccuugaucugauggacaguagggagcuucugaugguucuuaagcuggggaggcaucgugagaacaaaguucaagaaacaguaaugcuccugcucauguccauuggauacgaaugcggagggcaggggucuggggagaagucacugaucuauggaagcgcuaagugucgggaggacuugguggucucaggggaagggggaggaugggagcaacccuaagaguugucugcaugagagggaggaaggaggggcgaggaagagccgcauguuugagcuggggcuggugguaucuucccuuggcagaaaccagggaguggggcagcgugaggagaggcggaagggaggggccgucucagggaguggcuccauuggauuugggguguggaaagucccuugcauggggugagggcauaaacaggcgcuauauugagccuggacuagagaguggcauggguccugcugcagcugaggcaugggaugaccaagggugggccgcagaacagcaggggccacgcucugagugggacagaaggagagggccgccagugaggcuggggugagggcagacacuucacucuggaggaaccaggaagcacuggccagggcauuggguuuggcagcugggagaugagaggagcucacaccugagggccaggagguaacggagucgggugggcaggagccgcacugggugugugugagaugagggggccaugcuggcaggcagcugguccaagccagggccagcugggggcauacgagguauauuggguguguuguuuugucuuggauaucauugugucauuuguugugggucgugcugggaguaaguguagugggggaugaaucuaaccccuggugagccuguggggaguguauuguuuaugggauugucuggcauuaagcuguggauccauuguaaugaguguguguacugcuguacugugucucuuuguuggggguauuaggucgcuuucugggccugaguuauucugagccauucccagcgaggcggcugugcccaacuugguugcaauguggggugauggugcccccuggaggacagaagggacaacgacccggccguuaguucuuguacucgacaaccauuuauuuuagaguaggguuucucaaucucaguggacauuuugggaagaacaauuauuuguugugugggguuguccugugcacuggagggaauuugacaucaucccuggccucgauccacuagaugcaaguggcaccucccaguugggaaaaucaaaauggcuccagacauugucaaauguccucuguggguggagugggaguuugggggacaaaauugccuccuucuguuagaacuacugauuuagggccauguaaguaccagguuaacuguccuugcuaggugauaggagcacagugggaaaugagacagacgggauccugucuccuccuggagcuuacaguccugcagggagacaggcaugaacacggaaacaaaagcagaaaauaaugacaaauuggguuaagcgccaggaaggaaacaaagucagggcuggggugcaggugacagggcaguggugaagguggcugcuuuagcuaugagggucagagaaggccucuuugaagagcgacuuuuaggcggggaugaggagccaguuguguggaggcggggaggaaaguucugguugaggaaaccagcacaugcagaggaccugagacaggaaggagccggcacgaaugacugcugugucacggaugcuuaaacugugcccaguggaggcagcagcugccacucacugucuccccacagugccugggacuuucugugcauggggagguguuggagcccacgcacuggcaggagcagggaggggcuggggccaagugugagugugggcacaggaccucucuggggacucaguucugcugccaccauccugaugaguagagagcuuggucuaaguaggucccagggagggccuggugggcuugauugggcucuggggugaaugaucguggaggcaugggcaucgggcugggccugccugugccugacaucugaccccucccccagcgcuggcaagaccucaaugugaucagcagccugcucaaguccuucuuccgaaagcugcccgagccucuuuucacugauggugaguaggagguggaaguggggcggggaggggacaccaguccgugccucacccugaccacuacuuuugcauuugguuuguugguuuuacucuuuuuuuuuuuuuuugagacagucuugcucuguugcccaggcuggagugcaguggcgcaaucacggcucauugcagccucaagcuacugggcucaagcgauccucccaccucagccuccugaguagcugagacagcaggugaacaccaccacacccagcuaauuuaaaaguuuuuuuucagagauggggggaguuucucacuauguugcucagacugguguugcacuccugggcucaaucaauccuccugccugccccagccucacaaaaugcugggauuacaggcaugagccaccacgcuggcuuuuuuuuuuuuuuuuuuuuaacacaaaagcuuauuuaaaaaacauagauuguacagaugugaaugaagaaaacagcacaggacccugugaauguccugcucccuuucacgggagguuguggcuaacacuuucugagcauuagagugugccaagcacaacucccuacagcaacuccaugaggaaggugcuauugucuucccucuacagauuaggaaaccaaggcucagagaaguuuaaugccuugcccaaggucgcacagguuguaaauggcagagccaggauuccaccccaggcgucgggcaccgacgggcuuuggccguuugcugaacugcuuauucacaaucuguuguguuucucuccuggcccucuuauaugcauggcagagauacacacgugccugcgugggguuuggauuuggguggguucaggggugugcuggcagauguuuaacaucugucucugggggaaaaaagcccuaaugccuagcguuuuccagcuuccauggcguaaauacuccuaccaugguuuauuucaagccaccaacaugaugucaccaacauggaauugggaagagaggcacacagucgcucucaggagcuggugugagcgggcuccagcacaccgcugguugaguuguuuuuaacaaaagcagaguuguaauucugagauucauucgugucagugcagagagcucuaccucauucuucuuuuaaaucagccacauagaauuucaugguuugaauagacuacaauuucuuuaaguacuccucuauugauggauauuuagguugucuucaaauguuugcuauuacacaaccuguugcaauggcuuuccuugaauaaguccuugcacgccuggaucugugcucucuaaggagauucuuagauguagaauugcugggucaaagucccggugaaccuuucugagaccagugucaauugcacucugagaaagaggcccugguuuagacucccacuaaaauguaggagucugucucuccacauccccaacagcauuggauauuauaacuauuauuguuacuugaaggccaggcaugguggcuuaugccugugaucccagcacuuuggaaggcugaggcggguggaucaccugaggucaggaguucaagaccagccugacuguggugaaaccccgucucuacuaaaaauacaaaaauuagcuggaugugguggcgggugccuguagucccagcugcuagggaggccgagacaggagaauugcuugaucccaggaggcagagguugcagugagccaagaucgcaccacugcacuucagccugggugacagagcaagacuccaucucaaaauaaauaaauaaauaaauaauacaauaaaauaaaaauaaaaauacuauuauuugacacagaaucuugcucuguugcccagacuggaaugcaguggcgcaaucauggcucacugcagccucaaccuccugggcucaagugauccucccaucucagccuccugaguaguugggacuacagguuugugccaccacacccagcuaauuaaaaaaaaauuuuuuuugguagaggcagggucucacuacauugcucagacuggucuucaacuccuggucuaaagugaucaucgcgccucggccuuucaaagugcugggauuuuaggcuugagccaccucacccagacagcauuaaauauuauuaacauuuuaaacuuuugcuaaucagauaagggaaaugguaucucauuauuguuuuuauuuucauugcccucauuacuagggagauuaaaucuuuuuucauuagcauauuggcuguuucuauuuucucuguaauugcucgaucagaccaugugcccauuuuucuguugcguuguuuaucuuuuucuuauguugauuugcgggagaaaagcucuuuguguuuuacagcuauuaacccuuuguuaguuuuugcaaauauuugcuuuggccugccauuugccuuucacuuugcaguauagaaacugaaaacaaauuuuuuguuguuguuguuuuguuuuguuuuuugagacagaguuucacucuugucgcccaagcuggagugcaauggugugaucuuggcucacugcaaccucugccuccuggguucaagcgauucuccugccucagucucccgaacagcugggauuacaggugcccaccaucaugcccagcuaauuuuuguauuuuugguagagacgggguuucaccacguuggccaggcuggucuugaacuccugaccucaggugauucacccuccuuggccucccaaagugcugggauuacaggcgugagccaccgcgcccugccuaacaauuuuuaauuuuauuuuuauuuaauuuuauuuauuuucuugagacugagucucacccugucauccaggcuggagugcaguguuacgaucucggcucacugcaaccuccgccucccggguucaagccauucuccugucucagccucccaaguagcugggauuacaggcgccuaccaccaugcccaguuaauuuuuauauuuuuaguaaagaugagguuuugccacauuggccaggcuggucuugaacuccugaucucaagugaucagcugaugcgccucagccuuccaaagugcugggauuacagaugugagccacugugccuggccgaaaacaauuguuuaaaaugugaccaaagcuguucaucuuuucuucauggauucugcaucucauguuuaggauggccuuaggauuauaaaaauauuuucuuacuuuuuccccagugcuuuuauaauuuucacaguuggcucugccgugugauugcauuuguguauugugagcuagaaaugauccccccgcccccgaugguagccauuugucccggggacaucuguugaggcccccauccuuccccccgauuggaagugcugccuuuaucauauaauaaauauccauauggcccgcuuccccccuuucuagccuuaacauugcucugccuuuucugccgugccagccggcuucaguugugccauccauucgggauguuucagucccugguagggcagauccucccgcguuacucuuucuuuaaaaacuauuccuggcugucuuugugcguuagcucauccagaugaauuucagaauaggcuuaucauguuccauuuuuuaaagguccccauggacuuguucugaagggaguugggguaauccuugguggaggcugucugaagccccuccuccucuccaggugcccuucucuucugaccugcugaaccuugguguccauguccuggagacgggggcagggaccccuuuucugggaucagcaugcagcucagaugguauugccucccaaaugaacacagcugggcuaccccaggucaggugcacacccgaguguagcuguggugagugcagcuguggugagugcagcugugguggguguguucacauacacaagaggcugucgcccacgcuggagcccccgaacuggaggaguucaaaacacagcccucccagcagggcccuuggccgggagaacaggggaaggcgcugcccccaccucucuaaagagucuccgcuguguucuagacaaauacaacgacuucaucgaggccaaccgcauugaggacgcacgggagcgaaugaggacgcugcggaagcugguaaggagagagaggugcugucagacacgagguggggcagcugccugagcaccucugucccaggaggcagggaguccggugcugcccacgaccccuguggccuuggagaagccccgcuccacucagggccucaguuuccccguccauacaagagaacgggggguuagaggauagguuccagacucccugaggcaugguagugggagaucuuuggggcauggugaugacgggggacaggggcaggcccuuacagccuguccccaugccccuccucucuccugcucagauccgggaucucccaggacacuacuaugaaacgcucaaauuccuugugggccaucucaagaccaucgcugaccacucugagaaaaacaagguggguaggagucccgcauggagucugggggaggcaagcacggacuuacugugugagggcccucagcacgcacugagcuccagcagguccaguaacucaggccccucuaggcacgcccuccuccuaugacugcuccguccccaccccgcuccuacaugcuggucagugcuuucccccagagagccaucuccugaguuucugagggcuuuccagaggcagggaaccccggccccccguauccgaugcauugccauccuccgacuuagcucaagucccucgcauugcauuuuccucaucaaaccccuuaugccuucugguucugcaguggggaaaaugaggggagugauaggauuuuuuguguuuuguuuguuuguuuguuuguuuugagacgaagucucacucugccgcucaggcugcagugccuuggcacgaucucggcuuacugcaaccuucgccucccggguucaagcgaugcuccugccucagccucccgaguagcugggauuacaggcaccuggaagugaucggauuauuucccaggccuaaaauaaccccugggaccuccaacauguuuccuacugcagggucucccacugcuggcacugaccacucagggcugccuuguauaggugugcagguugggcacugcucauggcugcugggccuggggaugaaaggggcugaaaucuggucugugcucuacucaucaagcaucuccaugcccauacaaggggguguccacccucuaagcuggggacuggugaggauguaguuggggacagaggccucaggugccagagugagggaggacugaggucaggauguugacagugaccugcuuucccugcugcccagauggaaccccggaaccuggcccuggucuuugggccgacacuggugaggacgucugaggacaacaugacagacauggugacccacaugccugaccgcuacaagaucguggagacacugauccagcacguaagccccuguuccggggggcgcccggcagccccuggggcccaggccauguuccucugagccccucgcucuugcuccgccuggcggagugugccccaggaagggcucggcagcuuuagagcaugcugcuagggugguauauacuccuccaaagccaugggcugcauuucaaggcaaggcaggaauggauccuggaaucccugcugcccugggauguuguguccccagcaggagagucaagaggcccccgagcuuccgagaugccugggaaagguagaagaggaggaagggcagggaaggugcuacugguggagggcggaaggggcagcuucagaaguuggccccuggagagguguccuggcagacacgagcagacgggggccaaggucuggccugauaucaggaggccccggcucuagugacuuucccugcuggccccacugagguuuuggggagauaguggugauguuccugguaacaagggguggauggggcagggcacagggccuuggccugaggcaggauccugcaccagugcuuggcauguacugggcuggccaccucccuucucauggcuuccuggaugccaacagcccugguccuguagguucuuguuacugugcaugggcggaggagaacccagaguggccagcagagggcgcagaaggccuugguuuucgagagcccaacccuaaggcagcacugccgccuucuggugugcacacggauaucauuaugaaucguagauuuuccauuuccaauucuuguuacagcccacaaaggaugagaacagagccccuccugccaggggaaauaagacuggcagcuggucagaggaagggaagccucagucccaagcccccuagacacuuuagggaaggaaagcugggcccuaucacccccauuuuacagaggaggaaacaggcucagagaggcaaagcaacuugcucauggucacacagcuaauaaguggcagcccaagauuucaagccagaucugacuaaccaaagccugugcuuuccuccugcuaucaacccaaaggccagacuccugggucccuccuugagcuggcuugggacggagggagggggccaggguaaggaggcgagguggugagcagcugagccauguuaacagccuugcuugcccaucucccuccuucacugcaugcucagggcuccgagccacaggagggaagaucacagccugcugcauccggacacugggaacaccacuccagagcugucugggaggccagggcugcccugcagcgucggggauccugaugaggccuugggaaagcuuagcucuccagggcaccagggagccccggaaccucccgugaggguguguuuugggggcagcagcagggaagaaugggugucuggcccugugcuccuggagaagucccuggaagcccaaggucugaggucagcugaggugucaggaacugcagccuucagggaggaaggaggccaaagccccaagggggagucccugcucugggcaggguggagaagguggaguuugucucauuuagcacugacacuacuggcacacaguggcuacucaguguuuguggaguauaaaugacugaguaaauugcuaauugagguuacgucaggcugggcuuuucuuucucuuucucucucucucuuuucgcuuuuuuuuuguuuuuuuguuuuuuuuuugauagagucucagucugucgcccacacuggagugcagugggcagauacggcccacuuccaggcucaggcgauccugccaucucagccuccugaguagcugggacuagagaugccaccaccacaccaccuggcuaauuuuuguauucuuuuguagagaugaggucuuacuauguugccagggcuagucuugaacuccuggacucaagcgauccucccaucucggccucccaaagugcugggauuacaggugugagccaucacgcccagccaggcugggcuuuucuacucagagauucauucccgagagcuaacugagcuaguguccuucccuucucugccuccuuggcaucugaacguaaccagcccuggaugauugucgagggaaugagccacccacucugcaagcccugaaagccugcccacccaagcgugccagcucugucuagccuggaggcuccauagccagggcagugcugcugucacuugggguacccagaccagucuucaggucggaaagagcguggcaacugagggguaaagaggaacagcgacuugcccagggccacgcagcaagauaauggcagagcagagaggagagcaaaccugggugucugaucuugcagcgggcaaguugccaggagccccuaccuauguuuacgaagucaaauggaacccaaacaaagaucacccagggcauuugcucagggacucacucagcaaaggcagcgauaccuaauguuucucagccucagcacuagugagcgcugggguccagauaagucuuucuugugggaggcuguucuguguguuacaggacauuuagcagcaucgcuggcuucuaccugcuggaugcugggaauaucacucuaguugucacaaucgaaaaugucuccagacauugccaagugcccacugggguggggggauugacggcaguggcucuggggccagccugcuccuaugugcuguguggccuuggacaaguuccuuaccugcugugccucagucuccacaccuguaaagcagagaugacaauacuguuuaccucacaucguugugaaugucugcuaaagcacucgcggcggugccuggcagguccuaagugucgugugagaacggacugucauccucuucgucguggucauuauuccacgccagagacagauccccgugcugggaacacggaggugaaugggagccugcucagaaggaauauugccagcgggugugguggugcgugucuguggucucaacuacuuggggggcugaggugggaggcugcagugagccgagauugcgaaacugcacuccagccugggugacagagugagacccugacacacacacacacacacaaaaauccauuaaaaaaaugaugcuucucauucauuuauucuuuuaauaauguuuaucaaaguaagagcugcgucucuuugugcucugggcuaugcccaaggaagccccacagaaggacccaccccggcccugggugcagggcuggggucguagucauggaguucuugaacugccuuagaggaccaugaugagaacuuagccaggcagagcagggagaaagggcaucccaggcggaaagaacagcacgugcagaaacaggguggcaggaacuaguguggauuccucuugagagccguggccacccgggcgcuuccuguagacgcuguggcuugcagaguacuucugggcaccuuccaaccugcauuaacggcuggcuucuuugggccgauccucaggcuuccccuggucagccugucucuggaagccacacuuuugaauagcaguagcugacaucuauuauacauuaacaaugugcugcacucgacguuuuccauacaguauuucaucucaauccuccucaggccuagaaggagguacucacaucaugcccauuuuagagauaaguaaauagacuuacagagggaaaguaacuuggcuaaggugaacuugaaccaagaugacugacuccagagcuuccauuuuucuuuuucuuuuuuuuuuuuuuuuuuuuugagacagagucucacucugucgcccaggcuggagugcaacggcgcggucuccacucacugcagccuccagcuccugggcucaagugauccucccaccucagcacccccaaguagcugggauuaugggugcaugccaccaugccgggcuaauuuuuguauuuuuaguagagcugggguuucacccuguuggccaggcuggucuugaacuccugaccucagcugaugcaccugccucagccucccaaagugcugggacuauaggugugagccacugugcccggccagagcuugcauuuuucuuaucuuccuuugcugucuucucuucuaucucuuucuucuuucccuucuggccuuccugugcuguuugaguuaaucacaugucagaucaugagcgauaauaacugaggcucauggcguaugcucaggcaaguccccuuguuuccccucuucauuccccuaggugcccacucuuaauaggcuaauauguguccuuccaggacaccuuccacuuauuguaaaugcauggcuacccuuaaauauauauaauauucuuuguguguuuuaagucuacauaaugagauuauaaauugccuguuccucuucuuucauagguguugagggggguaaaggguaauugccuuaauuuuuauucauuuauuuuuuuugagauggaguuucacucuuguuguccaggcuggaguacaguggugcgaccucagcucacugcaaccucugccucccggguucaagcaauucccccaccucacccuccugaguagcugggauuacaggugcgcacaaccaugcccagcuaauuuuuauauuuuuaguagagaugggguuucaccauauuggccagguuggucucaaacuccugaccucaggugauccgcccgccucagccucccaaagugcugggauuacagaugugagucacugcaccgggccugucacuaucaauuucuaaugcuuaucaguuucugugucuuccuuccaccacaucuaaaagccaaaagugguagggugcaguggcucaugcuuguaaucccaaaaucuacaauuuuuuuuuuuuuaauuagcugugcaagguggcacaugccuguagucccagcuauucaggaggcugaggugggagaaucucuugagcccaggaguucaaggguacagugagcuaggaucaggccacagcauuccaaccuggauaacagcgagagacccuaucucaaaaauaaauacauaaauacaauaaaagccaaaagugccuuaguuauuucuuggagcuugccgaaggucaucucuuuacuugcucaaguauucaguuaagagagucuuuguguaguaaauuuucugaugucucaggauagcuuuauuucaaggccaggugugguggcuccagagagcaggagguucacuuaaggggugauuaaaacaaucugugguaugccuguaaucccagcacuuugggagguggaggugggcggaucacuugaggucaggaguugagaccagucuggccaacaugacgaaaccccaucucuacuaaaaauacaaaaauuauccaggcgugauggcgugcaccuguaaucccagcuacuugggaggcugaagccagagaaucacuugaacacaggaggcagagguugcagugagccaagauugcaccacugcacuccagccugggugacagagugagauucuguuggaaaaaaaaaaaaaagaauagcuuuauuuuacacucagauuuaaaugagaguuuagcaggguauaaaauucuagguuccuucaacacgucaaaacuuacuuucuugucuucuuguguuuugcugcugaaaguuccaaguaccugugauacguguucauuuauaagcaaucuggauuuuuuuuuucagaaaacuuagaauuuuaucuucaagauucucaaauuuuacaaaauauauuaaacugugggggucuuuauuuucucucuuguuuggccuuuaugagaaagcucucgccuccugccccucaggaaaccuccaacgccuuucuccugucauuuccuuuucugggcugaguacgugacaccccuguugucaguguggcacccauggguggcagguggcguggggcacacucggcugucacagccauggaccuggccaacacuaauggcacuggugccucccugccccccggcucgcuguggggaguauaccacaggggugugcccaggacaguguuuagagaaaagcaaguaaaagcgaagcucucccuaagccuaucuccugucugaggugaaugcucccacucccugccgugucuccucccacacuggggucccaccuuuucucucccccaggguuuuucauagucuguggagucagguuuuaggguccgucaagcucccucugagcccucuuuugcagccccgccagccugggguuuguugagagagaggcgccccuugccaccugagcggguccucuggaaugagcagguggaagagacucuucuuucccaugcugauuucaucccuuccuuuugucuucucugcagucagacugguucuucagugacgaagaggacaagggagagagaguaagugaugccgcgggcugggcuggcaugggggcuggucuggggugagccccaguccuuggggguggggcaggcagcgggacuuaagccggggaaggugucuguccuugaggcuucccucaagucugguggaggaaacacagacccucuccucaggagccccuagucugauagagaagcacaaagcuugccuucaggaauccccagucgaaaugggggagauauaggccuugcucagagggaacccaguucaggaguaaaggcagcuccugcccuccaggcuacugagaaggacuuagguuggaggaguuccagucuggugcgggagacacagcuccugccccuagcugaaggggccgcucuggccuucgcgguucccagguguugaggaaggcacaaaacugucuaauaggggacauguaggaaucauccucaagagcgcccggcugaugagggagacggucccugccccagugagcccggucugauggaggagacaugggcucugucaucagggcaccccccucugggggguuggcagcccagcaucugagggcaugccagcugaccccuccuccuguucgcagaccccugugggcgacaaggagccucaggcagugcccaacauugaguaccuccugcccaacauuggcaggacagugcccccuggcgacccggggucaggugagcgcaggggccugggaguggggaggcgggagguuggacacugcauuccugagggucccaggugccuggccagaugcccagcuucccugugccaccccagcggggcccuccccugccggccaccauggagauggggcuguugggggccuucucccucccuagggaaguccagcuugccccgugcccaccuccugucugcgcagcugccccgccccgggcagggucggagcuuuguucgcccucucucacugguuucuuuccucagccuuuaauuucucaugggcuggcuguguccuucugggcauguuccucuuuuuaauuuuucuuccuuuucuccuugcacccccgccucucccuccucuucuccccgugcucuccucccacccccuucucuucuccucccccuccccuccuccagcggaccuguuggagauuuaaaggguacagugcggugucgcggccucggucacuaacaguggcgggugauuauaagaaggcugggugggcacagcggcaggcagaaugucccggacugugaggaccccacgcugacaugccaguuaccccugccuguuauccacuuaccccagcaguccaugccccucccauucuaaagccccuucucaggaggaaggaggcacucacugggcccagggcccuccccguugccuggacaccugggcaucgaauugcugcccuccugcagugccacagacccugcggccucucuuugccgagucucaccacugcuagucauccaggcuggggaccgacacucucuggagaccagcgaugccacgcccagaagcuucucuuuaucucuaacuccugccucagucaccccaaugggccgccucuuccugcuuaagaaaccggggcccuaaguccuguuugcagggccuguggcccucucauggcagaggacagaugauuuacaugcucagagacagaugagggccacucccuuuguggcugcagccacugacuccuccccccgccaugguugucccucccuuuaguuuuagcauuucuguucgucucugacagaggcacacaggagcucccuagucaccagaggcaggcucaggaggggccagaagacaugggggugggacggcagagagggaccccaugucucuucuaaucacccgccgccccccgcgcccugugugucguguguggucgcccaucuugcuuuucucaccuugugcagggggagggguccggagaggggggcgucuaacuugccugccagagaguguggauuaaccgcaccugcccacuacccugugggaccccaggaggcccuuggaccaaccugcuccuucuuuagccuuggaggggacccaccaggacguguuucugguuccuucuccaccccagugauauuaagggagugggacccaagucccauagaaaucaugcuuuuggucuccuucauaacugggugauaacuggggacccugcccaugaggcagggugaccccagguccggagguggaaccuaucaaggcucuaaucaccagcccacuccaccuccugcgucccacccacuucauuuuugcccuuuuauccauuauucauguggucccucuucucuguugugugcucggggguggauguagggcacccaccucucugugcacuguguggucuccauuucuccagagcaucugugauuugcuguguuucacuguggugguuuccauggacugcaccugauauuuggcauuuucucuccagugcuucagaguaacagggacgggcggggaaggggagaggaaccaggcucaaagacaaugcccccuugcccuuagccaucgguaaaugaggggccaguggcuggcagccugaugucacuuccugccucuagaggaaguggcaguuaacaucauuuucuccuccaucccucucccauagauggacaucagauguccaucauacuccuagggccuggggagaucucauguuucagaauucccugguuucugaagccuuugaggagagggaauugugugcauaagacucagcuuucuuuuuuccugaugcaacuuucauuuuuuuuucugucuuucaccaacagauucuaccaccuguaguucagccaaguccaagguacguaugaaggcaauucugaaggcuugaucccuguacaaggcagcccacuuugguuuuuguucaagggaauugagggaauggcaguuggaccauggggaaaguugauggucccugggagggaaggcaggagguaccgagugcccaagguaagcugagaaauugcuuaccuuggcaguguuuggugaggcaucugcuguaguagaaggaccuggccugggaguuauguggcuaggaggcaaugucacucaguaguuagaagcacagacucugcagucagacaguccuggguuugaguucuggcuccaccauuuaguaguuugggacauugggcaaguuacuuaaccacuuucugauccuuagcuuccucaucuauaaaaugggaauaucaguaaaucuguggggugcuauaauaaauaaaacagauauccuuuaaggucuuuggagagccuaaagcaagcagaaggaaauaaagagaggagcagaaauccaugaaauagaaaacaguugaaaaaaagcaaugaaaccaaaagcugguucuuugaaaaaaaaucagugaaauugauaaaccucuagccagacuaacagaauaaaaagaaagauggcacagauuaucaguaucagggaugaaagagggacaucacuacagaccccuaaguuauuuuuuauuuuuuauuuauuuauuuuuuuugagacggagucuugcucugucacccaggcuggagugcaguggcaccaucucggcucacugcaagcuccgccucccagguucacaccauucuccugccucagccucccgaguagcugggacuacaggcgcccaccaucacguccagcuaauuuuuuguauuuuuaguggagacgggguuucaccagguuagccaggauggucuugaucuccugaccgcgugauccgucccccuuggccuccgaaagugcugggauuacaggcgugagucacugcgccuggcuauagaccccuaaguaauugaauuuaugggcauaaaguugcccauaaauucaauaacuuaggugaaauagaccaauucuuugaaagauucagacugccaaaacucacuuaagaaaaaauagauaaccugaauaguccuauaccuccuaaggaaauugaauauguaauuuaaaaucccccaacaaugaaaacuucaggaccagaugguuucacuguuaaauucuaccaaauauuuaaggaauuuuuuaaauuuuuaaacaauuuacuuuaauaauuuuaaaauauucuaaauagaaaauaguauaauuuuaaauauugauauauuuaaauaguuauuuaaauauuugaauuauuuaaauguuauuuaaauaguuauuuaagaaauaauaccaauucuccacuaucucuuuuggaagauaaaagaggguggcugggcaccauggcucacgccuguaauccuagcacuuugggaggcugaggucggaucuugagaucaagaguuaaagaccagccuggccaacauggugaaaccccaucucuacuaaaaauacaaaaaaauuagcugggugugguggcaugcgccuguaaucccagcuacucaggaggcugaggcaggauaauugcuugaaccugggaagaggagguugcagugagccgaggucgugccacugcacuccagucugggcgacagagcgagacuccgucucaaaaaaaagaaaggaaaauagaagaggaggaaacacuuuccaacucauuuaugaggccagcauuacccugauaccaaaaccuaacaaugcuuuugaaaaagauagggcuaauucauuugauaauaccacaaauacuuguugaacgucuacuuuauaucaguacugugcuggguacugaaaauauaaauaaugagccaaacagauagguuccugcccucacaaagcuuaucuucuaaugagagacagacacuaagcuuaugaagaaauagacuaucugucuggcagguuuggaggcacaguggaggcagaaaccagauggaaugagcuaauaaagugagggagggaaaagcgcauacguagaccacucuugugagaaguccgauugugaagagauauuuacagaacaaaaauggaaaaauauguggcuugagggaaacuuucauuaaaagaugaaagcagccaggcaugguggcucacgccuauaaucccaacacauuuggaggccgaggcaggaggaucccuugagcccaggaguccgagaccagccuggacaacauagugagaccucaacucuacaaaaaaugcaaaaauuaaccaggcaugguggggcaugccuguagucccagcuacuugggaggcugaggcaggaagaucauuugagcuugggagguugaggcugcagugaugagccgugaucaugccacugcacuccagccugggcaacagagcaagauccuaucucaaaaacaaacaaacaaacaaacaaaaaaagacgaaagcacauauuuacuugccaaugggaaugauccaggugagagacagagagagagaggaagagcugggcccagagcccgugaagcagcaguagccugugcuccuagcagaugcauccccagguguaguaggaagagagggagguggcaggggcacacuggcaggcaguguuggcagcaggucauuggggucacucccagcugauggcucuuuccucagcgaaguggaaggugaggaccucugcugggcgugaagguggcagggaaagucugagcagagugaaggaagucugaaaugggucccaugaagcaaggcagauuuccugaaggggccgagaagcaucaugggcaggccgaggccucugaaggcugcggccccuucucgagagccagcacuuugcccagcagccgugccccgccccuuugggccuggcuucuccacacuccccggagagccccuucugagucccuucuggccagaagauguccucauuugcuuccugugaccccaccgugucuccaguggacucaacacugaccuccccagagcucacaggccacugccucccggaagccuccuggcuugaaauuccuuccuccugagacgcuagcaguuaccgcuucccagucugggccugccugacuccugcauuaaccugggaacuccugcaggaggccuucucaaucacagggccuugaacaauagaacgugcuuuucagagaguacgucuuuacuguaaacugacucagagacuucacugugacccagugaguucaucacaaucacuagcaugagaugaaagaggagggaaugcacauuuacugagcaccuacuaggugccagccaguaugcagauaacuuuucacgaacaucgguuucauuucauuuuuacggaagacccuugaauuuuguaccauccccauuuuacagauguggggaaccaaggcucagagaacuuaaguaacuagaaguuugggcauauucuugggccucaggcaggggagcugguuagguggccuccuuccuugguuggugcucugguaucugaguucugauccucuguucucaggcucugaguguuucuugauuuucuggcacagggacuggcucuguccugagccugagcugaaaccaaccggccaagccucuaagaaacggaggcacagacgaggcugccggucuauuaaguacagcgauaggaauaacuguugcagggacagggacguugaguugugugugccgcaguggucucagucucaucuacuggggagaccaggaaucggagucagggaagcaggaggcaccaggcaucugagagccugcggccuccugucccggcuguaaggaaggggcugccucgggcaccagggccuggccucccgccaggcugugagcucugagggugggcacaaauccugcaagugccggacauucacgacugccagccucugucucucuugccugacucuaaaacccaggucugugauggucaaacuguguucccuggagccaccaugggguugugaccaccaacagguguaugacaggaccaagcgugcagggauccaagcucccacggccuccaucugagccacucuugguucugucucacauugcugggucucuagggaggauucgauuuggacagagugcucccaagcucaucagaaaccauuguucuagaugugacaguccugucuguagacguucuccaggcuguguccaggacacccaggcggcgucggugccccaaguuacagccacauucugaucuugccucccuguguggaugguuuaggcugucccggguaggaguguggccaggcacacauggcagucucucagcuccgugguggguggaguggagcuguucauuacucagaagccucccuuaucaucuuuuuuuuuuuuuuuuuuuuuuuuuuuuuuuuuuuuuuuuuuuuuuuuugagacaggucuugcucugucacccaggcuggagugcaguggccugaacacagcucacugcagccucuaacugcugugcucaagugauccuccugcuucaaccuccugaguuagcuggacuacaggcacacaccaccacuccugccuaauguuuuuguauuauuuuguagaaauggggucuugcuucuuugcguaggcuguucuugaauuccuggcuucaauggauccugcugccucggccucccaaagugcugagauuacaggcaugagccacggcaccccacucuccuuaucaucuuaauuccaaguucuugaggaaggggaccacuuuugucuucucugguggucccucaccuacugcuuagcuuucuuuacagccugcaauaauccccgagcacccccacugguacagggagaagucuagcuccugaccaggcucugauuuccccggcccugcccuauucaaguuccucaaauuccuugaccccaacccuugccccauaagaaaccuccccaugacccugacccugacagagaacuggcugugaaaauuuuugcauugacaacagauauuggaaugcagggauucccuaucuacuucaggcaccuucaagaaucagaggaggccaagcaugguggcucaugccuguaaucccagcacuuugggaggccaggguggggagaucacuugaggccaggaauuugagaccagccuggccaauauggcaaaaccccgucucuacuaaaaauacaaaauuagcugggggugguggugcacgccuguaaucccagcuacucaggcggcugaggcaggagaaucgcuugaacuggggagguggagguugcagugagccaagauugcaccauugcauucccagccuuggcaauagagugagacuccgucuccaaaaaaagaaaaaaggaaaguuaugcacucuugcuccagaacgacaccuaucuacacaaauccuguggcaaguucaaggaguuuauggacccccaaagccaacccagggacuccaguuaacagcaccuucuccagaguauuccggcugguaauuagcuuguuuggcagaaggugucaguccagcugucaauaaugccuuuggucaucgcugauuccuaaguuuaaaguauucaacaauaugaauaguuacaauuuauugagcauuugcuguguuacugugcuuagaauuacuaauccucacaaaugcccugugaguuagagauaaaauuguccuuauuuugcaguugaagaaacagaggccagaagagcuucuguaacuugccccaggucucacaaccagcaagucgccugcuccagagccuccccugugagacagaacccguuaggagaugaggccugcccugggugacccugcccggcugugagauuagagcuugagggcaggguguguauaaagucaucucaggcugcuguaauaaaaugccauagcuaggugccucagacaacagaaauugauuuucucacaguucuacagguuagaaguccaagaucaaggugccaguguggcucauuucuggugaggguucccugccugucuuguagaugguagauggccaccuucucacacuguguccuuacaaggcaaggcagaaagaaaagagagcgcaagagagcccaagcccucuggugucccuucuaauaaccgcacuaaucccaucaaaaggucccaccuucaccuaaaccuaauuaucucucaaaggcuccaccuccaaacuggggguuagggcuuccacaugugaguuugggagguacacgauuuaguccauagcagugagugaaaccagcugaugacuggcugguggaacugggcucauuucugucugggucucugagcacugcacuggccagguuuguaagcccacuccacagccaugugcuugacaccuggcaggugcuccgugugugucggaugaauacacuggacaaaagaaaaaaaggcugugggcgcaguggcugaugccuguaauaaucccagcacuuuggaaggccaaggugggaggaucacuugaggccaggaguucaagaccagccuagccaacauggugaaaccccgucucuacuaaaaauacaaaaauuagccagguguggugguguaugccuguaaucccagcuacucgggaggcugagucaugagaauugcuugaacccgggaagcagagguuacagugaaccgagauugcgccaccuacacuccagccugggugacagagggagacuccgucucaaaauaauaauaauaauaauaauaauaauaaugcucuagccuggugcaaggguccccuguaagcucugcauggagccccugccugcaccuggacaccucuggugacagagaccuccaucauaagauugcugugacagggagaaaguucauuauagugaccuacauccagguccuugucacuuccguccauugcuccugcuggcccccugcuuuccugcaguauauccuggauuaacucccugaucucucugugaaucugcugaccucugcauuccuuggaagagaaaucagucugaccucguugcuucuggaaccagcugggaugagaggguaguuugaucaggugauccuagcggccucuuaagucucucagagagcacuggccaggaaagaaagcaguacuggccaccauaugcuccaggcugauccuagcagugcaaccacauugcacaacuccagggggugccuucugguguugugcauugugggcaaccauggcccaggagccacaugccugugacuccugagucccugacaugcucugguuuucucagaacuaauuaaugugagagcaaggacaguggcugcaguggccacaagaggcaucugggucuccauucauuauuacaccauggcugaaacaagagguggucugugaggagggguugaaagggcagcgugaccuugucaggucauuccagcccaagacaggaaccagucccagcgucugcuucuacaaggcuuccuguguuaaggggacuucauucaccaauuguuuguucauuucauguuuauugagcaccuguuaugugccaugcagaaacaaccaagucacagccuuugcucuuaaggagcucagaguuugaugaggcugaugugagaagagcuaggagcauagugagaugacaggaacauagagaagugaucucccaucucaggcaaagggagggcugggaaguggcuguacagaggaagccauguucgagcugggccuuguagggugaguaggagcucauccagcaaauagggcagggggacauuaagggcuggcagcaauguaacaguguaggucacaucaaaggaaggguugguagggcuguauuuccacagugagggcuguguugggguuggggucagggcagagcagggcaguaggcugggaaaguuggggcuggguuaugaagagccccaugugcugaacuggggaacuugugcuuuauccuggugggugcuggggcaugcaagcuucugagcaaagcugggugaggaucagauuccugcuucagaaugguggcucuggaggagagacccgggcuggggcaaggguggaggcaggaaacccuauuaggaggggcaggagggcccagagagggcagaaugagggccugccggaggaggaggaggaguuggcuuugggagccauuucaaaagaauccaggacuuggcuguggguggaggagagagggaggagucacaagaccgcccuaaggugagcagugugaauggaggcaguuuggggcagggguagguaggaugcugugguuccggauaggugaguuuuaagagccuacagacacccagguagaaauggauucucaaugggaagaagagucccggagcucaagugagugugguguuggacagggaggccuggauagcagcgcugcuugggaaugguauuuucuagggaacacgaacagagaaggcaaaggggccaaaaacaguccugggaacacugagucucaguggggaaggcaggggcggggcggggggcgggcaagaagaaccucccaagaggcagaggagaggccagaagggcggaugaaaaccagcuuccagaaggccaugggcggcagcaugggcccuccugggaaagugugaaaggccaaggccccaaaacaccacaggguguagcagugagggcugguucaggugagaacagcggcaugaaguugcccaacuugggguuggaaaucacaguuugggagcggcuccaauccaaaccaugacaccauacgggaucuuucagccacuugcaggggcggagcuggcggcgggauugaccugggauuggggauuggcgggguggggagcuggugggguccggcggaaaggggaggacgugaacuugggcggguugcccuggagaggccuguagaugcugggcaggugggaaggcagguuuccagguggcagcggguggagaggaggugggggacuuguggucagagagcgccccuggcggggauuuggggaucagcaugcaggaagcucuggugaugacaccccaggggcgugugugaaacggauucaggcugccaagcguuauucacuguggagagauugucaucaccagagccgugucuaaaggauuuagccagggcuggauacggaaaacagaauggaagggggcuuugggagaccagcccaccucacaagaaagagcugagagccuagauuugggccagcggggguagucucuggacggagggcggcacggggcuggaggaggagcguuuuaugaugcggccgugggugcuggccuuggcuggggcuuguggcgacugggugccgugacguggggguggaccggguagagcggggucggcagggggccgaguccgggcgccccccgcauccugaccugucucccacacaggguucgugggcccccaagaaggagccguacgcccgggagaugcuggcgaucuccuucaucucggccgucaaccgcaagcgcaagaagcggcgggaggcgcgggggcugggcagcagcaccgacgacgacucggagcaggaggcgcacaagccuggggcgggggccacagcgccggggacucaggagcggccgcaggggccgcugccuggcgccgucgcccccgaggcccccggacgccucagucccccggcggcgccggaggagcggccggccgcggacacgcgcuccauugugucgggcuacuccacccuguccaccauggaccgcagcgugugcucgggcgcuagcggucggcgggcaggggcgggggaugaggcggacgacgagcguagcgagcugagccacguggagacggacacugagggcgcggcgggcgcggggccuggggggcgccugacacgccggccguccuucagcucgcaccaccucaugcccugcgacacucuggcgcgccgccgccuggcccggggccgcccagacggcgagggcgcgggccggggcgguccccgcgccccggagccgcccggcucggcgucguccagcagccaggagucgcugcggcccccggcggcggcgcuggccucccggcccucgcgcauggaggcgcugcgucuaaggcuccgcggcacggcggacgacaugcucgccgugcgccugcggcggccgcugucgcccgagacccggcggcgccggagcagcuggcgccgccacaccgugguggugcagagcccgcugacugaccucaacuucaacgaguggaaggagcugggcggagggggccccccggagccugcgggcgcgcgggcgcacagugacaacaaggacuccggacucagcagccuggaguccaccaaggcgcgggccccgucguccgcugccucgcagccgcccgcgcccggggacacggggucccugcagagccagcccccgcgccgcucggccgccucccgccugcaucagugucugugauccccaccucccgcgccgcucgggcgccaccccucccuagagccccuuuggaaccaggaggcuucaccagccugcaccuccucuucuguggccccugggugcaugguguggguggagggcgcagcaggcagugucucuaguuggugugcuggaacuggcagggcagaggagaaggcuggggccggacuaauugaauggaaggggguuccagaggugaugagcagaagaggagggggcgugggcugcuggggucugugucccugcacacaugcgcccgauagguccuucugagccuuucuguggcugcacuuggggacccuuguggaccaugggguguggcuagggaaccccuaaguuucagacuaaaggaaagauccugggugaugcuggcuuuuugcuucuuucuucugcccucccaccucagcuuguaagcggggauguguguaugucuggggagaggagguguagggugcguauguccauggggggaggggcuugugugugcagucauugucccaagguguuuccaguagcgacuucugucccccuauccccacccugguccccacuuugcgcccccgggcucccugccuuuggugcacacaggauccugcccgccccccuugccagagccagagaaggggguuggggccauuccaaggaggcaggacugaaacccucaccaggguuacuccccaacauccuuuugccugagucacccucuaagcgcuuuaaccacgggcagcugccuguuccccagacaguuuuuggugggggggguccagggucccccuugcugguaccucccucaccccucuuuuuguuuuuccaucugugccuguuccuuccacagcccaggcacacagaagcccaccuucuuccccuuaggaggagggauagucaacaccccugcugucucucugucacucacacacugauuuauggggucugagcugggcuguuccugcaggauggacaggacccagcgcccucuucuccccacaggcuguaaauagacuuccaaucaccaggccagcccccacacacccucacucauuccagggaagcccagguagguggugaacccgcugccacgucuaucaguccucuuguuuuaugcaaagauuuacuguaaaguagauuucuuucccucccucccccauucuuuuauuguaaauauugucucuaaauguguaacauauuauaaagaauuuauaaggauuuuuaaagauguuuugcucauuuacaaaaguguuguaacaguguuggacaaagccuuccaccccauguccgcauggcuccuuucacuguguccuugacacaccucucuggcaacaacuaaaauuuccugcuucugaaaaguccugucuuaaaaguacagucuauaucuuggaaauaaauagcuuuccucaaggcauga

SEQ ID NO: 192303 - RNA, 46990 nt, Homo sapiens
gcgaauuuugggaaguuccguuggggaagauggcggcggccucgagcacccuucucuucuugccgccggggacuucagauugauccuucccgggaagaguagggacugcuggugcccugcgucccgggaucccgagccaacuuguuuccuccguuagugguggggaagggcuuauccuuuuguggcggaucuagcuucuccucgccuucaggaugaaagcucagggggaaaccgaggguaagugacuguaggggaaaggagggggcgggacacaacugggggagccaguuugugagaggagguucuugcagaugucccaugggggccacuuuaggggcauagaguccaggagagggaauguguauuaguuuuagauugucacuauacccuccuuggugauuauagagcuucgacuuuagggcgauggggacucucaacuucugugaagauuucaugcucgacuagggcacuuuuggccuaaaguggugggagacggggcaaaugaauacaaaaucagcuuacaucucguuccagaagagacgccugaauaaauuuagggcuguguguaaacguacuggagacuauuuuggcaucaaugaaaugauuagguccuuauauuuauuagcagccagcaguucucuacaaugucaaguguucagauccugugccauuguguauuuuuaaagugcgcugaauuucguucuuuuauugaccgaacuacgaacugcagaaaaacaacuuuucuguggaacuuuacuaagauuuucuaaaguuccacacuccggcuaagaugcugccuuagcauuuugggcauaguucuguugauacagugaacuguguuauuguuuaucuucuccaguuuccucugagcuuugcagauuagaguccuugccugauuauuuuuguauaguuucuggcacguaauagucgcucaaaaaguguuggagcaucgaaguacagauauuuaucagcagguuucucaagaaaaacaaagaguguguuuuggagcagaggucgaaaggugaggccgggagcagugacucacaccuguaaucccagcgcuuugggaggcugcggcuggaggaucccuggagcccaggaguucgcgaccagccugggcaacauacugaggcccugucucuacaaaaaaaauaaaaaaauugccgggcacuguggcucacgcguguaaucccagcacuuugggagguugaggcggguggaucaccugagguugggagaucgagaccagccugaccaacauggagaaaacccgucucuacuagaaauacaaaauuagccgggcgugguggugaaugccuguaaucccagcuaccugggaggcugaggugggaggauugcuucaacccaggagguggagguuguggugagccaagacugcgccauugcauuccuaccugggcuacaagagcgaaacuucgucucaaaaaaaaaaaaaaaaaaaaaaggccgggugugguggcucacuccuguaaucccagcacuuugggaggcugaggugggcggaucaccugagguuaggaguucaagaccagacuggcuaacauggugaaacccuuucucuacuaaaaauacaaaauuagccaggcacaguggcaugccugcaaucccagcuacuugguaggcugaggcaggagaaucacccaaacccgggagguggagguugcagugagccaagauagugccacuggacuccagucugggcaacaagagcaaaacuccgucucaaaaaaaaaaaaaaagaaaaaaaauugaaaauaaauaaaauaaaaaauuagcuccagguaguggcucaaggcuguaaucccagcaccuugggaggccgaagcgggcgaaucacuugagcccacaaguuggagaccagccuagacaaccuggcaaaagccugucucuacaacagauacaaaaauuagcuaggcaugguggcacaagccaguagucccagcuacuugggaggcugaggugggaggauuaccugaauccuguaggucaaggcuccagugagccagaaucaugccacugcacuguaaccugggcgacagagcgagacccuguuucaagggaaaauuagcuauagucucagcuacucugaaggcugagcugggaggaucacuugauccuggagcaugggagguugaggcugcaauaggccuugauugugccagugcacucaagcuggggcuacagagugauacucugucuuaaaaaaaaaaaagaaaagaaagauguacuccuugggugcaaggagacaacaaguguaaaaauggaaacuucaugaaguaggaguuuuugucuaguuuguucauugcugucuuuuuagcauuuucauuuauuuauuuauuuauuugagacagaguuuugcucuuguugcccagguuggagugcaguggcgcaaucugggcucacugcaaccuccgccuccuggguucaagugauucuccugccucagccuuccgaguagcugggauuacaggcauguaccaccaagcccggcuaauuuuguauuuuuaguagagaugggguuucuccguguuggucaggcuggucucgaauucccaaccucaggugauccacccgccuuggccucccaaagugcugggauuacaggcgugagccacuccgcccagccagcauuuucauuuauuuuuuuucuuuuuuuuaaauuuuccucucuagcccaguucaauaacuuuuuuuuuuuuuuuuuugacacaaugucucccucuguugccuaggauggaguaaguggugugaucaaggcucaucacugaagcuucgaccucccaggcugaggugauccuucugccucagccuccagaguagcuggggacugacuacaggcacaugccaggaggcuuggcuaauuuuuuucuuucuuuuuuuuuuugagacaguguuucgcucuguugcccaugcuggagugcaauagugugaucucggcucacugcaaccucugccuccuggauucaagcaauucuccucccuuagccucccaaguagcugggauuacaggcaugcaccaccacaucuggcuaauuuuguauuuucgguagagacaggguuugacacuccagccuggucaucaagagugaaacuuagucuuuaaaaaaaaaaaaaaaaagguggauagauaacaguccagugguaugguauuccuuacaucagacccauaacuugugugucaucuugccauuaaaaaugucuucuuuggauguuuugaaguaaaaugauuuuggaaaauauuuuaacugaauucuuacugugaugaagugugggaauuuauuuugcaaggaaaacuguggauggucuugauagaacaguuacugauaacguuuucugauuuaaaucauagagucagaaaagcugaguaagaugaguucucuccuggaacggcuccaugcaaaauuuaaccaaaauagacccuggagugaaaccauuaagcuugugcgucaagucaugguaaggauuguggugaaguggguaaaguguuuugcuuagauaauuauucuuaauacgcuaagcuccccauguagauguguucauacuaucuucauaaaacaucugaauacauggugguuucaacuuuaggagucuauuguaucuauacuacagguugaauaucccuuauaugaaaugcuugggaccggaaguguuuuagauuuuggauuguuuuggauuuuggaauauuugcaaauauauaaugagauaucuuggggaugggacccaagucuaaacacauaauuuauuuauguuucauaaacaccuuauagauauagccugaagguaauuuuauacaacauauuuaauaauauauuuaauacuuuugugugugaaacuaaguuuuuuuuuguuuuuuuuuuuuauugagacggaguuucacucuuguugcccaggcuggguuguaauagcccgaucucggcucacugcaaccucugccucccagguucaagugauucuucugccucagccucccgaauagcugggauuacaggcaugcgccaccacgcccagcuaauuuuuauauuauuuguagagacgggguuucuccauguuggucaggcuggucuugaccuccagaccucaggugauccaccugccuucgccucccaaagugcugggauuacaggcgugagccaccgcguccagccguuuugacugcauuuugacuaugacccuguuaugugaggucaggugugaaauccuugguggcaucauugggaaugcuaaaaagguuuuggauuugggagcauuucagauuuuugauuuucagauuagguaugcccagccuguacuaguagaauuuuugauucauucuuuuuuuugagaccaggucuuaucauccaggcucaagugcaguggcgcgaucauggcucacugcagcuucaacuucccaggcucaggugguucucccaccucagccuccuaguaucuggaacaacaggugcauguaaccauguccagcuaguuuuuuuuuuuuuuucuuugagauggagucuugcucuguggccaggcuggagugcaauggugcgaucucggcucacugcaaccucugccucuuagguucaagagauuccccugcgucagccucccgaguagccgggacuacaggcacacgccaccacgccuggcuaauuuuuuguauuuuaguagagaugggguuucaccauguuggucaggauggucuccaucuccugaccucgugaucugccucccaaagugcugggauuacaggcgugagccacugugcccggcugcccagcuaguuuuuuauauuuuuuguagaaaucguuuuuuuuuuuuuuuuuuugagauggagugucgcuuugucacccaggcuggagugcaguggugcgaucucggcucacugcaagcuuugccucccggguucaugccguucuccugccucagccucccgaguagcugggacuacaggccccugccacuauucccggcuaacuuuuuguauuuuuaguagagacgggguuucaccguguuagccaggauggucucgaucuccugaccucgugauccacccgucucggccucucaaagugcugggauuacaggcguagccacugcgcuuagccagaaauagguuuuuacucuguggcucaggcuggucucaaacuugugggcucaagugauccacccacuuuggccucccaaaguguuaggauuacagugugagccaccgugccuggcggauucauuuuuuuuuuuuuuuuuuaaagauggaaucucugucugucaccuaggcuggagugcaguggugggaucuuggcucacugcauccuccgccuccuggguucaagcgauucuccugccccagccuccugaguagcugguauuacaggcauccgccaccaugcccaguuaauuuuuguauuuuuaguagagaugggguuucaccauguuagccaggcuggucuugaacuccugaccuugugauccaccugccucagccucccaaagugcugugauuacgggugugagccccugugccuggcccagguugucauuuuuauuccuuaaggcaaccaaauucuagcuugaaauauguucuguaaaugauacugucauuagagagacauugugagauagaaggauuccagguggcuaauaaggcccucucuuuggguaccacucucuugguuuggucaccaugacuuugcuugucuacuuuucaguuuugcagauucagaaaccuaauuuuauugguacaucaagauuuuauagaguuuucauggcugggcguggugguucacaucuguaaucccagcacuuugggaggcugaggcgggucgaucaccugaggucaggaguucgagaccaggcugaccaacaagguaaaacccugucucuacuaaaaagacaaaauuagcugggcauaguggcaggcgccuguagucccagcuacucgggaggcugagacagcagaaccgcuugaacccgggagguggagguugcagugagccaagaucaugcuacugcacuccagucugggcaucggagcgagacuccaucucaaaaaaaaaaaaagaguuuucaacaacugacauacuguaugcuuauuuauuaauuuaugacaaaacauuuaguuuuccaguuuucauaauacugguauucauugaccagagcaccucuucuccugucaagaaucaagagauuucagauuauuaauaaauuacuuuguuuuguaagggagaauuagagcagugagauagauuuauuugcaacauggaaaagccuggaaaacuauccuuauaccagaaaacuguucacguuuuuagggacuggaauguuuuucagagagaaacuucuucacuggauaggguuaggaaaacuaggcuaaguuuuuuuuuguuuguuuguuuguuuuguuuuguuugagauggagucucacucugucaccaagguuggagugcaaugguguggucuuggcucacugcaaccucugcauccccgggucaagcgauucuccugccucagccuccugaguagcugggacuacaggcgcguaccaccacaccuggcuaauuuuuguauuuuuaguagagaugggguuucacuauguuggccaggcuggucucgaacuccugaccucaugaucugcucgccuuggccucccaaagugcugggauuacaggcgugagccacugcaaccggccucaaacuaggcuaaguuuuuguucuuuggaagucccuuuucuggacuacauguucuguuucuuuucuuuuucuuuuuuuuuuugagacagagucucucucugucgccaggcuggagugcaguggugugaucucggcucacugcaaccuccgccuccuggguucaagugauucuccugccucagccugcugaguagcugggacuauaggcgugcaccaccacgcccagauaauuuuuguauuuuuaguagagacgggguuucaccauuuuggccaggauggucucagucucuugaccucgugauccacccgccuugaccucccaaagugcugggauuacaggugugagccaccgcacccagccuauauguucuguuuuuuagagucaaucucauuuucuuaaaauuugguuguguuucucagauuacaugcaaaucaccuuguuaaauuuguacacuaccaaaucuccugagccaucuuauuuaacuguuuauaucuuagcauguggucacuuccacaggcggcagaucucauguauuacauuuugauucuuccuaauauuucucuaaagguuuuuuuguuuuagauguggaaauacaacguuuucuuuuuuguuuuugacuaaauagaaacaggaucucucuaucuugccuuggcuggucucgaacuccuggacucaagugauuauucagcuuuggccucucagugugcuagaauuacaggcaugagccacgugccuggcugaggaauaccuuuuucuacacucauauauauggauuuugcauggauggacagaguaacacuuguagaccaguguuacucuauauagucuacaaaaucuauagacuauauugagucuauagacuguccugcaauauuacuacuaggauaauguguauguuuaccuaaaacacuguuggccugguuaauuuucaccucaaauguuuucccacuugacacaggagaagaggguugugaugaguucuggagggcaucaacauuuggucagcuguuuggagacauugcagaaggcucucaaagguuugugaacacuuuugaaauaugcugauuucacaaaacccccaguucaagaaggaccauuuuauacuuaaacuagaaguaaaaaauugagguaggucaacuuuauguauuagauauugcucuugcauucauuuauggaguuggaaugaucuuuuugcuaaaguuugaaacauuuauuuuugauccuguuuuggaggcugauagagauuuaaaagauaaaugaugaaggguaauauaagauaccuggggaggcugggugcgguggcucgcuccuguaaucccagcacuuugggaggcugaggugggcggaucacaaggucaggaguuugagaccagccuggccaacauggugaaacccugucucuacuaaaaauacaaaaauuagcuggacgugguggcgggcaccuauaaucccagcuucucgggaggcugaggcaggagaacagugugaccuggggaggcggagguugcagugagccaaaaucacgccauuacacuccagccugggcaacagggcaagacuugucucaaaaaaaaaaaaaaaaaaaaaaaagauaccugggaaaaguuuuuuuucccuucacauuuauuucugauuaaucucgauaagaagauggacuuuuuuuuuuuuuuuuuuuuuuuuugagauggaguuucacucuuguugcucuggcuggagugcagugguggaaucucggcucaccacaaccucugccuccuggguucaagcgauucuccugccucagccucccaaguagcugggauuacaggcaugugccaccaugcccggguaauuuuauauuuuuaguagagacaggguuuuccauguuggucaggcuggucucgaucucuugaccucaggugaucugcccaccuuggccucccaaaguucugggaucacaggcgcgagccacagcaacucgcgaaguuuuuuuuuuuuuuuuuuuuuuuccgagacggugucucacucugucacccaggcuggagugcaguggcacaaucuuggcucacugcaaccuccaccuccuggguucaagcgauucuccuggcucagccucccaagcagcugggacuacaggcgcgucccaccacgccuggcuaauguuuuguauuuuuaguagagaugggguuucaccguguuagccaggauaguauagaucuccugaccucgugauccacccgccucggccucccaaauugcugggauuacaggcgugagcuaccaugccuguccagaagauggacauuuuaacucuaaaaagauuuuuacgguguuuauggagcaaauuuccaggaaagcaaauguaaaauauaagucaugagcuugauuauucaugcuuauaaugacuaauucuauuuuuggggaauaaugaaaguaaaaacagauuuuacugugauccaccagaaaugaaccuaauucagcugaggguuuuuuuuuuuuuuucuggagacagugucucacucugucguccaggcuggagugcaguggcacgaucucugcucacugcaaccuccguuucccggauucaagugauuguucugccucagccuccugaguaacugggauuacaggcgcccauuaccaugcucagcuaauuuuuggauuuuuaguagagaugggguuucaccauguuggccaggguggucuuggacuccugaccucaggugaucugccugccuuggccucccaaaguguugggauuacaggcgugagccacuuugcccagucucagcugaguauuaucuucuuuaccuuuuuuuguuuucuuuuucuuugagacagagugucgcugugucacccaggcuggagugcaguggcacgaucucugcucacugcaaccacugcgcccccaccggguucaagagauucucuugccucagccucccgagagggugggauuauaggcgcgcaccaccacaccuggcuaauuuuuguauuuuuauuagagacaggguuucaccacguuggucaggcuggucuugaaccccugaccuugugauccgcaugccucggucuccgaaaguguuaggauuacaggcgucagccaccgcacgaggccuuuuuuucuguuuuaauugugguaaaauauagguaacaaaauuuaccauuuucuuuguuucuaaguguauaguucaguagcguuaaguacauucauauuauuguauaaucaucaccacuguccaucuguaaaacuucacucaucuucccaagcuuacauucuguaaugucccauucccgccuucccccagucccuggcagccaccauucugcuuccugucuuuaugaauuugacuacucuguauaccugauauaaguggaaucauauauuuguccuuuugugacuggcuuauuucacuaaacguaaugucuucaagguucaucuauuuugaagcauuuauuagaauuucuuucuuuuuuaagguugaaaaauacuccucuuuauguauauacauuucauuuauccauucaucugcuaguggacacuuggauuguuuuaaccuuuugacuguugugauuaaugguguuguuaauguugaguuuuuuuuaauguuaguuuuaauguuaaucuuccuuauucuaucauuagcagauaaaugugucuuaaguuaaaggcaguuugucccacauaaggaguaaugaaaacaggagaggagaaagguucgguaauuuuucaaauagaucuuuuuuuuuugaccuuuaguacugcauaggccacagcuaacccuaaucagugaacuuuauguaaauuacaagcauuugaacuacugaauauguuuacgguuuuggaaggaugaaucuuucugucuuaaaagaauaucauuuaagucauuuggagcauucuuugugacuccuuuuuucauccuuuuauaguaacaucuuuaccagcaaugacugaucguuuggaguccauagcaagacagaauggguaaguagucuuucuguaggcagaaauguuuaacuuaguguuaacuuuggguggcuuuauuuaugugucuucuauuaauuuuuguuuugauuuguuccugcuagacugggcucucaucucagugccaguggcacugaauguuacaucacgucagauauguucuauguggaagugcaguuagauccugcaggacagcuuugugauguaaaaguggcucaccauggggagaauccugugguauguguuguugauauuucacuggaaucugugggguuuacuuagggacauuaauuuuaaaauuaauuguugggguuuaaauagcuuggguuuagguuuuuccaugagccacuguagagaugaugugaugggcuacaaaaucaacagcuauagaaugggauuuagaaaauaugggucccaucucugacaucauccaaaggcuuuaacaaguggaaacaccauaggaacccuuuucccuuuccuuccuuccuuccuuccuuucuuucuuuucuuucuuuuuucuuucuuucuuucuugcuugcuugcuugcuuucuuuuucuuuucuuucuuuucuuucuuucucuuucucucuuucuuucuuucuuuccuuccuuccuuccuuccuuccuuccuuccuucuuucuuucuuucuuucuuuccuucuuuccuucuuuuucuuuuuuuuuuucccugggacagagucucguucugucgccuggagugcaguggcaugaucuuggcucacuguaaucucugccuccuggauucaagcaauucuccugccucagccucccaaguagcugggauuacaggugugugccaccaugccuggcuaauuuuuguauuuuuaguagagacgggguuucccuauguuggccaggcuggucuccagcuccugaccucaagugauccaccugccucagccucccaaaguguugggauuacaggcauaagccacugcaccggcaggaacccuuuucauuucauaucaacaaacaugagccacgauugaacaauaggugcuggggauacagaaauaaaugacucaggguuacuaccuucaaagagauuauaaucaagaacagaugaucugaaaaauuauguaauagagaugaauguaaaaucuguguaaccagauaauuugauaugaauuccauguauggcauuagaguuccuaauguuuuaaacaagcuacugaaaguagauucuuuuaaaaacuauuucauaugcuuugacuuuaaauuucucacccuaauccugugguucaccaaguaggaagaagaugcuuuuuaauauuuuaauaugaggaccaucuguaguuuuaaugguuuuguuguaaaacaugugcuauagaaaaagagaaaggcuuuugauaucuucaaaguugcuaaaguaguuuuaauguuuuaacauaauuuucuuugauuucagagcuguccggagcuuguacagcagcuaaggugagcaaauacgauuuauauuccuugauauugacagacagugcuguucuuuacagcuggcuuuuaagacuggucagaaguuauucuccucaggaacaaguuuauuuucuugggcaaagauuuuuaagagucuauacuuaaucacguccugaauugacauagcauagcuuuucacccuacucuaucccaggguuuuuuuguuuucguuuuuguuuugagauggagucuugcucuauugcccaggcuggagugcaguggcgcgaucucagcucacugcaaccucugccuccuggguucaagcgauuuuccugccucagccuccagagcggcugggacugcaugugugugccaccaugcccagcuaauuuuuguauuuuuaauagagacuagguggcugggugcgguggcucacgccuguaaucccagcacuuugggaggcugaggcagguggauccaugaggucaggaguucaagaccagacuggccaagauggugaaaccccaucucuauuaaaaauauaaaauuuaggcugacaccuguaaucccaggacuuugggaggcugaggcggguggaucaugaggucaggagaucaagaccauccuggcuaacacggugaaaccccaucucuacuaaaaaaagaaaaaauacaaaaaauuaacugggugugguggcaggcaucugugguuccagcuacuagggaggcugaggcaggagaauggcgugaaccugggagcggagcuugcaguaagcugagaucucgccacugcacuccagccugggcgacagagcaagacgccgucucaaaaaaaaaaaaaaaaaaaaaaaauuagccaggcauggugguggguaccuguaaucccagcuacucgggaggcugaggcagaaaauugcuugaacccaggaggcggagguuguagugugcugagaucgugccacugcacuccagccugggugacagagcaagacuccaucucagaaaaaaaaaaaaaauagagacgagguuucgccaugugggccaggcugaucuugaacuccugaccucacaucucccaaagugcugggauuacaguugugagccaccaugcuggacccuuuucuuuucuuuucuguuuuuuuuugagacggaguuuuguucuuguuaccuagucuggaguauaauggugcggucucggcucacugagcaccuggccccuuuucuguuuuuuuauuuuuauuuuuauuuuuuuggugagacggagauuuacuuuuguugcccaggcuggagugcaauggugugaucuuggcucaccgcauccucugccuccuggguucaagugauucuccugccucagccucccgaguagcugggauuacaggcaugugcuaccacgcccugcuaauuuuguauuuucaguagagacgggguuucaccguguugcccaggcugaucucaaacuccugaccucaggugauccuccugccuuggccucccaaagugcugggauuauaggcaugagccacugugcccggccccuguuuuuuuaaguuuuaauuuuuuuuuucuuauuuugauucagauucccaacagaaagauaucccagggucucuuaaacuugguacuaaugacaauuuggauuggaaaauucuuugcucccggguggccuggugcauucuauuauguuuaauagcaucccuggccucuucauuaguugcuaguaguaucuccuuaguuguuacaaccauguccccuggggcacaaaaucaccccugguugggaauuggugaucuagguuuaggaauuucauauagcugggggcgguggcucaugccuauaaucccaacaauuugggaggucgaagugagcagaucacuugaggccaagaguucaagaccagccuagccagccuggcgaaacccugucucuacaaaaaauacaaaaauugcugaaugugaggccaggcgcgauggcucaugccuguaaucccagcacuuugggaagccgaggcaggcggaucaccugaagucaggaguucgagaccagccugaccaacacggagaaaccccgucucuacuaaaaauacaaaauuagccgugcgugguggcacaugcuuguaaucucagcuacuugggaggcugaggcaagagaaucgcuugaacccgggaggcagagguuguggugagccaagaucaugccauuacaguccagccugggcaacaagaacaaaacucugucucaaaaaaaaaaaaaaaguagcugagcauaguggcucacacguguaaucccagcuacucaggaggcugaggcacaagauggcuugagccugggagguggagguugcagugagcugggaucacaucacugcauuccagccugggugacggagugagacugucucaaaaaaaaaaauaauaaagaauuauguguggaacaaaauaaauagaagguaaucauugaaucagugaaggcuugauaauugaguaugauaccaugaaaauaacuuuuucgcuuugauuuugggaaaaauuguuucauuuagaagguacauguguguuacaguaaaagugcuaggcuugaagacagucgcuuuuagcagauaguggauuuuuucacuuuucuuuuaauugaguggaaauuucuguacuuaaauuuaaacucagaguuaagacuuuuggggaauuuaaggaaguuauuacauacacuuuguuuugagcauugcgaaguucucaggcaccacaugaggaugucuuagaguguucacauugaggaaauaaguuguguaugugugugugcaaaagcuuuuuuuuuuuuuuuuuucuuuuuuuugaguuggagucuugcucugucgcccaggcuggagugcaguggugugcucucugcucacugcaagcuccgccuccuggguucaugccauucuccugccucagccucccgaguagcugggacuacaggcaccugccaccaugcccggauaauuuuuguauuuuuaguagagacgagguuucaucguguuagccaggaugguuucgaucuccugaccucgugaucugcccgccucggccucccaaagugcugggauuacaggugugagccaccgcacccggccuuuuuuuucgagauggugugucacucuguugcucaggcuggaguacaguggcgcaaucucggcucacugcaaccucccccucccggguucaagcgauuuuccugccuuagccuccugaguagcugggauuauggguaccugccauuaugcccggcuaauuuuuguaguauccaggcauggugaaaccuuaugucuacuaaaaauacaaaaaauuagccgggugugguggugcucgucuguaauuccagcuacacaggaggcugaggcuggagaauugcgugaacucaggagguggaaguuguagugagcugagaucgugccaucgccaucggacuccagccuggacgacagagugagacucugucucaaaaaagaaaaggagaaaaaaagaaauaauguugacuuuuaccugauauuaccauuuaguauagaugguaauauuaaguuaaagaauauauuuugcugcuacucguuucuuuuugcugucuuaauagcacuguugacuguaagugcucaguaaaugcucacagaaugucugcucaagugucugacauugucauggcaguuuagcuuuccagagagcuuuuuuuuucaaguuugaaaaaagauaucaagaguuagaauuguggagauguauuggauuccuaaaccuauccacaaaagcccauuuguccgacaaucgaagccugaauauuggguccuagaaagccagaggucacgguaguaguuuauguuuucuaggguagaucuggucguagcaauauuuucuaauggguauuuugccucgagaguacccacuaccuuuucucugggucuccaucucuguccuaguauuuguuuucccucucaucuuugcucucauguugcuguauacccacaaguguugugucuucccaauuuauuuucuuuuuuugacacacagucuugcucuguugcccaggcuggagugcaguggcgcgaucucggcucacugcaagcuccgccuucuugguucaugcuguucuccugccucagccuccugaguagcugggacuacaggugcccgccaccacacucggcuaauuuuuuuuuguauuuuuaauagagaugggguuucaccaugcuagccaggauggucucgaucuccuaaccucaugauccacccaccuuggccucccaaagugcugggauuacaggcgcgaggacugugccuggcccuuccuaauuuauuuucuucuuauuaucucugcaaucaaaaguuuuauuuuuguugacauccaaauucaguuacauauuuggaggaaaggagcugggugugguggugcacaccuguuguugaaggugagagguugaagugagagcauugcugaaguccuggaguuagagucuggccugggcaacaucgggaaaccccgucucuacaaaaaaauuaauaaaaagggaaaagaaaggaaaguuguuaaugauugauuuaaaucagguuucauugcuugggagcuaauaaaacaccugguaaagagauuuugcccaccuuccuuuuaacuuucacacugcuuauuagcaccuucuccagaaaaaauggaggagggagacaaaggaaaauauuuucuuuucuuuugcugcuuuacauugaugcuagaaaacuuuugaggaaaaugguuaaagcugauuauuaaaaucaguuuuauauagcugugauuuuuggcacuuuguuguaagauugaguaguaauuuuauguuuuauuuuccucucuuuccccucuucccugaacuccuuauagggaaaaaaauuuugaugaauuuucuaagcaccuuaagggccuuguuaaucuguauaaccuuccaggggacaaguaaguauuuuuaauauuuuugcuuuuguuuguaaaaaucaguauaaaucuauaagccaccuuaugccuagaaauuugccaccucuucugcuguuugucacuccuaguuucuacuuauacugcaaucuguagcucagcuuccaacauugggccuuucaaagauaucuucaauaggcagcaccugcauuaaucgaucauaaugcuggaagacagaauauaaucuuugagauguccaacauuccaauuucuaggcugaaaggaauuaguugcuguggaacuggcuuuaauucuauuuuuaaccuaccugggauucuauuaacguauuuggcuuuuuaaaacagagauaaaaauaagcuuugaagugcuaaaaauaggcuuuaauaguagugaagccagucaaaguggcccaugccucuaaucccaguacauugggaggccaagacaggaagauuucuugagcucaggagaucaauaccagccugggcaacauagugagacccugucucuagcagaaagacaacagcaacagcuuagauggguggugaugggugcauguagucccagcuacuucggaggcuaaggugggacgaucacuucaaacuaguaguuugagggugcagugagcagugauugcgucacugugcuccagccugguugacagagcgagaugcugucucaaaaaaaaagaaaaaauauguguguauauauauauauauauauaguaacaaaaaaaauuuauuuuaaaaauuaauguuuuaggcugggcacaguggcucacuccuuuaauccuggccacuuugggaggcugagguggguggaccaccugagguccagucaagaauuaauguuuuaaaauguuuuuuuuuuuucuuuuuuuuuaaauacggauugucgcucugucacccaggcuggagugcaguggcaugaccucagcucacugcagccuccaccucccggguucaagcaguucuccugccucagccuuccgaguagcuggguuuacggcuaugcgccaccacgcccggcuaauuauuauaauuuuuuuugagauggacucuugcucugucgcccaggcugcaguacaguggugccaucucggcucacugcaaccuccgccuccuggguucaagcgauucuccugccucagccucccgaguagcugggauuaaaggcgcccaccacugaccuggcuaaguuuugcauuuuuaguagaggugggguuucaccaucuuggccaggcuggucucgaacuccugaccuugauccacccgccauggccucccagagugcuuggauuauaggcgugagacauugcgcccagccaccuggcuaauuuuuguauuucuaguagagacaggguuuuaccauguuggucaggcuggucucaaacuccugaccucacgugaucuacccgcuucggccucccaaaguguugggauuacaggcgugagccaccgcgccuggccaguuuuuuuuuugguuuuuguuuuuuuuuggagacagagucucgcucugccaccaggcuggaaugcaauggcaugaucucgguucacugcaaccuccaccucccggguucaagcaauucucuugccuuagucucccaaguagcugggacuacaggcgcaugcugccacgccuggcuaauuuuuuuuuuuuguauuuuauuagagacgggguuucaccguguugcccaggcuggucucaaacuccugagcucaggcaaucugcccuccucggcuucccaaauugcuaggauuauaggcaugagccacugcgccuggccaguuuuuaaaaauauauauauauuuuugccuucaauuuagacuugcucuuuaggccuucuaugucacuguuugugucuguauguauauauguguauuuuucaacuuuuuuuuuuuuuuuuuuugagauggaaucuuguucugucacccaggcuggagugcagugguaugaucuuggcucacugcaaccucuuccucucggguucaagcaauucuccugccucacccuuccgagcagcugggauuacaggugccugccaccacgcucggcuaauuuuuguaguuuuaguagagaugggguuuugccauguuggccaggccggucucaaacuccugaccucaggugaucugcccgccucagccucccaaggugcugggauuacaggcugagccaccccgcuuggucauauuuuucaacuauuaacucauguucuucucaucuacucuccagcaaacugaagacuaaaauguacuuggcucuccaauccuuagaacaagaucuuucuaaaauggcaauuauguacugguaagacugcuaaaaccuuaauucuacaugaucccuugaguuuuucucuggggagauuaggguccuauuuuauacaucucuauuaagccuguaugauaauauguccuuucucuuccaaaaugaugauuguauuugaacuucugaguaucaguaucgcuaaguuguugguuaccauagguuuuaucucaagacucaucagaccuggagucccaucugagaaauaauagucuaaguguaauuuuuguucaccauacuacauacugguguguacuuggaaauaaucccuuuacuuuggaggugaaauacauuugcuauaugcccaauuacaagacagaaccauuaugauaguauuauaagacuuugggcugggcgcgguggcucacgccuguaaucccagcacuuugggaggccgaggcgggcggaucaccugaggucacgaguucgagaccagccugcccaauauggugaaaccccgucucuacuaaaaauacaaaaaauuagcugggcgugguggcgggcgccuguaaucccagcuacucgggaggcugaggcaggagaaucacuggaaccugggaagcggagguugcggugagcugagauuguaccacugcacuucagccugggcgacaagagcgaaacuccgucucaaaaaaaaaaaaagacaagacuucggagaggugaacucaauaucacaguguguaccaagaccaucagggauuaaauauaagcaaacauagaucacuugucuuacaggaaagcaacuaaugcuggucccuuggauaagauucuucauggaaguguuggcuaucucacaccaaggaguggggguacgugauccuauuuugcuuguuuagaaacauguguaauuuaaguugagggucauuacuuuucauuucaccuuuaguuuguuuguuuauuuuuuugagacagagucucacuuuguugcccaggcuggagugcaguggcaugaucucggcuuacugcuccuuccaccuccugggcucaagugaaucucaugccucagccuccugaguagcugggauuacaggugugcaccacaauagccagcuaauuuauucuauuguugguagagacaggguuucacuguuuuggccaggcugguccugaacuccucgccucgacugaucggccuaccuuggucucccaaagugcugggauuacaggcaugagccacugcgcccagccuauuuauuuguuaauuuuuauucuguuuuuuuuuuuuuuuuuuaagacggagucuugcucuguugcccaggcuggaguacaguggcgcgaucucagcucacugcaagcuccgccucccagguucacgccauucuccugccucagccuccaggguagcugggacuacaggcgcccgccaccacgccuggcuaauuuuuuuguauuuuuuaguggagacgggguuucacagcguuagccaggaugaucucgaucuccugaccucgugaucugcccgccucagccucccaaagugcugggauuacaggcaugagccacugcgccuggccaauuuuuauucuuauguauuuguuuauuuuucuugagacaggcucucaccaggcuggagugcaguggcacaaucuuggaucacuguaaccucugccuccuggguucaagggauucuccugccucagccucccgaguagcugggauuacaggcaugugccaccacacccgacuaauuuuuguauuuuuaguagagaugggguuucaccauguuggccaggcuggucucaaauuccugacuucaagugauccucccuccucggcugcccaaagugcugggauuacaaacagguauuagccacugcaccaaucccuauuuauuuauuuuugagacagggucuugcuguguugcccaggcuggagugcagucgugcaaucaugacucacuccagccucaaccuccugggcccaaauaaucccccuaacucaguuuccugaguagcuuggacuacagguacaggauaccaugccuggcuaauuuuuguuguuuuauagagacauggucuuacuauguugccuaggcuggucuugaacugggaucaagugaucuuccugccacugcauugcaaaggguugggauuauaagcauaagccacugcgcccggccucaucuugggguuuauaaacauauaagcagagggagaaaauugccagauauuuguguauuuugugaugauuucuuccuuuuuuuuuuuuuuuuuuuuuuuuuaggcauuuaggcagagucuugcucugucucccaggcuggagugcaguggcgcgaucuuggcucauugcaaccucugcauccuggguuccagcaauucucuugccucagccucccauguagcugggauuacaggcacgugccaccgugcccagcuaauuuuuguauuuuuaccagagacaggguuucaccauguuggccaggcuggucucgaacuccugacccuaggugagcugccugucucggccucccaaagugcugggauuauaggcgugagccacugcgccugggcuuuuugcgaugauuucuaagcugucaauaccuguccuccccauuuuuguuuguuaucuuuuugagacagagccuugcuaugucccucuggcugaaguacaguggcagaaacauagcucacuucagcccuuaacucuugggcuuaagugaucuucccaccucagcccccugaguagcuaggacuucagucaagugccaccaugccuggguaacuuuaacaauuuuuuuagagaugggggucucacuguguugccuaggcuagagugcaguggugcagucauaacucacuauagacuugaacuccuggcuucaagugauccuccagccucagccucccaaaguguugggauuauaagcgugagccaguucaccuggccuuuuuuuuuuuuuaaaucaauugugugaaauaaauuguuagucccggaauccauacuucaucuucugucauaugucuuuuuuuuuugagauggagucuugcucugucacccaggcuggagugcaguggcacgauuuuagcucacugcaaccuccaccuccuggguucaagcaauucuccugucacagccucccgaguaguugggacuacaggugcgagccaccaugccuggcuaauuuuuuguauuuuuaguagauacaagguuucaccaugcuggccaggcucgucuugaucuccugaccucgugaucugcccaccuuggccucccaaagugcugggauuacaggugugugccaccacacccaagcgccugucauauuucuuuauuuuuuauuuuuacuuuuugagacggggucuugcucugccuuccaggcuggagugcaguggcacaaucacggcucauuguauccuugaccucccaccuuaacuuccugaguagcugggacuacgggcacucaccagcaugccaggcuaauuauuauuauuauuauuuuugagacggagucucccucuguugccagggcuggagugcaguggcaugaucucagcucacuguaaccuccgcuuccuggguucaagcgauucuucugccucagccuccugcauagcugggacuacaggcgcgugccaccaugcccagcuaguuuuuuguauuuuuagucaagaugggguuucaccauguuagucaggauggucucaauauccugaccuugugauccgccugccuuggccucccaaaguugugggauuacaggcaugagccaccgcaccuggccaauuuuuuguauuuuuaguagagaugggguuucaccauguuggccaggcuggucuugaacuucucuccucaggugauucaccaucuuuaccucccaaagugcuaggauuacaggcauuagccaucgcgcccggccuauuauuauuauuuuuagagguggagucugacuguguugaccaugcuagucucaaacuccuggacucaagugauccucuugccggagccucccagagagccaggauuacaggugugagucaccacaccugccauauuucauaagcuguuuuggagcaugacucuucauauauguuaaaguacuuucuugaauaucgguuuauauaauaaauguuaauguuuuucuguguuuguaauuuaccugauaaagauacaguuaugaguuuuauuuuuuauaggucauuuaaugaaccugaaguacuaugucucuccuucugaccuacuggaugacaagacugcaucucccaucauuuugcaugagaauaaugguaagacuuuaauuguaaaggaauuaaagguuuuguucggugcccagcuugccuuuaauuucugguuugcuauucucuaaugaguuuguugaccuuaccauuugcaccuuauacacacaacaccucacacacguauauguguguucacaaguacauacauauguauauacacacaugcauauauacacacauacauaauaggagcuuaauaaguacuuuugggcugggcacgguggcucacgccuguaaucccagcacuuugggaggcugaggugggcagaucacgaggucaggacuuggagaccagccugaccaacauggugaaacccugucucuacuaaaaauacaaaaauuacccaagcauggugguacgcgccuguaaucccagcuacucaggaggcuaaggcaagagaauugcuugaacccgggaggaggagguugcagugagucaagauugcgucacugcacuccagucugggugacagagcgagacuccaucucaaaaaaagaaaaaaaguacuuuugaauaaauaaguaaaugagcaacucauaagaagagauauaaacgaucugaccugagauaaucagcuuacucauuguuuaaaaaguguagaaggaugggccugguaguuuaugccuguaguccuagcuacuugggagguuugggcgggaggauugcuugagcccaggaguuugagacuguagcauaccaugaucgugcauguaaauagucaugguacuccagccugggcaacguagugaguuacugaucaaaaaaaaagugaaguuuucuaaauuaaagaacuaugguaauggacauuauuuucuguuugcccuugauacaagaaaagauaaagagagauagacugccgggcgcgguggcucaugccuguaaucccagcacuuugggaggcugaggugggcgaaucaccugaggucaggaguucgagaccagccugaccaacauggagaaacccugucucuacuaaaaauacaaaauuagccaggcgugauggcccaugcuuguaaucccagcuacucaggaagcugaggcaggagaaucgcuugaaccugggaggcggagguugcagugaaccgagauugugccauugcacuccagccugggcaacaagagcaaaacucugucucaaaaaaaagugaaauggacuaauaccuccuuaggucccuuuguagcuucacucauugacuccaucccuuuauuguuuguuuguuuguuuguuuauuuauuuauuuaagauggagucucacucugucacccaggcuggagugcaguagugcgaucucagcucacugcaaccuacaccuccuggguucaagugauucuccugccucagccucccaaguagcugggacuacaggcaugcaccaccacacccggcuaauucuuguauuuuuaguagagaugggguuucacuauguuggccaagcuggucuugaacuccuuaccugaagugauccaccugucuuggccuccgaaagugcuaggauuacaggugcgagccuuggcgucaggcuccuuuauuguuauuauaauuuggcaugggggacgggguaggucucacuguguugcccaggcuggcguacagugauuugaucacagcucacuacagcccccgaaguccugggcucaagccauccucccgccuuggccucccaaagugcuaggauuacaggugugagccagugcaccagccuguccuuuuauuaugauccuacuuaaaugcauucugaagaaaaaauaaguaaauauugauacugaacccuucaaaaaugauguuuuuggacugcauuguuucuuguguuuuauuuacugacaaaaauuauugguugauuagaaagguaacuuccaggauuucuaauuuuuuuuuuuuuuuuccccagacagagucucacucugucgcccaggcuggagugcaguggugcgauuucggcucacugcaaccuccgccccccagguucaagugauucuccugccucagccuccugaguagcugggauuacaggcgccugucaccacaccuggcuaauuuuuguguuuuuaguagagaugcgguuucaccgucuucugcaggcuggucuugaaccccugaccuugugauccacccgccucagccucccaaagugcugggauuacaggcaugagccaucacaccuggccugauuucuaaguuuuauaggaacuacaggccgugccuggugguucaugccuguaauuucagcacugugggaggcugagauggguggaucaacuuuaggccaggaguuugagaccagccuggccaaccugaugaaacccccaucucuacaaaacauacaaaaaaauuagccaggcaugguggugcauuccuguaaugccauguacgugggaggcugaggcaugaaaauuucuugaaccugggagguggagauugcagugagucgagaucacaccacugcauuccagucuggacagagugagacucugccuccaauaaaaaaauaaauaaauaggcugggcgcagugauucacaccuguaaucccaccuguaauccuaguccuucgggaggccaagaugggcggaucaugaagucaagagaucgagaccauccugaccaacauggugaaaccccaucucuacuaaaaauacaaaaaauuagccgggcauggugaugggcgccuguaguuccagcuacuuggguggcugaggcaggagaauggugugaacccaggagguggagcuugcagugagcugagauugcgccacugcacuccagccugggugacagagcaagacucugucucaaaauaaauaaauaaauacauaaauaaauaaauaagggaauaacagcaucugauaaauuauagcugacaaauauugcaaaaauuaaccucuuaaaacauacugugauucccaucauuuguauuacuuugaggaauacccuuuuucuuuccuauccccaguuucucgaucuuugggcaugaaugcaucagugacaauugaaggaacaucugcuguguacaaacucccaauugcaccauuaauuauggggucacauccaguugacaauaaaugguaaguuaaauauaauuuuagaguagcaaagucaauuuuucucaaagcgcaguauguaacaaguuuuaaccuggcuguuaccccacuugaauuucuagagguuggccuuuuguuuuauccauucauugguuucucuuuuguuugauaucugaguguuccucuccaaagucggcucguagaacacauucucugcacugaaagggaaagaagagaacugugcuaauuccucuggcuuaaugagugcccccuuuuaucuuacguucauuaguuacauuggaguaauaacuggagaacaugccucaggauaaauguuugauuaaauucuacaguguuaaccaauagcaugucugggaauuggggguaggaaguuucacagagugagcuuuugagaguuuguacuuaugugucugugugauacauacauguuuaagaauagguguuuguggccaggcaugguggcucacgccuguaaucccagcacuuugggaggcugaggcaaguggaacaccugaggucaggaguucaagaccagccuggccaacauggugaaaccccaucucuacuaacaauacaaaaauuagccgggcgugguggcgggcaccuguagucccagcuacucacgaagcugagauaggagaaucccuugaacccgggaggcagagguugcagugagccaagaucacgccauugcacucuagccugggcauuaagagggaaaaucugucucaaaaaaaaaaaagguguuuggguuuuucauuuuuauaucaagucagaauccaacccuuccacccucuuuuuuuugaaggaccccuuccuucuccucaaucaccagugccaacaguguugaucuuccugccuguuucuucuugaaauuuccccagccaaucccaguaucuagagcauuuguucagaaacugcagaacugcacaggugaguuuugagcaucaggaucuaguacuuguuauaaaugugaaaaagaaacuucaaagucagguuaucaugacgucuuucagucuuacaugccucauugaaguauuacugguaaagauguuauagugcuuuguacuaguaaaugcuuaguaaguacucuuuugggugaaugaauguagauaucaaggggaaacugagcugucaguguuuucaucuuaacaugaucauuauauugauucuuguuuuuccaggaauuccauuguuugaaacucaaccaacuuaugcaccccuguaugaacugaucacucaguuugagcuaucaaaggacccugaccccauaccuuugaaucacaacaugagauuuuaugcuguaaguaaagcccuagggagcuagaauguuguagguuauguuuggacccaagaucauaaucuuccuuuauagcauuauugaggucagauaaguuucuucaagacugcuggaucauguccuauuucuuuaguaaggcaggaaauuacagaaaucucagaaaugggcugggcgcgguggcucacaccuguaauccccgcacuuuaggaggccaaggcaggcggaucgugaggucaggaguucgagaccagccuggccaacauagggaaacccugucucuacuaaaaauacaaaaaauuagccgugugugguggcgggugccuguaaucccagcuacucgggaggcugagggaggagaauggcuugaaucugggaggcagagguugcagugagacaagauugugccauugugcuccagccugggugacagagcgagacucugucucaaaaaaaaaaaaaaaaaaaagaaaucucggaaauguauugaaguaaaagggcaugagcuuccauuaggaaacaacaauguacaguucuuuguugaaauuuugggugauuggccaggugcaguggcucacaccuguaaucccaggaauuugggaggccaaggcggguggucacuagagaucaggaguuugagaccagccuggauaacauggugaaaccccgucucuacuaaaaauauaaaaauuagcugggugugguggaacaugccuguaaucccagcuacuugggaggcugaggcaggagaaucacuuaacccgggaggcagagguugcagugagccaagauugcgccacugcacuccagccugggcaacaagagcgaaauuccgucucaaaaaaaaaaaaaaaaaaaaaaaacgaggcugggcgugguguuucacaugucuaaucccagcagcacuuugggaggccgaggcagguggaucacgaggucaagagaucgagagcauccuggccaacagggugaaaccccaucucuacuaaaaaaauacaaaaauuagcuggguguggugucaugcaccuguagucccagcuacucgggaggcugaggcaggagaauugcuugaacccgggagacgaagguugcagugagccaagaucgcaccacugcgcuucagccuggcaacagagcaagacuccgucucaaaaaaauaaaaaagaaaaagaaauuuugggugauagacuuuuuuuuuuuuuuuugagacggagucuugcugugucgcccaggcuggagugcaguggugagaucucagcucacugcaaacuccaccucccggguucaugccauucuccugccucagccuccugaguagcugggacuacaggcgccugccaccaugccuggcuaauuuuuuguauuuuuaguagagacgggauuucaccauguuagccaggauggucucgaucuccugaccucgugauccgcccgccucggccucccaaagugcuaggauugcaggcgugagccaccuugccuggcggggugacagacucuuaaugguauuuugaacuuuuagaauaucauaauuagguguuauaaauucuuacuguuuaauucuuucaagugccaugagcuuagaaucuggaaagauccugaaaguacuuacagagaggaaaaugcuggaagcaguaauuaagaggcugggcacagugacucacaccuguaaucccagcacuuugggaggccaaggcaaggcagaucacuugagcucaggaguucaauaccagccugggcaacguggcaaaauccucucuuuuuuauuuuuuuauuuuuugagauggagucuagcuagcucuguugccaggcuggagugcaguggcgcgaucucggcucacugcaaccuccgccucccagguucaagugauucuccugccucagccuccugaguagcugggacuguaggugugcaccaccaugcccagauaauuuuuguauuuuuaguagagacgggguuuuaccauguuggccagauuggucuuuaucucuugaccuugagauccacccuacuccgccucccaaagugcugggauuacaggcgcaagccaccuugccuguccuuuucuuuucuuuuuucuuuuuuuuuuuuuugcucuuggugcccaggcuggagugcaguggcacgaucucggcugacugcaaccucugccucccagguucaagcgauucuucugccucauccuccggcaaaauccugucucuacaaaaaaaaaauacaaaaauuaggcugauguggccgggagcgguggcucacgccuguaauccuagcacuuugggaggccgaggcgggcagaucaugaggucaggagaucgagaccauccuggccaacauggugaaaccccgucacuacuaaaaaacacaaaaaauuagcugggugugguggcgggcgccuguagucccagcuacuugggaggcugaggcaggagaauggcgugaacccgggagguggagcuugcagcgagcagagaucgugccacugcacuccagccugagcuacaagagcaagacucugucucaaaaaaaaaaaaaaaaaaaaauaggcacaugugguuguucaugccuguagucucagcugcucgggaagcugaggggcuucauccugggagguagagauugcaaugagccaagauugcacaauuguacuccauccuggguaaugggagugaaacccugucucaaaaguaauaauaauaauaauaagggaacguuccaaaaccucaucuggacuuguauuuaucugaaucuuuuacaauagacuaaaguagugguuaccaaauucuggcugcauuauuauuauauagguguuuuauuaaaaauagagaauuugcagccgggcgugguuguuuauuccuguaaucccagcacuuugggaggcccagguggguggaucacgaagucaggagauggagacaauccuggcuaacacagugaaacacugucucuacuaaaaauacaaaaaaaauuagccgggcgugguggcgggugccuauagucgcagcuacucaggaggcugaggcaggagaauggcaugaacucgggaggcggagcuugcagugagccgagaucgcaccacugcacuccagccugggcaacagagggagacucugucucaaaaaaaaaaaaaaaaaaaagagauuuugcauuuaugguuuaggaaccucuuuaauacagauuucugagguaguuuuuauguuagcuagguuaggaaaucacuagcauagugcauuuacuaaaaagacaucuuuucagccuaauuaguaauugauugacauuuauaauaucagcugaugaaaacauucacuguggagacuuuucugcacuuuuuugaguaguagguuuuuucaggauacuuugugguuggaauacaauagguaacuaaauagcacucguuaacuguucuuuuugcccaggcucuuccuggucagcagcacugcuauuuccucaacaaggaugcuccucuuccagauggccgaagucuacagggaacccuuguuagcaaaaucaccuuucagcacccuggccgaguuccucuuauccuaaaucugaucagacaccaaguggccuauaacacccucauuggaagcugugucaaaagaacuauucugaaagaagguacugccuuuccuuugauaugcuuacuggaagauggaaacuuacuucuccagugguucuuuaauugguggcccaucagaaucaccuguagaacuuaaaaaaaguuuuuuuuuuuucauauuuggcauaaaaaucaagcaaauuagcugcacgugguggugcacgacuguagucccaccuacuugggaggcugaggaaggagaaucgcuugaacccgggaggcggggguugcagugagcuuagaucaugccauugcacuccagccugggugacagagcaagacucugucucaaaaaaaaaaaaaaauucaaacauguggagcuuuuaacacuacagaugauggccaggugugguggcucacgccuguaaucccagcacuuugggaggccaaggugggcaaaucacuugagcccaugauuugagaucggucugaggaacauggcaaaaccccaucucuagaaaaaaguagccaguugugguggugugcgccuguggucccagcuacucgggauccugaggcaggaggauugucgcuugagccugggaggcagagauugcagugagcucagauugcaccacugcacuccaaccuggguaacacaguaagacccugaaucaaaaacaaaacaccaggcugagugcagugguuugugccuguaaucccagcacuuugggaggccgaggugggcagaucacaaggucaagagauugagaccauccuggccaacuagugaaacccagucucuacuaaaaauacaaaaauuagcuggguguggugguauacaccuguagucccagcuacuugggagucuuaggcaggagaaucacuugaacccaggaggcggagguugcacugagcuuagaucaugccacuguacuccagugugggugacagaaugagacucccucucaaaaaaaaaaaaaaaaucacagaugcuguguuuccacacgaagaugaacugaaugauaaucucagugggaagaguugggaaucuaaacuccacaaaucauuuugauggaaccagucuguagacuagcauuuggagaccacugcuuuuugcaauguucuuaacucuuuuucugaacauaguaauguaacuggguauuuuaggggcuguacccuguagcagauauacauaagguagaacuuggaaugcuguagugagagaggcuuuuuuuuuuuugagacagggucucacucuguugcccagacugaaccacaguggcaugauaacagcuuucugcugccucuaccuccuuggcucaagcgauccuccugccuuagccucccaaguagguggggcuauaggcauguaccaccaagccuggcuaauuuuuucuguagagacagggucucucuauguugcccauguucgucuguaacuccugggcugaagcgauccucuugacuaggccucccaaggugcugggauaauaggugccaccgugcuuggccaguuuuagguuaaauuuuagguuguuaggagagugcuucccagguuuaguucugaguauguuuucucuccccauuguuuggagaacuuaaucuuacagcuuuaagaagguuuagcucuuuuuucucucaggauucuggaaugcugaugaauuuuuuuuuuuuuuuuuuuuuuuuugagacggagucucacucuguuccccaggcuggagugcaguggcaugaucuuggcccacugcaaccuccgccucccagguucaagcgauucuccugcgucagccucuggcuaauuguuuaaauuuuuuuuaguagagaugggguuucaccaucauggccaggcuggucucgaacuccugaccucgugauccacccuccuaggccucccaaagugcugggauuacaggcgugagccauggcacccggcguaaaugcugaugauuuucaaagacaguuggcuauuagaagcuuugcuguaaauuuuggcuguucuagcuaaccauaguuaauuuuaaaaaucuuaagucagaagcgcucuguugauagauaugugucagugccagugauagacaauaagaaauagggaaggcaaaucagaucucuuuuauuuuuauuuauuuauuuuuuguuuguuuuuugagacggagucucgcucugucgcccaggcuggagugcaguggcgcaauuucggcucacugcaagcucugccuccugaguucacgucauucuccugccucagccucccgaguagcugggacuacaggcacccgccaucacgcccggcuaauuuuuuuguauuuuuaguagaaacggggugucaccguguuggccaggauggucucgaucuccugaccucgugaucugcccgccugagccucccagagugcugggauuacaggcaugagccaccacgccuggccuuuuuguuuuuuuuuuugagacggagucuugcuuggucacccaggcuggagugcaguggugugaucuucacucacugcaaccuuugccuccuggguucaagcaauucucuugcuucagccucccaaguagcucggauuacaaguauccaccaccaugccaggcuaaucuuuguaguuuuaccagagacgggguuucgucgaguuggccaggcugguuuugaacucgugaccucaguggucugccugccucggccucccaaagugcugggauuacaugcgugagccaccaugccuggacuuuuuuuucuugauacagggucuugcucuguuaucgagauuggaaagcagugguacagucauaguucacuuuggccucaaacuccugggcucaagugauacucuucccucaggcuccucaagucgcuggacuauaggcaugcaccucuacaucuagucaaauuuuaaagaaauuuauauuauacuuuuuauuucaguguacauauuuauacagcaacauuuuuuuuguagagauggugucuugccauguuguauaggauagucuugagcuccuggccucaggcauuccucccaccucagugucccaaaguguugggauuacaggcaugagccacugugcugggccaggagauucuucucauggaaauaaaaauugcuuuagaaaugagaaauuuuuaguaguuggaguaauaacauagagcauauauguucaaaguuguggcacuucuguuucauguguuaaaaugccuuaagaagucuccagauagcuuuagggcauuuaaaaaugaguuuucauaaggcaguuauggagcuaauccuauagagaggcaugcuuuuuacaaagaaaguauaugauccuugugucuaggcugcuagcacaucuggcauaagaacauaugaugauggcuagauauauguggaauaaauacauuauuuuagauuauagccucuauaucucugcuugccaaacuaugggcugcacaucuaacagcugcaaacacuugauagaaagcagaguuuauggcagugguucuggauaucugcuuaucaaguagaaugagacacucggccacuuuuauuuucagaauucacuuuuacauuuuagggauuaaguuucuucaucuuggaaaauugaaagucuagcuacuuuuguucuggagaaauuuauaacaaacuggcagguuccuuggaaucugauuccuucugucaucuguggaugacauauaguagguuuuguaugugaaaaaagugugcgauuuaguuuccaaggagggagagagaauuucagucuguacauuuaaggaauguuauuugugugaagucuuuuuuuuuuuuuuuugagacagaguguugcucuguuucccaggcugggguucagugacaugaucucggcucacugcaacccuugccucccagguugaaacgauucuccugucucagcccucugaguagcuaggauuacaggugugcgccaccacacccggcuaauuuuuuuuuuuuuuuuuuuuuuuuuugagauggagucuuacucuugcccaggcuggagugcaguggcacgaucucagcucacuacaaccuccgccuccuagguucaagugauucuccugccucagccucccgaguagcugggauuacaggcaugugccaccacgcccgacuaauuuuguauuuuguauuuuuaguagagaugggguuuguccauguuggucaggcuugucucgaacuccugaccucaggugaugagcccaccucagccucucaaaguucugggauuacaggccugagccacugcauccggccucuuuuuuuuauuuuuuaguggaguugggguuucgccauguuggccaggcuggucuugaacuccugaccucagguaauccaccugccuuggccucccaaacugcugggauuacaggcgugagccaccgugcccagccugugugaagucuuauauuugguuguuuuaugaucuuucucuuugccuuuuagauucuccugggcuucuccaauuugaaguguguccucucucagagucucguuucagcguaucuuuucagcacccugugaaugacucccugguguguggugaguuguguggguggcuaacaccucucauggagcgguuuggucccuaugucuuuuuuggaaaagucagaagcuaaaucuaaaacaauuuccuauguauuuugucuuucagugguaauggaugugcaggacucaacacaugugagcuguaaacucuacaaagggcugucggaugcacugaucugcacagaugacuucauugccaaaguuguucaaagguagccuuggcccuuuuucaucugagucccauuuagagauguauaaagaauguuguugaguagggcgcgguggcucacgccuguaauccccacacuuugggaggccgaggcaggcggaucacgaggucagaagauugagaccauucuggcuaacauggugaacccccaucucuacuaaaaauacaaaaauuagucaggcgcgauggcgggcacauguaguaccagcuacucgggaggcugaugcagaagaauaacuugaaccugggagguggagguugcagugagccaagauugcgccauugcacuccagccugacgacagagcaagacuccguguuuuuguuuuuguuguaaaaaaaaaaaaaaaaaaaaaaaaaaaaaaaaaaaaaaaaggccgggccugguggcucacgccuguaaucccagcacuuugggaggugaaggcggguggaucacgaggucaggagauugagaccauccuggcuaacacagugaaaccccgucucuauuaaaaauacaaaaaauuagcccggcaugguggcgggcgccuguagucccagcuacuagggaggcugaggcaggagaauggcaugaucccgggagguggagcuugcagugagccgagaucaugccacuguacuccagccugggcaacagagugagacucugucucaaaaaaaaaaaaaaauguuguuuucagaauuagcaugaauuucaaauaaaggagcaauuuaguuauugcuuugauuucacccuucucugcuuucggauucaaaguaaucuaagcuuuguuuuuuuuuuuugagauggagucuugcucugaugcccagauuguacagugguacaaucuuggcucacugcaaccucugccucccggguucaagugauucuccugccucacccuccugaguagcuaggauuacaggcaugugcuaccacaccugacucauuuuuguauuuuuaguagagacgggguuucaccauguuggccaggcuggucucgaacuccugaccucaggugaucugccugccuuggccucccaaaguucugggauuacaggcgugagccacugcacacagccagcuuuguuuuuuuuuuuuuuuuuuuuuuuuuaaugauauuacuaugagaguaaugggaaguaaaguagguaacuucaggccuggaauuaugguacuuuaaggcaggagaaagccauaauaaaauacagauauuuuucuuaccuauccugugugccaauucuucauagaugugacauuuuuaucuuuuuauucuuuuauuuuuuuauuuugagacaagagucucacucuguuacccaggcuggagugcaguggugugaugacggcucacugaaguguugaccuccgagguucagguuauccuuccaccuagaccuccugaguagcugguacugcaggugugagccacugugucugccugagcagauuucacaacuuaaauguuaggcugggcguggcagugcaugccuguaauccagcacuuugggaggccaaggcgggcagauuacuugaggucaggaguucgagaccagccuggccaacauguugagaugucaucucuauaaaaauacgaaaauuaaccgagcauggugguauccgucugucauucuagcuacuugagaggcugaggcaggagaaucacuugaaccugggaaucggagguugcggugagccaagauugcgccacuguucuuuagccugggugauagagugagauucugucucaaaacaaacaaacuaacuaaauaaauaaaaauauaaaaauuagccaggugugguggcaggugccuauaaucccagcuacucaggaggcugaggcgggagaauugcuugaaccugggaggcggaggcugcagugagccgagauugugccacuccacuccagccugguagacagagcaagaugccaucucaaaacaaacaaaaagccaacuuaauuguuacgugauaguuaagccaguaugcaucccagaaccauuaauauguaauuuuuugagauuuuucuacagcugggucuggcagccuauuuuuguaaauaaauuuuauuggaacacugcuguucauuuacaugucuguggcagauuucuaguuaauauugcagaguaggugaacaggaaacaagaccuacaaagccuaacggauuacuauauggccuuauaagaaaaauuugcggccgggugcgggggucaccccuguaauccuagcacuuugggaggcugaggcggguaaaucacgaggucaggaguucaagaccagccuggccaagauggugaaaccccaucucuacuaaaaauacaaaaauuagcugggcgugguggcgggcuucuguaaucccagcuacuugggaggcugaggcagagaauugcuugaaccugggaggcggaaguugcgguaagccaagaucaugccacugcacuccagccuggauaacagagcgagacucugucucaaagaaaaaaaaaaaaaaaaaaagaaaaauuugcuggcugggugugguggcucacgccuauaaucccagcacuuugggagguggguggaucgccugaggucaggaguucgagaccagccugacugacauggagaaacccugucucuacuaaaaauacagaauuagcugggcgugauggcgcauggcuguaaucccagcuacucgagaggcugaggcaggagaaucacuugaaccugggagguggagguugcagugagccaagaucgcgccauugcacuccagccugggcaacaagagcaaaacuccgucucaaaaaaaaaaaaaaaaagaaaaaaaaauuugcugacauauguucuagagcaaaacguuugcaaacugagguuuaugaauauaaauuuaucuggaaaauaaaaagugcuuugcuuuaaaauaaacaagauuuauaacagaaauagcacuuuuuauaauaguguagguuugggaugaucuaagucauuaagguuuaguacuuaaugggucaagagauuuuucuuuucuuuuuuuuuuuuuugagauggagucuuguacugucaccugggcuggagugccauggcacaaucucagcucacugcaaccucugcuucccggguucaagcaauucugccucagccucccaaguaguugggauuacaggcaccugccaccaugcccagcuaauuuuuuguauuuuuucuuuuuuuuaguagagaugggguuucacuauguuggccaggcuggucucaaaacuccugacccugugauccacccgccucggccucccaaagugcugggauuacaggcgugagccacucugaccggcggagauuuuucuaaugguuccuuaauuaaaauaaauuauguaucccuguaauuaccauaugaagccccccagaggacgacauuuucuuuuuuccuuugaaaugaagucuugcacugucaccaaggcuggcgugcaaugggacgaucuuggcucgcugcgaucucugccuccuggguucaagugauucuccugucuacccuuccugaguagcugggauuacagcugugcaccgccacggcuggcuaauuuuuuguauuuuuaguagagacaggguuucaccccgcuggccaggcuggucucaaacuccugacccgaagugauccacccuccucggccuuccaaagugcugggauugcaggagugagccaccgcgcccgaccuaaggaggcauuuuuuuuuuugagacggagucucacucuguugccaagcuggagugcaguggugugaucucagugcaaugcaaccuccgccucccuuguucaagcaauucuccugccucaaccucccgaguagcugggauuacaggcacgcgccaccacgcccagcuaauuuuuguauuuuuaguagagacgggguuucaccauguuggccaggauggugucgaucuccugaccucauguuccagccgccuuggccucccaaagugcugggauuacaggcgugagccacugugcccggccccuaaggaggcauuuucuuacugaguuccauuauuaccaauuuucuuuuaguuaaguuugaaauucaauuauuuggacucuuguuuauaguuugcuuuuguugugugauucauaagagguugacaauuuuauguuggguuagauuuuuagaauguauuuacccaaagcucugguauuugauagaacuauuuuugucuuacagauuauuugcccuaccugaaaacugcuuacugcaaaacucugauguuauaucuaaaucucaggucucauucagcagcuauugcaauguuaacuuuguuuucuucuuuauuuugcagauguauguccaucccugugacgaugagggcuauucggaggaaagcugaaaccauucaagccgacaccccagcacugucccucauugcagagacaguugaagacauggugaaaaagaaccugcccccggcuagcagcccaggguauggcaugaccacaggcaacaacccaaugagugguaccacuacaccaaccaacaccuuuccggggggucccauuaccaccuuguuuaauaugagcaugagcaucaaagaucggcaugagucggugggccauggggaggacuucagcaaggugucucagaacccaauucuuaccaguuuguugcaaaucacagggaacggggggucuaccauuggcucgaguccgaccccuccucaucacacgccgccaccugucucuucgauggccggcaacaccaagaaccacccgaugcucaugaaccuucuuaaagauaauccugcccaggauuucucaacccuuuauggaagcagcccuuuagaaaggcagaacuccucuuccggcucaccccgcauggaaauaugcucggggagcaacaagaccaagaaaaagaagucaucaagauuaccaccugagaaaccaaagcaccagacugaagaugacuuucagagggagcuauuuucaauggauguugacucacagaacccuaucuuugaugucaacaugacagcugacacgcuggauacgccacacaucacuccagcuccaagccaguguagcacucccccaacaacuuacccacaaccaguaccucacccccaacccaguauucaaaggaugguccgacuauccaguucagacagcauuggcccagauguaacugacauccuuucagacauugcagaagaagcuucuaaacuucccagcacuagugaugauugcccagccauuggcaccccucuucgagauucuucaagcucugggcauucucagaguacccuguuugacucugaugucuuucaaacuaacaauaaugaaaauccauacacugauccagcugaucuuauugcagaugcugcuggaagccccaguagugacucuccuaccaaucauuuuuuucaugauggaguagauuucaauccugauuuauugaacagccagagccaaagugguuuuggagaagaauauuuugaugaaagcagccaaaguggggauaaugaugauuucaaaggauuugcaucucaggcacuaaauacuuugggggugccaaugcuuggaggugauaauggggagaccaaguuuaagggcaauaaccaagccgacacaguugauuucaguauuauuucaguagccggcaaagcuuuagcuccugcagaucuuauggagcaucacagugguagucaggguccuuuacugaccacuggggacuuagggaaagaaaagacucaaaagaggguaaaggaaggcaauggcaccaguaauaguacucucucggggcccggauuagacagcaaaccagggaagcgcagucggaccccuucuaaugaugggaaaagcaaagauaagccuccaaagcggaagaaggcagacacugagggaaagucuccaucucauaguucuucuaacagaccuuuuaccccaccuaccaguacagguggaucuaaaucgccaggcagugcaggaagaucucagacucccccagguguugccacaccacccauucccaaaaucacuauucagauuccuaagggaacagugauggugggcaagccuuccucucacagucaguauaccagcagugguucugugucuuccucaggcagcaaaagccaccauagccauucuuccuccucuuccucaucugcuuccaccucagggaagaugaaaagcaguaaaucagaagguucaucaaguuccaaguuaaguagcaguauguauucuagccaggggucuucuggaucuagccaguccaaaaauucaucccagucuggggggaagccaggcuccucucccauaaccaagcauggacugagcaguggcucuagcagcaccaagaugaaaccucaaggaaagccaucaucacuuaugaauccuucuuuaaguaaaccaaacauauccccuucucauucaaggccaccuggaggcucugacaagcuugccucuccaaugaagccuguuccuggaacuccuccauccucuaaagccaaguccccuaucaguucagguucuggugguucucauaugucuggaacuaguucaagcucuggcaugaagucaucuucaggguuaggauccucaggcucguugucccagaaaacucccccaucaucuaauuccuguacggcaucuuccuccuccuuuuccucaaguggcucuuccaugucauccucucagaaccagcaugggaguucuaaaggaaaaucucccagcagaaacaagaagccguccuugacagcugucauagauaaacugaagcaugggguugucaccaguggcccugggggugaagacccacuggacggccagaugggggugagcacaaauucuuccagccauccuauguccuccaaacauaacaugucaggaggagaguuucagggcaagcgugagaaaagugauaaagacaaaucaaagguuuccaccuccgggaguucaguggauucuucuaagaagaccucagagucaaaaaauguggggagcacagguguggcaaaaauuaucaucaguaagcaugauggaggcuccccuagcauuaaagccaaagugacuuugcagaaaccuggggaaaguaguggagaagggcuuaggccucaaauggcuucuucuaaaaacuauggcucuccacucaucagugguuccacuccaaagcaugagcguggcucucccagccauaguaagucaccagcauauaccccccagaaucuggacagugaaagugagucaggcuccuccauagcagagaaaucuuaucagaauagucccagcucagacgaugguauccgaccacuuccagaauacagcacagagaaacauaagaagcacaaaaaggaaaagaagaaaguaaaagacaaagauagggaccgagaccgggacaaagaccgagacaagaaaaaaucucauagcaucaagccagagaguugguccaaaucacccaucucuucagaccaguccuugucuaugacaaguaacacaaucuuaucugcagacagacccucaaggcucagcccagacuuuaugauuggggaggaagaugaugaucuuauggauguggcccugauugggaauuaggaaccuuauuuccuaaaagaaacagggccagaggaaaaaaaacuauugauaaguuuauaggcaaaccaccauaaggggugagucagacaggucugauuugguuaagaauccuaaauggcauggcuuugacaucaagcugggugaauuagaaaggcauauccagacccuauuaaagaaaccacaggguuugauucugguuaccaggaagucuucuuuguuccugugccagaaagaaaguuaaaauacuugcuuaagaaagggaggggggugggagggguguagggagagggaagggagggaaacaguuuugugggaaauauucauauauauuuucuucucccuuuuuccauuuuuaggccauguuuuaaacucauuuuagugcauguauaugaagggcugggcagaaaaugaaaaagcaauacauuccuugaugcauuugcaugaagguuguucaacuuuguuugagguaguuguccguuugagucaugggcaaaugaaggacuuuggucauuuuggacacuuaaguaauguuuggugucuguuucuuaggagugacugggggagggaagauuauuuuagcuauuuauuuguaauauuuuaacccuuuaucuguuuguuuuuauacaguguuucguucuaaaucuaugagguuuaggguucaaaaugauggaaggccgaagagcaaggcuuauauggugguagggagcuuauagcuugugcuaauacuguagcaucaagcccaagcaaauuagucagagcccgccuuuagaguuaaauauaauagaaaaaccaaaaugauauuuuuauuuuaggaggguuuaaauaggguucagagaucauaggaauauuaggaguuaccucucuguggagguauugacuuguaaucucauuuuccuuucaaaaaaaaaaaaaaaagcuaagguggcuuguugggauguaaacauguuuucagaugcaguaagguuuaguguaggacagccuuccugacccaguggcaugaaaaccauuacaggauuaauaguucuccuacuuccacaaugugccaaaagucugcaucccagcauuuuguuugcaggagaacugaugccauuccuaagagcuggacucacuguuucucuucaucacaaggagaaggaguccaaacuuuaaucacuccacuguaugcucccugagauaaaacaguaaaaaauccgcagccauaguucacuuaaaacaauuucaagcucacuuuugaaguaaugggggccuggaaugcuaggugagcaugaagauaaacccuugcuacuauguagcaacccaauuggaccuuuuuggagaaauaggucugagucuggauucugggggacaucaauaagagcccuucacauaaaaauauagaaauccaggagacuguuucgagugcaacagaaguucucaguauuuggaggguccucucaaaaauucugcggccuuacuuugauauugacaccugcacugugccauuccugauuauuccauucaggaucuguaucagcgggauggggcaugguccccagcacaacucuucuggguuaaaaaaaaaaagccaggugauuccuuuguguguuaugucguaaguggagugacuucaucauauauggaagaagauuucuauauucagcuuuuucugcagguuggagucagcauagaguuggaaaaucagcuuuggcuuucuuuccugucucauuuccucuaguguucuccuuuuuauugucaucagcucucaacaacucugccacuuuugugucccaagguaauaagauguaggaaacaaaacauuguaaaguggagcaagaaaaguuaucaauuaaccacaucagagucaaaugucuugggugacacuaaggaggauaugggcaggugauaccagagugcuuuaucuugugauguugauacaguagcagccucucagacauucagccagguuggauuucucaugaguuugucaccuaguuuugaauccuaucccguugguuucugcaggaaaaaaaaaaaaauuuaugugguuuuuaaaauuuguucugaguggggagaaucuuagggggaauguacugaauaguaucaugggcucagcucccccaugcagggccaacaaauaccaaaaugaguaaacugggaagcuuuucucucuuucugucuucaucccagaucaaagaaucccgaguuaggaucuggaugaaggauaagccccugaauugucgaugggcucacccccacacugacccagcaucugaacuugcuuaacagggagccggggcuaaacugcuucacccugccugagaaccagggagcacugcauuucuccacaggguggaggagaagaggcagaauaaaccaagccugggacaccucccuccugucuagguguacucauucuucuguuucaaaagaaggcaaggacaugaagucaacuucuaccuaucuucugcugcuggugucuuauguauucucaguuugaccugauuccucuucugucuuuugacuuaacauuagggguucuuggucauaaccugcucugauguacauaaagauuucagguucaauaucaaugugucuuaaaacagaaguauuuuagcgggugggggguggggugguggggacaaacaacgcaggauauaauugccaaaaccaggcuugagguuggugacucuugaaagauuuucuuucuucaggccuagaucagaaaauuaagugcagcaauaucaugaauucucagaagcccuuucagggagccagugagucauacaguauccacaguugagucacuuaaagaugucaguauacgaaacauuauucacaauccuugggcaaucucauuuuuuuuuccuucuccccuccuccccugccccccauacauuucuauccuugaguuaguuuuggaggggcaggaaguacuuaacaucucagaagcuagauugggaaacaugcucagcuauaagaacugagcuuuaaauuuugaguuuaaaaauguacaucaggagcagcuggggagggucuuuuuuuaaaaaaaucuuucaaauuugguuuucugugcauauggccguuuuguaaauacuuugggguuuuucauuuuuuugaaaguagaugaaaucuguugugggauuuuuuucccgaaacauuacaaaauaaccuguuuauuuacaugcaaauaaacuucuuugauaaaaaguaa

SEQ ID NO: 192304 - RNA, 40745 nt, Homo sapiens
ggccuuccucucccgcuuccgccuggcguaggagcugaggcauggccuuguucuccagcugagaggacgaucguccuuauaggagaggccgagucuccgagggcaauuucagaggucuggugcgaggugggggaagcggcgcggcgucgaugacgacuuccuuacaucgcccccgacccccgcguucucuuguuaacuucugugcauuguugccugucugcacuuuccgucuccaaaaccuuugcucuccucaccccguuuucccuuguaauuauaccccagcgaucacuagucuggguucgaagugauugugugucuccauaauugaccugguugcccccgguuaucccagaagucaaagaugacagagaaaaaaaggaagagcgaggggcuuaucucguguucucuacgucagacuccucuuccccuguccuuccugggugaucuuuauccuucccagcacuguucuuucuuaaguuaagcaccaaggaagagggcaacugcuugggcgcuguuggcacuccgaagcagccgcagugguucgagauugccagucggacuagccaagggagcugcugagugagugguuuucgagaacgcucuagauucuggcaacaguuaggccagauuauuggaagugggguuggaacagaguuguggguagucauacuuguucuaauccuaaagcagaauugacaagaagguucuagaaguuuggagcccuuuccuuaucagcugcggguuagucugacccuuuuguucaagauaucuacagugcccucagucucuuugcaacauacuuuauaucuucauaccaagcccguugugucuucaggcuggguaauuugaggcggugauguagaauuaguucaugagaucugaaaucaggauucugagauuuuuacuaucuaaugaguucgaaauauaagaaguacucggacgcaaugaauaguuaucaagcuugagggugguuaccacagccagaucucaaguuccugaucugcugggagcugaggggccugacaaaguguaauaggccccugggauaucagagaagccaggacaccagaguccagucucuguucuuaauuuugagcuuucauguuguuccuacuucuuccuagauauuuaaagcuaagcaucaucaacccuuauacaucauuaaagagcugcacaaugggaaacaaaauuccucccagugcagacggagcuuaaauuaauuguagagauuuacuuguauuuggaaagaguucagugguucuuuauacuguaaauagggauuuggccacagguuauuuauuuuuuauuuuuugagacggaaucucgcucugucgcccaggcuggaguguaguggcgcgaccucagcucacugcaagcuccgccuccugaguucacaccauucuccugccucagccucaccaguugcugggacuacacgugcccaccaccacauccggcuaauuguuguuuuuuuuuuguauuuuuaguagagaugggguuucacccuguuagccacgauggucucgaucuccugaccucgugauccgcccaccucggccucccaaagugcugggauuacaggcgugagcuacugugccgggcuggccauagguaauuuuaaaaacucacccuacucauuguaaaucucugauguagagugucccuauuuuggacuucauuucauagccuccuaucuuaagcaaauacauuucuucaaucacagccuuagaggauagucuaucauaaaauuggaguaaaugaaccugaagacauauaauaaaauagguuaugcuguaaugugaccacaucacacaaaacaugguauuugauagcaguacaacaaaauaagguaaacuaccuuauuucauggaauuuaagugucauuaggcugggugcaguagcucacaccuguaaucccagcacuuugggaggccgaggcaggugggucagcugaggucgggaguuugaaaccagcauggccaacauggcagaacccugucucuacuaaaaauacaaaaauuagcggggcgugguggcacacacauguaaucccaguuacacgggaggcugaggcaggagaaucgcuugaacucaggagguggagguugcagugagcugagaucgggccauugcacuccagccugggugacaaagugagauuccaucucaaaaaaaagucauugauugcagaaugcaaauuauuuuaucugucacuaagaaaauguaacuguaaauuaaacaugacaacaugcauuauuccuguaguucaaauagugacagaaaaaaauuaauuaaaaaaagaaaaaagacugggcgugguggcucacaccuguaaucccagcacuuugggaggccaaggcggguggauuaccugaggucaggaguucgaaaccagccugacuaauacggugaaaccccaucuacuaaaaauacaaaaauuagccagguggggugaugcuguaaucccagcuagucaggaggcugaggcagagguuguggugaggggagaucaugccauugcacuccagccugggcaacaagagcaaaacuccgucucaaaaaaaaaaaaaucaauuaaaaaaagaaaaaaaugcauucuuaucagacuuuuauguuucucauauauagcacuguuuucgacagacuuaaacauaguuauuuauuauauaccacuuuuuugcacaaaucaaaaggaaaauuggcugggugcaguggcucacacuuguaaucccaucauuuugggaggcugaggugggcggaucacgaggucaggaguuugagaccagccuggccaacauggugaaaccccaucucuacuaaaaauagaaaaaauagcugggcguaguggugggcaccuguaaucccagcuacucgggagucugaggcaggagagucgcuugaacccgggaggcggagguugcagugagccaaggucacaccauugcacuccagccugggcgacauggugagacuccauuucaaaaaaaaaaaaggaaaauaagugaaauaaacaaaaaaaucaguuuaacuuuuugccauaucagacauccuuagaagaauaaacauuggccgggcgcgguggcuuaugccuauaaucccagcacuuugggaggcuaaagcaggcugaucaccugaggucgggaguuugagaccagccugaccaacauggagaaaccccaucucuacuaaaaauagaaaaaaaaaauuagccaggcauggcggugcaugccuguagccccaccgacuuggaggcugaggcaggagaaucacuugaauccgguaggcggagguugcggugagccgagaucgugccauugcacuccaaccugggcgacaagagugaaacucugucucaaaaaaaagaauaaacauuaggcucuguuaguaugaaaaagccuuguuuauguaugauuuuuccagugcugaaaaugggauggagauuuagaagcuuuggagggaggugguuuuauguuuuucauguguccuggauuccucuuguguggccauagcagagggcagugauaggggcaucccuuacaaaugcccuuuuacugucuggcuugguuagaguucuuuggccaaguuccugccucuguuguuaugguccuccuaccaguucauuuagggaucaagaguuaaugagucucucgggucguuuuugugagguccagcuuuguaaggaguccuuccuuccuuacgucuuggcuuaagacauguccugcugcugcuaaguugucacagucccauaggggggcaaaaugagaggagcuuuuaagacggacuucacgauugcagcauuuuaaauggcuacauguuuuauuuccuuagcuuuaguguuucuguagagaaaagagauggauuucaauuuuuuugcaugucacucugacaaaguucuguuucccuuacagcagccaagaaacuaaaauaaggcuaggcuuaguggcucaugccuguaaucuuagcacuuugugaggccaaaaugagaggaucgcuuaagcccaguaguuugagaccagccugggcaacauagugagacuuagucucuauaaaaacauuuaaggcugggugcgguggcucacgccuguaauuccagcaccuugggaggcugaggccaguggauugcuugaggccaggaguucgagaccaaccugggcaacguggugaaacccgccccccaucucuguaaaaaaaaaauacaaaaauuagcagggugugauggugcauaccuguaggcccugcuacuugggacgcugagguguaaguaucaccugagcugggggaggucgaggcugcagugagcugcgaucacaccacugcacugcauccugggugacagagugaaacccugucucaaaaaaaaggguuggggcuaaaauaaaagauauauuaguuggcacuccaaaacagaucaggauucuaugcaugaagauuauuucucuuugcucaccaaaacaggcaaagcuauuuaugagccagaggguuaaacuucagauguuucacauuucaacuaacuuaaggcuuuauauuuuccugggaaguugcugacugcuuuaccuaauaugggaauaccugucuugaauuaaggaucucuuguuauaucuccugggcugggaaacagcuugaucucuauagggagucuuucuuaugguaaacuugagggauuucaaauuguuuucuuuucuuuuugacggagucucgcucugucaccaggcuggagugcaguggugugaucucagcucacugcaaacuccgccuccuggguucaaaugauucuccugccucagccucccgaguagcugggacuauaggcgugugccaccacacccagcuaauuuuuguauuuuuaauagagacggaguuuuaccauguuggccaggauggucucgaucucuuaaccucaugauccgcccgccuuguccucccaaagugcugggauuacaggcgugggccacuacacccaaccucaaauuguuuuucaaagagaaaacacuuacgugucucagcauauaccuagugugacuggacaacaagaucuaaaagaaucaagggauccauagacuuaagagucaggacauccuuaccugauuccuugagcugauaaacuuaacuucucuguauguuuuccugaugggcacaaauaagagcaauucuuauuaggcccuuacuaccuagguauuguacacucuuugcgauuaggauuuugccuuuuauuucucuauucagauuguuaaugggaacaacugaacucucaauucaugucccggguuuccuguaguugcuguucguuugcugcagcuuugcaugguguuuuugaguuuguggccucacuuaacugaagagcuugugggcaugccuccccagcuuucuuccuuaccugguuuuaaauucuuaggaauguguccuucuaaucuuccucuugaaguuucagagcaagcaccuagacauuucaguaagccuccaaacugagugggaauuuaucuuugaccuggaacccaaaucagugagaaacacuauuuuccuuuugcugugcacuaaguguagucagaugugaagaaaugggagaugggaggagaaauaaguuaaggaagggauaaaccuaggaauacagaauucucaauaccggcaaauuaauugaacccugauacuaacagauggcaaaguagauaaucauaacuggagcaaagguagaguacagagaaagguucucucuuagugcuuuaguucagauccacauguuaacuagugccagagaaacaagaauuuugagaaaauauagggccaagugaguggcaguugcuuagaguccaguccacucccaacaaacagaacucugauuggccgaaagcccagccuuauuguacauuccagccaaucagggauuaguuuagucauugaaguuuguauuuuaaugguuuugaaaagcugaguacugggcacuugcuuuuuuguucuucgggacuuuagaaguuuggagaacaauagucagcaguugccuaguugcuuuguggccugaugcagagucccucugagagcccauuucucccuuacugcacuagucuuugguccccuuucuccagcacugagugauguggaaguuacucagaggucuuuccagguauucuuuuaaacuuuugaaguaagaacaaaauucaaagugcaguuauccuaacaggcuauucauuuuauuggagugacacuguuuuuccuucucccauucggaucaaaauggcaauuccuauguuuuacccucaccauggguaagaauaugagugguugaggcuuuugagaaugguaauaggaggaauauaugacucucaggucuuauucugagacgugaaauucuauuggcaugugacuuacaauuuguguggggaggccagauugucagauaagcaguguuaaccaucucucuugauucuaauauuacuuuuggagagagugugaggggcaagcaggacccucucuuguuuuuggaguuucuguccugagaguucuuccuuggacaguuugcccugagacaguuaaccaccuguugaacuaaggaaccaagacaacuuugagaagugaaauaccguugacaauccaggcuccuccccacucuaguucccaucuccaccccaccccacuccacccaaaaaaacucaggaagcagccuuuauauauauauauuuuugagacagaguuucauucuuguugcccaggcuggagugcaauggcgcaaucuuggcucacugcagccuccgccucccggguucaagcaauucuccugagucagcuuccugaguagcuggaauuacaggcaugcgccaccacgcccggcuaauuuuguauuuuuuuuuuuuuuuguagagacaggguuucuccauguuggucagucuggucucgaacucccgaccucaggugauccacccgccuuggccucccaaagugcugggauuauaggcgugagccacugcacccggccuaggaaguagccucuuucuuucucucuuucugucugucucuuucuuucuuucuuucuuugugauggagucuugcugugucuccaggcuggagugugcaauggcacgaucucggcucacugcaaucuccgcuuccuggguucaagcuauccuccugccucagccuccugaguagcugggacuacaguugcaugccaccaugcccagcuaauuuuuuauauuuuuaguagagacggguuucaccauguuggccaggauggucuugaucucaucaccucaggaucugcccgccucggccucccaagugcugggauuacaggcgugagccacugcgccagggcaaagcagccuuuuccuuaauuguaguuccucaguuuuaaauuuuugaugggugcuggugucccuauagugggagaugucacagaauagggaaccgagggauggaaaaugguggguuuggggauauguuaugaaaacaagccucuggcuaaugcugaaaagccagugacuuguauccucagaaugguuucagagaagcauguuucccagaaguagcuucauuguugggucuccucuccccagggauaagugaagguuagguagauguaauagauugugacaccucucauuuaaggaccuaaaauaaauuuccaacucaccguugagacaaguauuuccaagugaauauguuucugccugcagugaugggauuucuguagggauugaauugguugcuugcuuuuucuuccuuacugaauaaggcauagccagcugcauagccaggcacagcuugcuggcugguguccgucccugccugaacaguagggagugcugcugcuuuguguagacagucugugacuccucuggugcauuuugggucccuucugacucugcccguguugaggcuucuccuugaauguccacccagaggacaauuugaacugguauguuaaggaauuuucuucaucuucugccuucucuuuauuagcggagauguguggaggguuguuccauuugugcuuuaaagugaaaacuaucuauucuguaggaaauuggguaaagaaagcugaguagcagauagcuuugcuaaaagguagcaguuggauagcgcucaccuucuauuuuuuucuggaugaagcaccgagcauaaauaccuugccauauuuauagaauuauuccaagucauauaucuauggcccggcgugauggcucacgccuuuaaucccaacacuuuggaaggcagagauuggcggaucacuugaggucagaaguuugaagaccagccuggccaacauggcaagaccucaucucuacuaaaauaaacaaagauuagccaggcaugguaguggggcccuguaaucucagcuacucaggaggcugaggcaggagaaucacuugaaccugggaggcagagguugcugugaacugagaucacaccacugcacuccagccugggcaacaagagugagagucugucucaaaaaauauaugucugacccggcgcgguggcucacgccuguaaucccagcacuuugggaggccgaggcgggcggaucaugaggucaggagauugagaccauccuggcuaacacggugaaaccccgucucuacuaaaaauacaaaaaaauuagcugggcgugguggcaggcgccuguagucacagcuacuugggaggcugaggcaggagaauggcgugaaccuaggaggcggagcuugcaaugagccgagauggcgccacugcacuccaaccugggugacagagcgagacuccgucucaaaaaaaaaaaucuauaucuauauauauauaucuauaccugugacuuccacuuaucuaugugaaacuuauauugacauuucacuuguagaauaguagauuuuuuuuuuuuucuuuuuugagacggagucucacucuugcccaggcuggagugcaauggcacagucucggcucacugcaaccuccgccuccuggguucaaauaauucucccgccucagccucccgaauaggugggauuacaggcacccuccaucaugcccggcuaauuuuuguauuuuuguagagaugggguuucaccauguugccuaggcuggucuugaacuucugaccucaggugauccacccuccuuggccucccaaagugcugggauuauagacaugagccaccuugcccagccuagauuuuuuuuuaaaaaagaaacuucuuaccgggcacaugccuguaaucccagcuacuugggaggcugagacaggagaaucaguugaaccugggaggcggagguugcggugagcugagaucacgccauugcacuccagccugggcaacaagagcgaaauucugucucaaaaaaaaaaaaaaaaaaaaaaaaggcaguuuuuucuggccaauugugguggcucaucauguguguaaucuuagcacuuugggaggcugaggagguggauugccugagcucaagaguuugagaccagccugggcaacauagugaaaccccaucucuacuaaaauacaaaaauuuagcugggcaugguggugcgugccuguagucccagcuaccagggaggcugaggcacaagaaucgcuugaaccugggaggugaagauugcagugagccgagaucucaccacugcacucuggccugggcaauagaaugagacugucuccaaaaaaaaagaaauuuuuuucuuaaagaagaaucuaaaugauaugcuuuugguaagauggaauagaaguuaggcuccugggcuccuuuuacuuuauuuugucaugaaggucagggagagugcaacaugaaacaggcccugugacaugccauuggggacaagaggucucggacugugggaaggaggaaagaauuucuacucugacuggccaagaucccgugaauucugaaggguggagggcauuucuagaucaacaggcaacuaguaaguuugacugaauaaaauaaauggagcacaacaaucauagaguaaggcgacauuuggggaguaguaaauauaagaggaaugcauaagggauauugacucauuggcaguauaaaguauuauuauuaauagccuaaaggaaaagaaaaguaucuuuuucuuuuucuuuuuuuuuuuugagacaggaucuugcucuguugcccaggcuggagugcaguggcgcgaugucagcucaccgcaagcuccaucucccggguucacaccauucuccugccucagccuacugaguagcugggacuacaggcgccugccaccuugccuggcuaauccuuuuuuguacuuuuaguagagaugggguuucaccguguuagccaggauggucuugaucuccugaccuugugaucugccugcccagccucccaaagugcugggauuauaggcgugagccaccgugccuggacuuuuuuuuuuuuuuuuuuuuuugagacggagucuugcucuguugcccaggcuggagugcagugguguaaccuuggcucaucacaaccaccgucuccuggguucaagggauucuccugcaucagcgucccggguagcugggauuacaggugcaugccaccacgcccggcuaauuuuuguauuuuuaguagagaugggguuucaccauauugaugaggcuggucucgaacuccugacuucaugaucugccugccuuggccucccaaagugcugggauuacaggcgugagccaccgugcccagccugguuuuguuuuuuuuaaaggcagggucucacucugucacccaggcugcaggaacaugguuugcugcagccucgaccuccugggcucaggaggucuucugccucagccuccugggauuauaggcgugagccuauaauuucccaaaaauuaaauaaauaaauaaauaaauaaagcucuuuucucaaaaaaaaaaaaauuggccaggcgugguggcgugugccuguaaucccagcuacucaggaggcugaggugggagaauugcuugaacccaggacguggggguugcaaugagccgagauugcgccacugcacuccagccuagguaacagaggugacagaggucaggagauugagaccauccuggcuaacacgaugauaucccgucucuauuaaaaauacaaaaaaaucagccaggcgugguugugggcaccuguagucccagcuacuugggaggcugaggcaggagaauggcaugaaccugggaggcagagcuugcagugagcugagaucacgccacugcacucuagccugggugacagucagacugugucucaaaaaauaaaaaaaauuaaauaaauaaauaaauaaagcucuuuucucaaaaaaaaauuggccaggcaugguggcgugugccuguaaucccagcuacuagggaggcugaggugggagaauugcuugaacccaggagguggggauugcagugagccaagauugcgccacugcacuccagccugggugacagagccagacuucgucucaaaaaaaaagaaaaaacaaaaucaaaccacagugcggugugcuuuuugucauauaaaauuuggauccacauuuccuagguuacaaguguugcagaauaaugaaaccaugcuagucuguuuuucaugcagugagguggaauaaauuuuaaaaugaugaagaaucucaucccuguuuuaauaaucugcaaauacgugauaugucaagcaauuccagagagaacccagccauguuaaugacauuuuaaaaacuaccacacaauuaauucugcauuaguguaggcugacuaaaguuucugauugaugcuuuaauugcuaaaaguuagacuaguugacccaacgcagagaucuuaaguguucaacuuggaaguauuuagagagaaaauggaaauuuuuauagggcaucuaauuuggggcauguugcaaugucaacuaugauguuuuaauguguuuuuaauuuaguugagcuguaaaugugcaaaguuggcuagcaaccauaagcccaaguugucugauuuaaucacaugaugcugagcccugcuaagaccugugugauaccaaaugauucccuuagcaguguuuguuggaguaauuagugucagcaaugaaugaaugcugaauugagagagauaauguaacuacaugucuaaaggauauacagauuuuaacgaacauuuauuguagaagagcaaguuuucaaagcugcaguuuucuuacuggugggugguuuuguuuuuuugagacagucuugcucugucauucaggcuagagugcagugguacaaucacagcucguuacagccucaaccucccaggcucaagugauccucccaucuuagccucccaaguaguugggacuacagacuugcaccaccaugcccagcuaauuuuuaaauuuuuguagagacagagucucccuguguuuuccaggcuguucucaaacuaacuccugcacucaagcagucuucuugucucugucuccuaaagugcugggauuacaggcgugagacauugcgcccagcaagguuauuucugaaaaacaaagaaauacauuuuaaaauagcaaaggagaccaugaaugggaugucuucucugaaggccagggcuuccagugugcugauccuguugugagagauccuccaugcauccagagaggacagauuuuuuuggaaaaccuuucaguagcuguuuucaugcaacuuuauuacugucaguuaaaaugaaaagacuggauugguggagguggagucauucccagcaucucuuggugaaucagagcugugaagcuauucugcuuagaaguugacccaaggauuuggugggagaacuggauaaauuaguuuuaaucuaaaagccuugacacuaacaggaugugggggaaaacauaaacuucuaggacuuaggagaccugugcagccaucuugguugccucacuagcucuuccucuguuggaggauaggugaaauuauugccauaaccaccucagaaggccauuugaaaaucuuggccaggcgugguggcugacgccuuuaauccuacuagcacuuugagaggucuaggcaggcggaucauuugcagucaggaguuugagaccagucuggccaacaugaugaaaccccgucucuacuaaaaauacaaaaaauagcugggcaugguggcacaugccuguaaucccagcuacucgggaggcuaaggcgagagaacacuugaacccaggaggcagaggcugcagugaaccgaguucaugccacugcccuccagccugggcaaaagaguuagacuccaucuaaaaaaaaaaaaaaaaaaaaaaaauugaaaaucuucauuggaaaugcuucgaaaaucugaaauaacacuagaaauauauuguaguuguuaauaguaccaucaggucaguuauggccaagucuauauuuugcugugguauuauauuuaagaguuuaaucugaauuuaauuuuguagccacagaaaauaaucuguaguuuaauuuagugcauugggaauccuuuuuuuuuuuaauuggucuaggugaagccaauuaauccuaagucuucuuuucucaguacugguguguuucaguaggugcauguuacaaccucacuuggcuaucagaugaauugacccuggcagugagugagugacagaugccaccaccagauugccuucaauuccaguguuaaccagcucuucuccuuuuuuuccagucccacgccuuugacaucucauccuucagucccuuugcuguaaaggcaacuugaacaagcuucagcccuuucucagacuuccagggcaggacuugaauggauuugacacuggaauuguuccugaugcagccuuguucaguucuugcugcugccaugcuggauuccaaagauccacucuuuccucgacuggucucgcagggucaggcccacugguuaaagcuuguuguguauuugguggggagguucaaaaugaaggagggacuccaguccacuuugggcauuggaccugaaggcaaaaaauaagcguucagucuaaaagcacuaagugcccauuguuuaggcagcuguuaaucagccacguuucuaugaaaauaaguccuuuucaugaggcaguugugugggaauagcuaauucuggccugaugcugugcagugugagguuaaaaacauggcaacuugucacaacacaauucuucuuguucuuuuugcugugggcugacucuacauuacuugcuuuguuugcucuagaauggaaucuacucaccauuuacuaaaaugaaaugcauuucuuuggggaggcaaaguccaguucacuaggucuugcaucuuaaagagaaaggagcccugcuuccucuaugacuaauuguuaggaaugucauuuagcuuauuuaaauaccgauuuugguucugggguugaauauuacaugugggguguacugugugucuuaguuuaaacaaauuuauauguauuguccaugucuuacauauauuguccaugucuuacuccucguaguacagacuaauuuucaaaauaguuagcaguaagcggaggcaagcauuagagagaaagcuuggcauaguagaaagugcacaagcuuuguauucugacaaacauggguaacauccugaccucaggcaaguuauuuaacccccaggccuuauuuccucuuuugaaaaaugggaauaaugaaguucaccggacuguguuuuauagaggauacuguauggaaaguaccuggccucaguaguuauuaguaacuguccaccaaaaucauccuuugcauuuuuucuagaagccaguccugaacuccccgaccuccauagggguagugucuuaggaaggaggagacuaggggcaccuuucagcagcccuguacauuauuucacuuucgacuaacaagcuuuauacugcugacacagugucuccccagguaccuagaugucuucguuuuccucaaagauuuguauauucuuagccacuagccaacugaagaagaggcuagaucuucucugauggaguuugggccuaaugucuuacuuuggaauuugcuacuccauuucuucacagcaguuugacuaaucgaaauccaguuuuggggaaguccuuuguucaaaucccuuggcaugucugcucuuaaaggauaggcuccugagaguuuuuauaagcacuuugcuuaauuuagaguuacaggauggugaauaccauguagcaagauuucaguugguucuuuaaaucuugcaauugggggaucuuucuugaagauuuuucauagcagaaggccucuuuucagcauugugauaguugguauagacaguuacucaagcagauuuauauccaucacauuucacagcugucagcauuuauaggucauucccauuugccuucuccuucuagcagccuuuucauauuaguagggcuugccaggacagugauggagaagaauggagagggaggaucaccucaauaaaaggagggcgacuuuaccaguuuguaguuuaaaauacuuaaguaaaucacaaaucucccuaaugcagauauccguagacucaagcuguaaauugcuguaccaucaccaagguuuaagaacuaggacuuuugccucaacuucaggcaaccccgaacuagguucuuuuuugcaugugaacaacaggaaaagaaagauguuucucauaacaaaaaugaucagguacuuaguuaauguugcaguaaucauuucaguaaagaauuaucuuuaucacuugagcaguggaaugauuuugaguaucuugauagagguuacuaguucuuuuaaaacacuguuggucaugucugauuugauucuagguacuugcucgggaaucuaauucccaauuauauaacauuguuccuuuaggacaaaguuuaggaaaguauacuuugucuaauggcacaguuucaaaaaauagaucuuagagguagggaaaaaauacugcuaucacccaguugcugaauauauaagguacuggagggaguacaaagagggcagcaaguaccuacauuguugugaugggaagagggaacaccaguggaugggugcuccuuauaguauggcacuggcauccuguaccucauaugucccugucauccacggucuuagucucugcugucacucagcucuguuccugucuuaaacaccaacaugcuaugcuuuuaacucuuuugccaccugccuuugcucugcuuguucuuccagugacaaaugcaugagccacuuuucaggaggugaaauuauuaaaacucuugaggaugugaccuauuucacauugagaaauaaguugcccugaauggaguaaccauuuuuccuguaaguuugcaaaagaggcagcaguugugacacuguggaaggagauagaaaaauuccuugccaugagggaaugucuaaauuuguccugcggggaggaugacuacaggcagaaauagugaggugaggcaggaacauaagagggguuuucuugauuuaguuugaauguaucuaagugacaaaaaggagcaucugaagaacuuggauucuuucauuagcaccuccuuuugguccauuggccuauucaacaaaucuauaaauccuucaaguaucacacuaacuuucagcucagugugcugcgggcucuagaccaaagauuccuccuguaagauuacagagguuauucccuuuguaaaguaacaugauucucuuucucuuucauuuucagggaagcagagacuuucaaggaacaaggaaaugcauacuaugccaagaaagauuacaaugaagcuuauaauuauuauacaaaagccauaggugagaaagaacugauacuuacgcuagaaaacauuuacuugccaaauauuauuaaaaguagcugccaaguccugguggcucacgccuguaaucccagcacuuugggaggccaaagcaggaggaucacuuuagaucagggguuucagaccacucuggccaacaugacgaaaccccgucucuacugaaaauacaaaaauuagcugggccugguggcgggcaccuguaaucccagcuacuugggaggcugaggcaggagaauugccugaacucgggagguagagguugcaaugagccaagauugugccacugcacuccaaccugggcaacaaagcaagacuucaucucaaaaagauaaaaaaaauaggccaggcucaguggcucaugccuguaaucccagcacuuugggaggccaaagcaggcggaucacuuuagaucagggguuucagaccacucuggccaacaugacgaaacccugucucuacuaaaaauacaaaaauuagcugggccugguggcgggcaccuguaaucccagcuacuugggaggcugaggcaggagaauugccugaacucgggagguagaaguugcagugagccaagauugugccacugcacuccaaccugggcaacaaagcaagacuucaucucaaaaagauaaaaaaaauaggccaggcucaguggcucacgccuauaaucccagcacuuuggaaggccaaggcaggcagaucaccuaaagucaggaguuugagaccggccuggcuaacauggugaaacccugucucuacaaaauacaaaaauuugcugggugugguggugcgugccuguaaucccagcuacuagggaggcugaggcaggagaaucgcuugaacccaggagguggagguugcagugagcugagauccugccguugcacuccagccugggggacgaccaaagaacuccaucucaaaaauuaaauuaaaaaaaauugagaaaaguagcuucucucugagaaguagccuuuugcccaauggguugauaacuguuacuguaugaacuccuucaggcuuaaugaucucaugaaggccaggcguggugacucaugccuguaaucccagcauuuugggaggccgaggcgggcggaucaccugaggucaggaguucuucuccccuaauuugcuuaccccaacucaacaugcacauuucauuucagccuggccuguuaacauggugaaacccugucucuaaagauacaaaaauuagccagguguggugggcgcuuguaaucccagcuacucgggaggcugaggcaggagaauugcuugaaccugggaggcagagguuguagugagccaagaucacgucgcugcacuccagccugggcaacaagcgcgaaucuccgucucaaaaaaaaaaacaaacucaugaaugauaacuuuuuucuuuuucuuuucuuuuuuuuuaacucuuuaaauuuuuuaaaauagagacagggucuuaccauguugccccggcuggucucaaacuccugggcucaagcgauccuccuaccuuggccucccaaagugcuagaauuacagggaugugccaccauccccagcugugauaacuucuucuaacugggguggguaguuuuucuuuugauaaauuaaaggcaauuccagaaauacugaauguuauggcaaaacccaccuaaauacauuucagucauugucaauucauuuacuaccuuagaaaauggccuuuguacauaaaagaagucuuaguuaucuccaugcuuaauuugccagcauacuuuaaucccgugucagcauucuucucaccuaauuugcuuaccccagcucaacaugcacauuucauuuuaaugucucauuauacaaaacaguucauuaagauuaauaagcugccucucuccucaaaagauaaucacuacacuucaaagccguaccuuguuuuguuuuaaaacugauuguauccuugcugcuguccauuugcacaagcagucagaaauuuggaugcagccuauuuauuuauuguugagacagugucacugucacccaggcuggaguguaguggcacaaucuuggcuuauugcaaccuucaccuccuaguuucaagcgauuuucaugccuuagccaccugaguagcugggauugcaggugugugccaccaugcuuggcuaauuuauuuguauuuuagcagagacagcguuuugccauguuggccaggcuggucucaaaacuccuggccccaagugaucugcccaccucggccucccaaagugcugagauuauaggugugagccacugugcuggcuguggcauucuaaagagagugugucagggcugggugcaauagcucacuccuguaaucccaacgcuuuuggaggcugaggcagauggaucacuugaggccaggaguucaagaccagccuggccaacgcggcaaaaccccaucucaacaaaaaauacaaaaauuagcuggaugugguggcgugugccuguggucccagccacuuaggaggcugagguaggaagaugguuugagcccaggaggcggaggaugcagugagcagagaucauaccacugcaguccagcgugggcaacagagccagacugugccucaaauaaauaaauaaaaauacagaaauuagccaggcgugguggcacaugccuguaauccuagcugcuuggcugcuugggaggcuaaggcacaagaaucacuugaacccaggaggcagagguuacagugagccgagauagcaccacagcacuguagccugugcaacagagugagacccugucuccaugaagaaaaaagaguuuaugagcguuacagauagauucccuuaacauuguuuggagggagaugcccucuaaguuuuuguuuauuuguuuguuuguuuuuugagacagggucuuccucugucgcccaggcuggagugcagugaugugcucuugggucacugcaaccuccacuucccagauucaagcaauucuuaugcuucagccuccugaguagcuggaauuacaggggcccaccaccacgcccagcuauuuuuuuuuuuuuuuuguauuuuaguagagaugggguugugccauguugacuaggcuggucuugaacuccugaccucaaguggucuccccucuuggccucccaaaguacugggauuaugggcaugagccacugcgcccagcccccucuaaguuuucaaagcagggaccuguucuaaacuuuguuuuacguucuucugccuuuccuauagauauguguccuaaaaaugcuagcuauuaugguaaucgagcagccaccuugaugaugcuuggaagguuccgggaagcucuuggagaugcacaacagucagugagguuggaugacaguuuuguccggguauguauguaauggggcuguuuggggaaggcuggguugcuacaguugaguuucucuagccccguauuucucaaccuugacacuacugacauuugggaccagauuauucuuuguugugggggacuuuacugugcacuguggguuguuuagcagcaucucugacuuuuaaucacugaguaugaguagcacccccucugcccaguuguaacaaccaaaaaugucucuuaacauugcuaaauguccccuggagggcacauugcccagguugagaacuacugcuguagucauuuucauuuuguguuaguuuuguucguuuguuuguuuuuguuuuugagauggagucuagcucugucgcccaggcuggagugcaguggcgcgaucucggcuucaggcaauucuccugccucagccuccagaguagcugggaccacaggcauaugccaccacacccggcuaauuuuuguauuuuuaguaagagacggaguuuugucauguuggccaggcuagucucaaacuccugaccccaagugagugaucugcccgccucagcuucccaaagugcugggauuacaggugugagucaccgcgccuggccucuguguugguuuugugugggugucuguugcugcuguugauuucuuuccacuuggccaaucaugcuucuuuucuucccucuugguguucuuuuagggacaucuacgagagggcaagugccaccucucucuggggaaugccauggcagcaugucgcagcuuccagagagcccuagaacuggaucauaaaaaugcucaggcacaacaagagguacgggucugauccuguuucugucaaaagaggcaguaugguauauuugggaggaguggcuacuugaaagucggaacugaggucuagucucacuucugccaucagcacaccugggugacuuuaggcgaguuucauagccucucuaagccucagcuuccuaaucuguaaaaugaguuuugaauaugauugacagcuuuuaaaaaucugugaaaauugaaguguuucugagauagcuggggaauaggcaaaugcuuccagggacugauuugagugagguuaaagaauuuaagaguuugggacuuagugagacccugucuccacaaaaaaauuuuuuacauuagccaggccuggugccaugcaccuaccugugcucccagccacucaggaggcucaggugggaggauugcuugugcucaggagguugaggcugagccgugaucgcaccacugcacuauagcccgggcaacagagcaagaaccugucucaaaaaaauaaaaaagaauuugaguaaauucaagccuugauuaaauugguagcagcuaaaacauguuuuaguuccaucuccauauauaguaugugucgcuuaaugacaggcauacauuuuguuaggugauuuugucauugugcagaaucauaaaguauacuuacacaaaccuggguggcauagccugcuacacaccuaggcuauauggcaguggcuucuggacuaaaaccuguauagcguguuacuguccugaauauuguaggcagcuauaacacagugguauuuguguaucuaaacagaaaagguacaguaaaaauacgguauuacaauuuuacaggagcacugccauauauacaguucauuguugaccagaguguaugacuguauauacaguuuacccuagaugcauuucagugagaaucucaaaacauaugcucaaucccuggcaaugcauugccuuuauuucauguauaucaagcauaacacuuguguuccugacuugaaguucaaacugagggugaagauugggucuagcccuucuguuaagaagucuugacuguaucuucaucaauuugauuugugaaaugucugugguucugauuuucuugaaagaaaaucuccuagggacuucuaugagaggucgaguaccaccucucucuagggaaugccauggcagccugucgcaguugccagagagcccuagaacuggaucauaaaaauggccauucacaacaggagguaugcauucgacccuaucucuaucaaaagaggcagugugguauauuuacugaauucaaauucaucaaggccuuguuaauuuuuuugugguuguuuaaucuacagcuucauuaaaacuuuccuaugucugauuuuccggugcaguucaagaaugcuaaugcagucauggaauaugagaaaauagcagaaacagauuuugagaagcgagauuuucggaagguacaguacaaccaugagauaaucucaucugcucuuugucgcaaaauucccauucgugugugugugugauaauuaagaggaguaguauggcacaaaagcucuagaauaguaaauuaucacuuaaauuaggcuucugacuuuuccucuuaaaaauguuuugugcuaagguacuuauuuucuuaauuauauuuggcccuaugauaaaagguaaaaugagugugccacuugaguuuguuucuauuguugauguaaagcacuggucuaauaguguacuucuuaauaaagggaaagcccgcuggaauuaaauauuagguuuggauaaucuuuuuuuuuuuuuuuuuuuuuuuuuugaggccuagucucacucugucacccaggcuggagcacaguggcuaacugcaaccuccgccucccggguucaaacgauuauccugccucagccacccugggauuacaggcgcaugccaucacaccuggcuaaguuuuguaguuuuguuuuuuguuuuuguuuuuuguuguuguuguuuguuuuuugagauggaguuucacucugucacccaggcuggaguacaguggcauaaucucggcucacugcaaccucugccucccggguucaagcgauucuccugccucaaccuccugaguagcugggauuauaggcaugcgccaccacgcccagcuaauuuuuguauuuuuaguagagaugggguuucaccauguuggucaggcuggucucaaacuccugaccuccugaucugcccgccucagccucccaaagugcugggauuacaggcgugagccaccgcgccaggccuuuuuuuuuuuugagagagaguuuggcucuuguugcccaggcuggagugcaguggcgugaucucggcucacugcaaccuccgccucccagguucaaacaauuguccugccucagccucccgaguagcugggauuacaggcaugugcugccacgcauggcuaauuuuguuuuuuuuuuuuuuaguagagacgggguuucugcauguuggucaggcuggucucguacucccgaccucaggugaucugcccgccuuggccucccaaagugcugggauuacaggcgugagccaccuccccggccaaaaguucuagauaucuuucuagaccucgcaguuauuaugcuuuaucuguguaacuccuuucuucuuuagauggugcuuggaaauaguuuucacuugaguuucaaaaggggagguagauaacccccaaaaagguuaaaaaccacugaucaggagagauuuucuggaucacuuaaguuugugacuacuauccaaggaacagaguugucacuucauaugugggaauuugcucaguacuuuuuguagcaugugcucaguaaauuuuuuuguuuuguuuuuguuuuguuuuguuuuguuuugaggcagagucuuggucuguugcccaggcuggagugcaguggcgggaucucggcucacugcaagcuccgccuccuggguucaugccauucuccugccucagccuccugaguagcugggacuacaggcggccaccaccacgcccagcuaauuuuuuguguuuuuaguagagacaggguuucaccguguuagccaggauggucuugaucuccugaccuugugauccucccgccuuggccucccaaagugcugggauuacaggcgugagccaccacgccuggccucaguaaauguuuugauaagaggauacauuaagaaucauucacauugacugauggucuuuuauuugguaauguauauaucugauuagcuuaugcagagucccggcaguaacuuauuagcaucccucuucuguccauugguuuuaauaaccacaguugucuuuguaauguaauucauaaguuuguuuuguuuggcauguguguguuuggaaagcaauucugccuacugucaguuuucugagguuuacauaggcaaaagcuuugucuugagagguggucuuuuggguuucuuuucucucuugccuacuccagagccagaauccugaguuugugacagaauccucuguuugugacaucccagcccccccacuguagcucacggugaugucacaaaugaagaauuaugauccuggcaggggaaacagaugaacuuggaagaaacaaaagaucuucuuugccugcagcugucccuagucauggggagguuggggggugggaagugaagcacugacgauccccaugauuagcagaaccagcucugcauaaaacgggguccuugugaaggcaacaggguguggcugcugacauuuugacugacuuuuuccugcccccucauuccuuuuccaucugggggggcaggacaguuagcacaacucuaccuacauaaugcuuaaguuuucauauuguccuuagaacuuucaggacaugccgagugcgguggcucauggcuguaaucccagcacuuugggaggccgaggugggcggaucaccugaggucgggaguuagagaccagccugaccaacauggagaaacccugucuuuacuaaaaauacaaaaaauuagccaggccugguggcgcaugucuguaaucccagcuacucagagggcaaaggcaggagaauugcuugaacccgggaggcagagguugcagugagccaagaucaugccauugcacugcagccugggcaacaagaacgaaacuccaucucaaaaaaaacaaaaaacaaaaaaacagaaaacuuucaggacaguaaaccugugccacugaaggagaggcauuccugucacugcugugugacacugcagaaagucuucucagugaaacagcugguaaugugguaguguuuacugacuugcucauauuuuaaauuucaguuuuggaauaggugcuauucaugguucaaaaacuagaaaguguugccagaugcaguggcuuaugcuuguaaucccagcacuuugggaggccaaggcaggaggaucacuugaggcgaggaguucgagaccaaccugggcaacuuauugagacccugucucuacagauaauuuaaaauuuuagcugaguguggugacgugugccugcagucccaacuacucaugaggcugaggcaggagaaucacuggagucugggaagucgaggcugcagugagccaugauugugccacugauacuccagccugaacagcagagcaagaccccaucucaaaaacaaaacaaacaaaaguuagaaaguaugaaaaauauucagugaugaguguccccucaaacuuguccucucuccgcccaguucucacuccccuaagcuaaccacuguucuuaugucuucuauuuucuuccuuaguuuuguuguacuuauauaaaauaaagauccuugauuuucucccuuuauuuagcgugaaagguaguaugcuuuauggcaggucugcaccuuuaaaaaaaaaucacugaguagcucuuggaagucuuuccauauuaguacaugaagagcuucuucauucuauuuuagaacuauauaguauuccauuauaugaauguccauguuaacuaaccagucuccuguggauggaauuugaauuuuucugcuuguaaguuuucagaguuuaucucuuccugacccccauggccaaauucuuagagggaauaggugucccuuaacuccagauuuguccuucgguucauuuauucucggcgugaaugugauucagcaaggcucucccaggaauaaauagcagcuaaaccaaaacugaaagcucagaggacaaacuaguaaaaagagaaaaacagaauauauggagaugcuuuaugaggcugaaagaguaaauuaauccccaccuuuuugugugugugauugcuccuuggcuugugguuuguauaguggcauguugggaauaguaaucugauguagccuauuuagagccauuuaaaauaacuauuuuaaggcugggugugguggcucacgccuguaauccuagcacuucgggaggcugaggaggacggaucacgaggaucaagaccaucauggcuaacauggugaaacccuguguuuacuaaaaauacaaaaaaaaauuagcuugggcgugguggcgggcgccuguagucccagcuacucgggaggcugaggcaggagaauggcgugaacccaggaggcagagguggcagugagccaagauccugccacugcacuccagccugggugacagagugagacuccaucucaaaaaaaaaaaaaaaagugauaauauugccuauuucauaaaauucuugugaggauuaaauggguucauauaugaaaguacccaguaaauguuuacuguccucauuaucaucuggagccuuugcuguccucauuucagugcuuuuauuuaaugaauuagguauguuuuuaaacuuugauauuacuuagaaguggacccaaagaccucauugaguuuugagucuguuaccugugacuaaacuaaagugaagauguuucuggagucccugaugaagagccuuauuuguuuucuucuucccuacagguuguuuucugcauggaccgugcccuagaauuugccccugccugccaucgcuucaaaauccucaaggcagaauguuuagcaaugcugggucguuauccagaagcacagucuguggcuagguaugcagucaggcuagcuggacauuaaaaugccagauaccauuggacugaugguguccggcagcuucaccacaggauaugguccccagaguaggccagcuagggcugaucagacccucuugggacuuaaagucaaagauuagaccagcuuugaaaacccguaggguauacaggaguauaguaguauagcagguacuugagcuauauaugaaagaacagauuguguuuuugugguuuuguuuguuuguuuaagguaguccuuuuccuucuacuccacugguuggcacacuuucugcaaagggccagauuuuagccuuugcaggccacagggucucuguugcaacuaacucaacucugccauugcagugcaaagguugcccuagauaauagaugaaccaauggguguggcuguuugaauaguguuuuauuuacaaaaaccaguggcagaaaggauuuggcccugugggcuguaguuugccaaacccuguucuaguuuaauaaggauuguaagacacaagauguguauuaaagauaauuauaggugguuuauuuggggaaaguuugggaacaguucuugggaaucugucuaccuuuggauauuuugaaugcuagacacauggucaaggaggaaaacuggccacaaaugguaguaaugguggggacauucuaaagcacagcucaaugugcccuuuucugacuauugcagugacauucuacgaauggauuccaccaaugcagaugcucuguauguacgaggucuuugccuuuauuacgaagauuguauugagaaggcaguucaguuuuucguacaggcucucaggauggcuccugaccacgagaaggccugcauugccugcagaguaaguucuagucaccagaccuaacugggaaagagcuuccuuuugggaccuuuaagauggcuagaguggaagguuuuagaaucacaaggaaugugauagcuuuuccuccugcuuugcaaggaugcuuggucuuuauuagaaaugguuucaggacuacuuguauuuaccuaaagguagaugugaucauauagggucggaugccuuuaauaucuaagaggguuuuuuuguuuuguuuuuccccucagugaagauagauaguaauacuuguccugagaagugaaggcagacccaguaacauaggucucauugguauuuuugguaacucuuuuccuguccacucuguaggaagcucaaaugagcaacagauagcccagauuggggguuggcggggcucugugaugcugaacugcuggaagcaaagaacuugaaaauagagucuggccucucugugcaauggucugaggcuuuguggauaugaaccgauccuccccuugcuuuuuucuguagaaugccaaagcacucaaagcaaagaaagaagaugggaauaaagcauuuaaggaaggaaauuacaaacuagcauaugaacuguacacagaagcccuggggauagaccccaacaauauaaaaacaaaugcuaaacucuacuguaaucgggguacgguuaauuccaagguaagcucuugaucuagaucuuggggccuauagaaauauuuuuaagggacaucaaagggucuugggaaaucugccuagugaggguaagcaagaugaaagagggaaaguuguuaugguuaauaguuuguuaggaacucccuuccaagaggcaagcuuuugucaucucuauggaauuugagggcaguuggacaauuugcaaggauauucucaccuguucauuaaggucccuuuccuccaguaagagaauggcuagggucugugggauaaucuuaagcaccuacuguugcuuuuuuguuguuuugcuuaugcaagugaucauuuauuuuuuaggagugauuuggaggaagaguaugaggcaagcuuguuuuucuccaguguaauugauggucaccaugcaugguugaaaauggccugagugcuuuuguggcccuacccaacaucagaaacaaaaaguagacuccuugcccuugcagaauucuagcaguuaaaaaucagagugauuucugaucccugcaggugaccucuggaaaaaaggagggcaggaaccagccuuacuauuuucauguuuucauugggcacuaacauggaaugguaaagguaguuuauccuugaagacagaugugccuggcuuguaucauauacaagagaaaucaauuuugaaguugcuguccauagcccuggugacaaagaacuagaacuuaauaugacauuuaaggggccagcaugacugauccucuuagaguuuugaagccaugcucacagcuucugggcucccucagucaccaaaggugugaaguaugauugcucucucucuccugaagcuuaggaaacuagaugaugcaauagaagacugcacaaaugcagugaagcuugaugacacuuacauaaaagccuacuugagaagagcucagugguaagugccucugauggguagggggaagagggaguugccgcuggccucaggggaauugccuuguggaugacgaagcagacccagagauguugugaggucauuugguccuucccccugccucuaggugggauuguuccagcccuagacuaucuuuauagaccuccagcggaggagauugcacaagcucccucagucucccaugccugugucuaacgccccucacggucaguaaguuuccucugaugccugacccaaauuccuuuuguuaaaaaguuuaaauccauuuccuuuggagauuuuauuuuguguuguacacuuaugcucuacccuggcacagugcuugacacauaggugcucacugaauaaauguuuuguugaaugaauguauggugcuuggaagagaaaacaacucuuggagacaguugagaguuguacuucauccuguuuguucugggcgagggaagacaaucuuagaguuggaagagauguaauccggcucagccucccaggauaaaggaacuuccuuuugaaacacccuggauggcuacucucugcuugaguguuuugaguggagggcacucugugucugacagggugauuaugagccaggaugugccuaccucuaaugcucacauuugccccagagucagggugcucccuggcaugguugcuccucuuacucuuagacccaccagcugguuuucuccagauaggaacagggcuaggagaaaucuuucucagaaauccaucucuucugauuucagauuauucucuaggcggagaaaaacuucccgucuuuaaaguucuuagagaagauguauuuauuguauacuaauccuccagcaccugcuccacuccuuauuauaaaaugucauauccaaagaacagaugcugucacugaugccugaugagccaguaguuuaagcuuccuugucucaucagugguacagaauaucucauggacuaccucccacuuaguuuucucaaaauuaucucacuuaaaauaggaaaacugcugcugugugugaugcuuuuuuuaaaagugaauuucuaaguugaugacuaagucuguccaacagaaacauacagggaauuauaacuucugugagacugacugucagucauuccaucuuugcaaaccacuggcacacagaagcagaagcuuuggaagacaaaaaaagcacccuuugauucagccaaagacugacuuuaacagacgcaaaaugcuauauacaugaagguguuugcugcaauuuuaucuauaauagcaaaaaaaaaaaaaaaaaaaggcggggggagaaucaccuacauguccagugggaaggggguggcuagauacuugauacuguaugaacuuaauggaaugcucuguauauggaaugccaggggaugggaagagaagagaaaaaucgcuuuguuuuauuuuuugggauggagucucgcuaugucgcucgggauggagucucgcuaugucgcucaggcuggagugcaguagcaccguacuggcucacugcaaccuccaccuccugaguucaagcgaauuuccugcuucagccuccgaaguagcugagauuaccggcgcaugucaccacacccagcaaauuuuuguauuuuuauuggagaugggguuucaucauguuggccaggcuguucucaaacuccugaugacaagugaucugccugucuuggccucccaaaguucuggaauuaccagcaggugugagccaccgcgcccggccuuuuuuuuuuuuuuuuuuuuuuuuuuuuuuuuaagcaagcccccaacaccauagaaaauucuugauuugcucggaggauaauuggaugaaggauuauuuucuucuuuguuuaugugcaagaaaugaaaauaaggaauugcuuugaucagacaacuucuuaucuuugugguagaaacagaacugcccuucuuggaguggcucugccucugagaucacuacaggggagacagcaugcccuguucagcuggcugaauauuuggcaacaaucuccugaagcagcuggaauugacaagaaguacuggagauuagcucgggccaaacccuuacaucuggccugacuacugcugcagucugccucaacuuaccccuaaagcuggggagaugccacccacccacaucuuugcuacacaugccaucaugagcuagaguucacccuuucuccuuaaagcccuauuuacuuuucuacuucaacuuuaaaacaaaauuaaaaugugaggauaucccugaauuuuaaaaagcaugaaguaaaaaugcaaauuaguauaguuuguuuaauacauuacauauagaccuaaagaaaguucaucaggguuaaucauuugucacaucauucuauacccagggcuaucagcuaucaauuuuccuuuuuuuuuuuuuuuuaauucaggauccagcucugucacccaggcuggagugcaguaucaaaguaucauuucucuuacuucaaauuauuacauuuuauucuguacauugauucugaacuccuaauauaauauuuauguccuguauuugcaggccauugguuuuuuuaaagucauaaaucaaaaugaugccagaaaaucaaagaugcccaagauguugggcuucucuuuugccagccacauugguagcacucuccugcccuggccuccaagcugguggggaucugugauguuugugaaaaugggcuuaugccaggcgcaguggcucacgccuauaaucccagcacuuugggaggccgaggcgggcagaucgguucaggucaggagaucgagaccagccuggccaacauggugaaaccccaucucuacuaaaaauacaaaaaauuagccaggugugguggcacaugccuguaaucccagcuacucaggaggcugaggcaggagaaucacuugaaaccugggaggcggagguugcagugagcagagaucgugccauuacacuccagccugggcuacagagugagacucugugucaaaaaaaaaaaagaaagaaaaugggcuugugugguagcagguaagaaauugaaucucuguuguacagcagcuagcuguacugcaugaucacuucccauuccccagcugacaguggcugucucuggaacuccuaccacagucuucaauugguaggccagcccuggugccagugauuuuaucugggcauggaaaaugccacuugcuucuguggaagagacacuuaaaagaucuggcagucggccgggugcgguggcucacgccuauaaucccaacacucugggaggucaaggcaggcggaucacgaggucaggagauggagaccauccuggcuaacacggugaaacccugucucuacuaaaaaaaaaaauaaaaaauuagcugggcgagguggcgggcgccuguagucccagcuacucuggaggcugaggcaggagaauggcgugaacccaggaggcggagcuugcagugauccgagaucacaccacugcacugcagucugggcaacagagcgagacuccaucucaaaaaaaaaaaaaaaaaaaaaagaucucgcaaucauccugucaagcuugauuccuccgaucuugggccaagggccccuccuuucuuuugugcuacugaaauagaagcaaaccuguguuuagaguucccuuuucugucucauuuaccugcaucucucauugauuggucuuaguggagggauuugccagcagcugccacguugaacuugauccuuuuaguggcucacuaaucccaccucuauucuggauuguagcuaguccugcauguuuauggcacuauagguuucaaagcucuuucauacccauuuauucacuugauaauuuuucucuuguguguuucaacccaaaguaaucaaguagaucccuucacauugucuuuucuaaggcaguccaguaccucuuagguggcugugugucagaaggaacuuuuuccucuugauuacuuucugcucaaagcugaacaucacuuugcugguuggaugcaagugccaugcgaccucucuuuuuauuuccuugaggacuuguuagcuaauuuucucucacugcuagauuaagggcuccuguuucugaagcaucuuaccagaagugugugucucuugcuugagccaugccucuugcccuagagugauccugagaaccacugcuauuuaugucuuagugcuguauugccuuguauuuccuucucaguuacauggacacagaacaguaugaagaagcaguacgagacuaugaaaaaguauaccagacagagaaaacaaaagguaaguuuaaaagcauuuguuuuuuagggaacuguguggacuucguaggccauaaaucuguacacaagguaguuugauucagggaucagggaucuaccuagaacuuauuugaucaccagccagaaagaagugaacaaaggcugggcgugguggcucacgccuguaauccccagcacuuugggaggcugaggcaggcagaucaccugagaucaggaguuggagaccagacuggccaacauggugaaaccccaucucuacugaaaauacaaaaaauuguggguauggugguauacgccuguaaucccagccacucaggaggcuggggcacgagaauuccuugaacccaggaggcggagguugcagugagcuaagauugcgcgacuauacuccagccugggugacggagcgagacuucaucucaaaaacaaaaacaaaaaaaagaaaaaaaaagugaacagauaucuuggguuggggcaugaggcaccuauuuucugguuccagauccucccugucguuuucauuucauuuuuuguguggugaggcuaaagugaggaaccuaagucuggguagauuuucuuuuuucuuuuucuuuuuuuuuuuuuuaagauggaguccugcucugucacccaggcuggagugcaauggcaugaucauagcucacuacaaccuuugccucccagguucaaacaauuauccugccucagccucccgaauaacugggauuacaggcacaugguaccacgccuggcuaauuuuuuguauuuuuaguagggaugggguuucaccauguuggacaggcuagucccgaacuccugaccucgggugauccauucugucaagcuugauuccucccaucuugggccaagggccccuccuuucuuucgugcuaccgaaauagaagcaaaccuguguuuagaguucccuuuucugucucauuuaccugcaucucucauugaugcaggccucccaaagugcugcgauuacaggcaugagucaccgugccuggccgaguagauuuuuuuucuaaucuccagaagaaagcaccguaaaagucccuggcaugguuaacaaggccucuaacucccaggcagcugggcugagaccuggugaggaaaaaaccagagucagauuuguccacugaugccagaugucuuccuguagaacacaaacagcuccuaaaaaaugcgcagcuggaacugaagaagaguaagaggaaagauuacuacaagauucuaggaguggacaagaaugccucugaggacgagaucaagaaagcuuaucggaaacgggccuugaugcaccauccagguagaguaggugcggggagugggcucagugggaagaacccgcagggcaggccaacugccacacucaguccagaggggaccccuuggagagguccuucagcugagaauaagguguugcagacuuguggacccuccaaauuuugggaagugccaaauuccaaaauuagacagaaaguaguuuuucucuuaaacuuuguuuucuugaaacuuugauuuccacugaguuguucuuuuacuccccacuuuagaucggcauaguggagccagugcugagguucagaaggaggaggagaagaaguucaaggaaguuggagaggccuuuacuauccucucugaucccaagaaaaagacucgcuaugacaguggacaggaccuagaugaggagggcaugaauauggguggugaguuggcuggggcagccugggaugaauuugacagcuguagaauguuagaauuuuuuccaaagaugcuccagagggagagucuauuugggccaaaucugaucccugguccaaacaguaauagacauggagucaaacaaaugcagucaaauguggcagguucacagugugcagugagcucugaggaggcgagcacuagcaagggaaggcuuggaagugcagaaaagcauggccccaugggucaugccuguaaucccagcacuuugggaggccaaggcaagcagaucacuugaggucaggaguuugagaccagccuggccaacauggugaaacccugucucuacuaaaaauacaaaaauuaggcugggcgcgguggcucaugccuguaaucucaccacuuugugaggucaaagcagguugaucaccaggucaggaguuugagaccagccuggccaacauggugaaaccucgucucuacuaaaauacagaaauuagccaggugugguggugggcgccuguaaucccagcuacucgggaggccgaggcaugagaaucgcuugcacccaggaggcggagguugcagugagccgagauugucccacuguacuccauccugggcgacagagcaagacuuugucucaauuaaaaaaaauaauaagaagaaagaaaaaagaaaaauuagccaggugugguggugcacaccuguaaucccagcuacuugaacccgggagguggagguugcagugagccaagauggcgcuacugcacuccagccugggcaacagagugagacuccaucccuccccacuaaaaaagcaaagcauggccucuuuggggaucugcagggggcuuggucuagggaagauaaagggauagggugcuagaggcagguggugguggaaggccggcaaguagcuggaucagagcucacaggccauaagggcuguaugugguaaggaauaugagcauuuuccuauuaucuggaaguucuuuuuuacccacugcaaaguguaugcugacauuuauguaugucauacauuccuauaaacacucacagauuuuaauuucccaaaaagauuuagcaugauauaaagcacaccuauugucaauauuguugcucacugugggcugucagagauaagaggcccugaccugugagcugggcgcgguggcuuacgccuguaaucccagcacuuugggaagccaaggcgggcagaucaccugagcucaggaguucaagaccacccugggcaacauacaaaauaccaaaaaaauuguacucucuacuaaaauacaaaaaaauuagcugagcaugguggugcaugccugugguccaagcuacucaggagacugaggcaccaaaaacucuugagcccaggaggcagagguugcagugagcugagauugcgccacuguacuccagcuuggguuacagagugcgacuccaucucaaaaauuaauuaauuaauucagucagucuucacucuaaguugucugccaaaaaauuugcugggcaugguggcucacgccuguaaucccaucacuuugggagaacaaggugggcggaccacaaggucaagagauugagaccauccugcccaacauggugaaaccccgucucuaugaaaaauacaaaaauuagcuagccaugguggcgcacgccuguagucccagcuacuugggaggcugaggcaggagaaucgcuugaacucgggaggcggagguugcaaugagcugagaucgcaccacugcacuccagccuggcgacagagcaagacuugucucaaaaaaaaaaaaaaaaagaggaccugaccugugaauggugaacagaccuaccaucucuuccacuaagaaaaucuauugggauuuuguuuuuuguuuuguuuuguuuuuugagacggagucuugcugugucacccaggcuggagugcaguggcaccaucucgacucacugcaaccuccgccuccaggguucaagugauucuucugccucagccucccgaguagcugggacuacaggugugcgccaccacgcccagcuaauuuuuguauuuuaaguagagacgggguuuuaccauauuggccaggcugaucuggaacuccugacuucgugauccacccaccucggccucccaaagggcuggaauuacaggcgugagccaccgcgcccggccuuuuuuuuuuuuuuuuuuuuuuuaagacugagcccagucugggugcaguagugccaucuuggcucacugcaaccucugccuccaggguucaagcaauucuccugccucagccuccugagcagcugggauuacaggcauccacccccaugccuagcuaauuuuuauauuuuuaguagagacaggguuucaccauguuggccgggcuggucuugaacuccugaccgcaagugaucuacuggccuuggccucccaaagugcugggauuacaggcgugagccacugugccuggccuuccauugcaacuuauuuauuuauuuaauuuuuuuuuguuguuauguuuuugagacauggucuuacucugucacccaggcuggugugcaguggugcagucucagcucacggcaaccuccaccucccagguucaagaaauucuccugccucagccuccugaguagcugggauuacaggcaccugcagccacacccggcuaauuuuuauauuuuuaguagagacgggguuucaccauguuggccaggcuggucucaaacuccugacuuugugugauccgcccaucuuggccucccaaaguguugggaugacaggcgugagccaccgcacccagccggaauuuaaaauaagaaugaugguacuauauagauaaugcugaguccucuccaguucaguguggggguauuuguguuuaauaaaccuagguucaccacaauaaacauguuccucugccuagcaguuaagaagaucuauaagcagucaaaaacuagugaagagguuuuguuuuguuuugagacggagucucacucugucgcccaggcuggagugcaguggcgcgaucucugcucacugcaagcuccgccucccggguucacgccauucuccugccuuagccucccaaguagcugggacuacaggcaccugccaccacgcccggcuaauuuuauuuuauuuuauuuuuauuuuuauuuuuuuuaguagagacgggguuucacuuuguuagccaggaugaucucgaucuccugaccucgugauccacccaccuuggccucccaaagugcugggauuacaggccugagccaccacggccagccgugaaguuuuaaguaggggcacuguggaccagauuuuggcucuggaaauauauuugugauaggggugaggagguugggguuggagggaguaaggagaauggagauggaaggaagacacaaaagguaggaaaggauuggagggcacagucagggaguuaguuagugguagacucagcaggaguugguugcuauucagauguguuggggaaagugacaggcauagcugacucggggucauucacuaagccaggagcccaggaagacacacagaugcaagcagagaaacucacucugggcacgagguggcugugggaucaccuggugggggucaguccuucugugaagcuugggcagucagucagggauggggccaccagacaugcuguggccuugcaaaagugcacagagccagucaggcaggaguuggauuuuccaguucugcugcuuucgcugccaugugaucgugggcaaguuacuugaaccaccuacauauguuuuguugaguauuaauugggaaugauacuuacccugacaaaacauuacuaggauuaaguaauguaauguaugcaaaguaccuaguacuuugcaccuaguagguguuuuuguugguuuguuguuguuauuaagacagggucuugcugucacccaggcuggggugcaguguugugaucauagcuuacugcagccuugaacuccugggcucaagugauccucccaccuuagacucccaaagcacugggauuauaggugugagccaccacgcccagcuaauaaaccauagcuuuuuuucuagccuagagucuacggaguaaaagacauggaaucaaauacaguaaauccuagaucuugcucuuauauuuauuuuugguaacauuuaagugauacauuuuauccuuuuuaguagccgcuccagcauuauagggagacagaguauggggaaagucuuguguaagugcaaauggcauuccauuuguugagaaaacagcccaaugaagcaagcugaagcagagaaagcuuccuuuggggcagcaguuggaaggagaagggaacauguccuaggagugggaucagguagcauguuuugcacgggauggggcagguuugcucacuugcagucugaaguguugggaaaggaggggagugagacucuccaggaaagcuuuggagaucuguucucagugucaucaguucucuucgaacauuucuaauuuuucaccuuuucuucccuuccauguuacuugcccugcucuacagauuuugauccaaacaauaucuucaaggcauucuuuggcgguccuggcggcuucagcuuugaagguaggugggccugcuguucuugggaguucccagaucacaagccaacacacucauugccucuuaggcagcucuuugggagucagaggggcccaugagcgggggcagcugaauucucaucuagcagggcaucuauccacucggcuguugcuaaggaugaagacaggaagguucccaggcaccccuugccuugggaccuuuagccaccgcaucucugcagggucagggaggcaucucuaacugccuaguaccaaggcuucucugcaagagcaaagguacuauauagauaaugcugaggucagaagcuacccauguauaauacagucacgugcucccucuugcacccaaaaacagccugagcuguuugauacccauagaguuucucucuguguuugaguuugaagcagcccuugaagacuuuuccauaaucagagcaaagugaucuuccuuagaaaauccauagccaacuaccaaccccucuuuucucuuucagcaucugguccagggaauuucuuuuuucaauuuggcuaaugaagggcaaccacccagaacccagaaaaugcagauucacucaguuuaaucuugaauguggaaacaguucaccuccucccuucaucacgucuccgugugcuuagagcaguuucguuuucucaguuggaugcccugugucucugugagugggguggagcaaagggaaccaaugccgaagaccgagggcaggggagggaggcggggguggacagggaggcagcuugugaauuuuuguuuuacuguuuaacuuuauuaaaaaagaaaaaaaaaagagaauaaaauguuuugacccuuccuggcccuuugcucugg

SEQ ID NO: 192305 - RNA, 5446 nt, Homo sapiens
ccugguggccggauuucccaguuggggcccagccuuuuaaagccaucgcuccuucuuucuggccggaugugugcugagacccagagucacccaggggucuccgucacgugccaggaguaggcagaagugggcugugacaggugcaugugggcauggaccccacagccuggggcucaggagggacaaggagcugggacaggguggaucccgagagaaagcaaagccacucgggagugggcaagagauaucguuacgcagcugcugugugcccgaccgacccuguccgaaacccuuccuguaccuucccuuccucuuccuucuuuucucccuuuuuuuucuuuucuuuuuuuuuuugacagggucucacucuguugcccaagcuggggugcaguggcacgaucuuggcucacuguagccuugacauccugggcucaagggauccucccaucucagccucccaaguagcugcgacuaugggugugacaccacgcugggcuaguuuuucaauuuuuuguagagauggagucucccuauguugcucaggccgguugcaaacuccugggcucaagugauucuccugccucagccucccaaagugcugggauuacagaugauagccaccucacccggcccaccccuaccuucugaaagaggcauucuuauucuuauucccauuuugcagaucaggaaacagagcucagugcagcccacuaaauugcucagggcccuacagcuaacaagcggcagaggcaggaucugcacucaggucagugggacuccaaagcuuugauagucucuccuuugcaucaccugccccacaggguccugccuucuucccaauuucauuuuuccucgguuuuccuguaugcaguagagcgugggaggagaaauggauaauugcugcaugcccccauaucucgguuccuuccucuucccaggagcugcuuggagaugcugcuguggccacugcugcugcugcugcugcugcugccaacauuggcccugcucaggcagcagcggucccaggaugccaggcuguccuggcuugcuggccuccagcaccgaguggcauggggggcccuggucugggcagccaccuggcagcggcggaggcuggagcagagcacgcuccaugugcaccagagccagcagcaggcccugagguggugucuacagggagcccagcgcccccacuguucccucagaaggagcacagguguguuucccagggucuggggaggugacccaaagagaaagaaaccccacaggaccgucagauuccagagccugauggcccccuuaccuccuccacugccaacggaguggccugacccagagacccaggacuggcuuucuuguccaagaugaauuucccaugcuggguccuuacauccucucuaccccaggccuauucucgguuccucccucaagggucucaccagucuugccugaaacucuugggaaacuggcuuccugaggcguuucuguugucauuggggcuauagacauaagcaccuuccggaaucaucucccucugaccaaggccagccagacccagcaggaagacaguggagagcagccacugcccccgaccucaaaccaggaccuuggggaggccucucugcagguaaucuaggauggccagagcccaguccuggccacagcccagucccaccagagaccucugacuugcagccaaacccuccagucauggugggcaaagaacccccaaaugggggcucugggucuggcucugacaccagaccaacauucucucuuuccuccuccaggccaccuugcugggucuggcagcccuaaacaaggccuacccagaagugcuggcucagggacgcacugcccgugugacgcuuacauccccuuggccccgaccccugccuuggccugggaauacccugggccaggugggcaccccuggaaccaaggacccuagggcccugcugcuggacgcacugagguccccagggcugagggcacuggaggcugggacggcugucgaacuucuggauguuuucuugggccuggagacugauggugaagagcuagcuggggcgauagcugccgggaacccuggagcgccucuccgugaacgggcagcugagcuccgggaggcccuagagcaggggccacggggacuggcccuucggcucuggccaaagcugcaggugguggugacucuggaugcaggaggccaggccgaggcuguggcugcccucggggccuuguggugccaaggacuagccuucuucucuccugcuuaugcugccucgggaggucagugggacucaagggcagugaggugggggcaacggucaguggucacaugacaagcagccaugcauugggcccuacauaaucaucucauuuaauccuccccaacaagcugcaugcuagggccagcagccuccuuuuacaagugaagaaauucaggcucucuagguuaagagucuuguagcugggugcaguggcucacgccuguaaucccagcacuuugggaggccaagguggauggaucguugaggucaggaguuccagaccagccuggccaacauggcgaaaccccaucucuacuaaaaauacaaaaacuagcggaguaugguggugcacgccuauaaucccagcuaccugggaggcugaggcgggaggauugcuuaaaccuuggaggcagaaauuauagugagcugagaucgcgccauugcacuccagccugggugacagagcaagacccugucucaaaaaaaaaaaaaaaaaaaaaaggccggggcaguggcucacggguguaaucccagcacuuugggagaggcugagguggguggaucaccugaaguuaggaguuuaagaccagccuggccaauguggugaaacccugucucuacuaaaaauacaaaaauuagccaggugugguggcaggcgccuguaaucucagcuacucaggaggcucaggcaggagaaucacuugaacccaggaaucacugaaucacugagccgagaucgcaccacugcacuccagccuaggugacagagcgagacucugucucaaaaaaaaaaagagucuugcacaaauucauguggcaccaggauucacucccaagucugcccccuccaggaccacagcacucugccucuuuccagugagggccuaagaggcagcccgcugaggcugggggagccaggaaggaugugguggaagggcagcaggaggaucaggugcucagaggaucaggccugggauccaggaggggcuauugccuggcagaaagcgauggcaccagcagacgcugaggaggcugcuuugcuuucacaggggugcugggccuaaaccuacagccagagcagccccaugggcucuaccuucugcccccuggggcccccuuuaucgagcugcucccagucaaggaaggcacccaggaggaagcugccuccacccuccuuuuggccgaggcccagcagggcaaggaguaugagcuggugcugacggaccgcgccagccucaccaggugaucagcugcacagccccugcuaccuggggcccuaugggaccgugcugggggccuggggcaugagcucagaagaccuugggcccgaccucacucccacuugcaccccaucaggugccgccugggugauguggugcgagugguuggugccuacaaucaguguccagucgucagguucaucugcagguaggugaccccggggagcugaagggccauccuuguguccugggcuccacugccucucccuuccuccucuucaggcuggaccagacccugagugugcgaggggaagauauuggugaagaccuguucucugaggcccugggccgggcaguggggcagugggcgggggccaagcugcuggaccauggcuguguggagagcagcauucugggugagccuccccaccggcuccugccuaccauccuugagcuacccuucaacuccuaccuccccugccaggggacugcuaggaaagagauaagccuccuuuacuacuccuacaaaaguccuucucugcaucuaacucucauccauccugcugcagucucuacccauuuucuuuccugaucugucuccuauuuaggaucaagcucuagguuccucuccauuuaccccacuccccaccaagaaacucuuuuuucccuaugaaucucagaguggggaagaacagauagggcagaggacacuagacuuggcagcugcccauucaccggaaguaugugugcacauggggucuauucacagauuccucugcgggcucugcuccccacuacgagguguuuguggcgcugagggggcugaggaaucugucagaggaaaaucgagacaagguaaaggagacgaggacagggucugacuguagaccccuucacucugcacacucccagggugccauggagaucagggcugaugggaaggagagggguggcggaggagaagcucccuggggcucugggaggggagggcuaagucccacagacacacaccuguccacacaaaacuucuaaacacauguagccugggcacagccacacacgccucgugugcacacucacagucacacaccagcucacucaggcuguucuguucccagcuggaccacugccuucaggaagccucuccccgcuacaagucccugcgguucuggggcagcgugggcccugccagaguccaccugguggggcagggagccuuccgagcacuccgggcagcccucgcugccugccccuccucccccuuccccccugcgaugccccggguccuucggcacaggcaccuggcccagugucugcaggagagggugguguccugagucaaguccugccccaccgcccagcuccccccagaggccaccucgccccucccucugggaccucuccggauggggaguccuuggccagggucucugacucugugucaccugacauuugcccaugagagccgcugggccuuagagaggccuuggcccagcugaccgguucugaaguaugggccuccgggguuagcagaugccagcagugccugcccguguccccaugucccggcaugaaggacacugcuagagaguuaccaugcacaccgaugguuuccuguaucacagcccaaagagguucucugguggccacagcugugugcucagucagugcacugggcaagcuagaaguguugggggguuaauguccccaggagcagcaacccugagucaauaaggagcaggaccucagcuucauuguccuugagcaggacaauucugaaguguauucuacauaaacucucagaggaugcccagcaggauggagucccaguugcccgcagcaguaacccacucauucauguacuuccugcgggggcucucccuucccucucuuccccacucccccgccuugggcuuccugggauggcucccaaauaaaccucuugcacccaga

SEQ ID NO: 192306 - RNA, 75171 nt, Homo sapiens
gguuuccggagcugcggcggcgcagacugggagggggagccggggguuccgacgucgcagccgagggaacaagccccaaccggauccuggacaggcaccccggcuuggcgcugucucucccccucggcucggagaggcccuucggccugagggagccucgccgcccguccccggcacacgcgcagccccggccucucggccucugccggagaaacaggugaagggggugcaggguggggccguuggggaggccuggggacccgggggcuccgcagcggcagggggccucugggaccuuggggauguugugauggacgcugcaguggggccgggagagaugaagagacgcggagggucgcccugagggaagacucuucgggaugacaggagcgggccucggaagggacucggggcgcuggagggaaguuucguucuucggagaaacagaacgcgcucgagggggcaccguggggcgagggcgcacucgguugcggcggcaggagugagggacagucccccgauuuccugcucccuggggcccuggggacguuccggccaccggagcgacugucacgccgacggggaucaccggcgcgaguggggggucggaaagcgccuccuccccgcccggucggcggcucccgcugagccacuuccuccgcuugcccuguucccgcuccuucaggagacagcugugcccuuuuggaggcaggaauaggugugucugucgccugcagccuuacgggcuggcuggucguggguaggcuuuauugcauaagaaucaaguuuccuguagggaaauugacagaccgguacucuuucuaaauucccucgcaucuuuuucuagguuaaauuaugcuccccccacguccccgccuuguaaaaaagagaaaaaaagacaaaauaaaauccccaucaacccgucaagccagcucuagagagagaaauaaaccucuugacauuguccuuuuccaaauaccugguaaagucggccagaagauaaauaauugagccauugcauuuacuggauugugguguugcuuaauugcauaggacggaaugaaccaauugagagugggaguuuucugucucagagccaagaucuuggguaaaugcagaggagagggaaacaaagacaggcuggccuugaaaaaaccaugugugcaaacuuuacaugcauuuggggggugugguugcacugaaguuaacaagauucaaaccgucgcccaaguugguauuuccauguuugguacacaucacucugugccauaucaggucguuguuaaguguggugacaaaaucagugguuagucauuuuuuuaauuaaaaauguguauaguguguaccugcuggucuuacuguaugugcaacuaaagguuuacauagucuguguauggguuguaaauuuuuggcuggcugugcugauaaagcauugggcuugaauaaagcaaagcagaaaaucaucucaaucuuuuauauguggauuuagacuguguuaugacuugguucagccaguuuucuaucuuauuuuauauuaaauaugucuguguucucugagucagcacauuuauuuccuuauuacauguuccagacaggagugcuagcccaguuuuuguucaguuugcacagugggauggggaaacaagucuggaauuuaaaaaaaaauguuuuagagguuggagccuugauuuuagucucuauauuagcacauccaucacaaagaaccauuaguaaauucaugaaucuuuuguuuuuuauguaguucauuugagaagaauaaucacuuagaaauauccacagugccaggcaugguggugcacaccucugaucccagcuaauugaaggcugaggugggaggauuccuugaguccaggaguugagucuggucugggcaacauggugagaggccaggaauugggucuagagucuagucuaagcaccauaaugagaacccaucuuuaagaaagaaagaaaggaaaggaggaagaaaggaaagaaaaagaaauacccacagcacaguuaugaauuaacccacaaaggacuugugagguggguaguucacauaacaauuacccuaauaucguagauaagaaaauugaggccaaaggaucaagacacuuggccaacgcagcagagugccauagugguggaauuugugccuccuucuguauauuuugugaaaaguaucagugaaauucuuuuuuuuuuuuuuuuugagucagagucuugcucuguugcccaggcuagagugcaguggcgcaaucuuggcucacugcaaccucugccuccuggguucaagcgauucuccugccucagccucccaaguagcugggacuacaggcgugcgccaccacgcccagcuaauuuuuguauuuuuaguagagaccgggguuuuaccauauuggccaggcuggucuugaacuccugaccuugugauuugcccaccucuaucucccaaagugcugggauuacaggugugagccaccgcgcccaguaaguaucagugaaauucuaacauauaucugaacaguaaaauaccaccaauaggcugaaagacuucaugggagguaaauauucaauaaacaggugaaaaaagaaauacaaauggagcuugcuuagauuauuuuucuaauugcuaugucuaacuugggaagugaggaacuguuuuuggucagcauaauuuaccaucagaauuuagcuauuuacuaaugaaaagaaauacuaaucuagguuuguuuuagauuaaggacagucaugaccuaaaugucauuuaaaccagagugcauuguggcuugaucaguggucauuucugucucuagaaaguugcuuuaacuucucugccucuacgugucucuugacauucagauaugaggugggguagagguggugaccaacuuuccagacgccugaguccaaaccuucuuagcuuaugguuuucuuaggugaugugcaaaucaacaaauauauacuuuuuuuuuuuuuuuuuugaguuggaguugcacucuaucacccaggcuggagugcaguggcaugaucguggcucacugcaaccuccuccucccggguucaagugauucucgcaccucagccuccugaguagcugggauuacaggugcccgccacuacgcccggcuaauuuuuguauuuuuaguagagauaagguuucacuauauugaccaggcuggucucaaacuccugaccucaagagaucugcccaccucagccucccaaagugcugggauuacaggcgugaaccaccuugccuggccaacauauauauaccuuuugcaacuuugucagaguugcuaugaagaauaaguuguaucuuguucacagaaauugcagucuacugggggagcugauaaauguuuuaaccauccaauguaacauguugucaucaaagagauggugagacuuuacacuugugcuaacaagguagcuguucuacauaaaagaacauacaguacagauguagaacuuuucuguuaucauagaacguucuauuggacagugcuaggcugaaugcuacagaucuucagagaaaggagagguuaugaggccuggaguugucuagaaagucuuuuugccaaagagggauuucaacugggucccaaauaauggguggaauuugauagguguaaagaauuugcggugguuuaugccuguaaucccagcacuuugggaggcugaggcaggaggauugcuugagcccaggaguuugagaccagcuugggcaacgugguaaaacucccucuccccuaaaaauaaaaaaaauuagccaggccugguggcguggaccuguagucccagcuacuggugagacuaaggugggaggaucacccaagccccggggguuaaggcugcagugagccgugaucccgccaccgcacuccagccugggugacagagugagacccugucuccaaaaaaaaaaaaaauuccugguagcccgguagacuaggaggguaaguaggggagaagugauuacuuacaaaagacauugaauacaggaccaaggaauuucaguucuguucuuuuguaggggaagcuuuuaaaacuuucggggcgccgggcgcgguggcucacgccuguaaucccagcacuuugggaggcccagacgcgcggaucacgaggccaggagaucgagaccauccuggcuaacacggugaaaccccaucucuacuaaaaauacaaaaaaaaguagccgggcguuguggcgggcgucuguagucccagcuacucgggaggcugaggcaggagaagagcgugaacucgggaggcggagcuugcagugagccgauaucgcaccacugcacuccagccugggcgacagagcgagacuccgucucaaaaaaaaaaaaaauaaauaaauaaauaaauaaauaaaacuuuggagccgaagcacugauguuuaaucauagagugcuuacuauguguuaggcacaggccugauugccugaugcugguuaauuuguacaaaguaaaucagugcauaugcccucugcccuaggggaguuauuaacuggagucugacauuguacaaagguagguauccugacuaguuugauuugguacuuugggugaaaaaaguauagugugcuuaagugcagaaguguuuuuugaggauuuuugauuggauacaaaccaccacucauauuuuaugucuuuggcacuuaaaaauuucaccauaacuuuugagucauuuauaaaaaccacugaaagaguacuugagggacauccccgaauccugaagaacuucugguguucuggagcagccucagugagauccaggaggauggcauugcugggcuggcccagcccuuauugauuaugguguaaagaauuaauauggugguuauauacucuuuguuagacaccuuggcuuacaagacguaagcguaaaguguagugcgcuuuagucaguauggccacaugguccuuuggugguaaauuguuugagaugccuccaguuuuuaaaaggaguagcauaucgggccaggagcaguggcucaugccuauaaucccagcacuuuggaaggccgaggcaagaggauugcuugagcccaggaguucaagaccagccugggcaacauagugagaccacuuuguuucuuuaaaaaaaaaaaaaaggcaaaaacaggcugggcaugguggcugaugccuguaaucccagcgcuuugugaggcagaggugagcggaucacuugaggucaggaguuugagaccagccuggccaacaugguaaaaccccgucucuacuaaaaauacaaaaauuagccaggugugguggcacacgccuguaguuccagcuacucuggaggcugagccaggagaauugcuugaaccugggagguggaggcugcagugagccaagauccugccacugcacuccagacugggggacagagugagacauucugacagugcuacacugaaugcuacaugucuucagaggaaggagagguuaugaggccugggaauaacauauggaagaaugaauuucuguuauggucaguucucauuugucauguuaggauuacugcaacucuuacccagccgggugugguggcucaugccuguaauuccagcacuuugggaggcugugggcggaucacgaggucaggagaucgagaccauccuggcuaacacggugaaacuccgccucuacuaaaaauacaaaaaauuagcccagcgugguggcagacgccuguagucccagcuacucaggaggcugaggcaggagaauggcaugaguccuggaggcggagcuugcagugagcugagaucgugccacugcacuccagccugggcaacagagugggacuccaucucaaaaaaaaaagaaaaaaaaaaggauuaccgcaacucuuuaauucagaucagcaaacauguugagagccagguauugcgucaggcaggauccaaggauaaugaaauauuguccguuuucaugaaacuggagauguugcagggaccgaggugugugcuaugccaguauggaaguaggacaggggagacgacagggcagugagugguucaagacucuggcucugaagucaaacagaucugggacugaauccuggaucugccacuuccuagucagaaucugagccucuauuuucuuaucuguaaaagaagauuauaacagugcuuaucuuguagguacuguugacgauucaauaagauaauguggauaaaaugcuuagcauagugccuggcacauaguaagagcucgguaaaucuaaguucuuacuaaauauccaagaaaagagauuaauucuuuucaggagugagagaaagucaucauuauugaggggcuuuaucagaugggaacaccugaauaggguuuuauaggaugaauaggaauucuuuccacgaaguugcguuacaaaaaguugcauucaaggcugaaggaacaugagggugcagaggcuuaaaacagccuuguguguucagggagcuauaaguagaaguucuuaauuuaggagaacuaaaccaaggggaaaggaggccaaggaaccacaguucuuaucccuuuucuguuaauaauuggguuuaaaugucauuaaaauaaguuauuuuguccuuuuuagaaaaguaauaacaugcuauuauaaaaaaaaagacuuguaggaauauaaaauguguguuuuacauguauccuguuaauugacuugcuuuuauucagauuuuuugcagcccuuucuguuuaccagguuaucuuggagacauauuuauuccaaauuccuuuuuuuuuuuuuuuuugagauggagucucgcucugucgcccaggcuggagugcaguggcgcuaucuuggcucauugcaagcuccgccucccggguucacgccacucuccugccucagccucccgaguagcugggacuacaggcgcccgccaccacgcccagcuaauguuuuuuuuuuuauauuuuuaguagcgacaggguuucaccguguuagccaggauggucucaaucuccucacauugugauccgccugccucggccucccaaagugcugggauuacaggcgugagccagcacgccuggccuuccaaauuccuuuuaacagccuagcaaaagaauaauaaggaagguaaaucugccccuacaagaaaauaaugcuucgacgauccggcuuuccuuccugcuacccccagccauaagaauaaaugaccuugcucaucacugaaauuuuaccugaccuuugaauuuuuaacugcgucagccaaagaacuuauauuuugaguauuccuaaggugauugcuauuguaguuuugaaacacuugguugguauguuugaggguuucaugguccaaaguuacuauagcaguuaaaagaguggacuaucaggucagaccuauugggcuuuaaucccaguucugccuucucuuagaccuugggccuguuguuuucacuucucugguuuucaguuucucuguccacaauuguggaaacgagguccacuuguagaguaauugagaggaugaagcaagaugaugcauaucaaguacuuugcauagugccgggcagacagguaacauucaagugcuaauaauuacuauuauuacuauuuauuuuuugagacagguucucacucugucaccuaggcuggagugcagcggugagaucacagcucaugacagccuugaccuccuaggcucaagugauccuccugccucagccuucgggguagcuggggcuacaggugugugcuaccacccucagcuaauuuucuaauuuuuuugagucaggaucucgucacguugccuaggcugaauuacucuuauuaaaaacuauaauaucaggccgagugcgguggcucacgccuguaaucccagcacuuugggaggccaaggcggguggaucaccugaggucaggaguucaagaccagccugcccaacagagugagaccccccccgucucuacuaaaaauauaaaaauuagccaguugugguggugggcaccuguaaucccagcuacucgggaggcugaggcaggauaaucgcuugaacccgggaggcggagguugcggugaaccgagaucgugccacugcacuacagccugggugacagagugagacucugucucaaaaaaaccgaaaaacaaaaagcauaauuagggugguaacgcuuauacauaggggcagguggaauaaaacauaauuaggaggucgggcaugguggcucacgccuguaauuccagcacuuugggaggccgaggcgggucaggaguucaagaccagccugcccaacauagugagaccccgucucuacuaaaaauauaaaauuuagccuguugugguggcgggugccuguagucccagcuacccgggaggcugaggcaggagaauugcuuuugaacccaggagguggggguugcagugagcugagaucgcgccgcugcacuccagccugggagacagagcaagacuccgucacaaaaacaaaaaacaaaaaacugucauaucaaaaacuaaacuaaaaugguaauaucuguuagauauuacaaagucaggcaaauuaugauucauggcagccacuaaugacccaaaggagagaaagaauaauuagcagauucuaaccuaaugggaaaaaaacuaaaugaauagggaugggggacuuacauucuguuagaggaaauugaggcugucauauaaaaggaauagguaaggcaaacuguaaauuccuguuuacacaaaugcccuucugauaaaucucugcauugcccacaguccaugauuaccucucccuuauuuuaaguaauauuuaacacauuaaaaauggauuaccacccaaggaauugcucccgacccagaaagugcagguaguguugaagguuugaggggaagaggaaugauuagaguugguugugucucaggaagaagccaacaggaggaaccuuauuuugagucagguaaagaaggugggagugaggaggcaucccgguggccagguaugaagcugggagcugauugcugcacauuacucagcugaauuaaaugugcccucacaucugugugugugcguacaugcaaauguacauguguaugaguuaguuggagggguagaccuuuauuuuccuguccuguaacuuuccuuugcaaacuaaucuguauucagaacaguguugcaguuaagaaccacccagcuuguccaugaaacagguucucucaccccaucuccccaguuuuagagaaggcaggaaagaaaaggcagugcuuuucuuuuuuccuggccguaugcggggcaggaagaagccagcagagcuugaaagagaaaguaaaccuucugggaaauaaacggcuuggcuucccuauuguggaggaggagugcaaauuauuagggggauguuuggguaguuuuuguagaagccauuucugaaaacugauuuggauuagugaagguaagcccaauuuaggaaaacccugcccagucuggugucagccaccuguuucccgcuuuguuugauugauuugauuaguuugugguauucugaccucucauuuuuauuacaagaguuggaagauuugagucugaacuugagcaccugcuucggugaaagcuuccuaaaaugcauguuuuuucacauuuuuucucauguucauuuuguuuugcuuuuuagcaaacacuuuuucugacagaaucuaaaagcauuagacuuuucuuguuuuccccuucucuccccacaauguaaucuugaaaacccaaauguuagcuguguaaauuaccucucccguaaaccaaacaaagugcaauauugcauugaguuagcauugaaauagucggccuuugaauuuuuuucuacuugugguuuagacauaauaaauauuucaucucagacugacuuucucgacaaaucaguuuugcauuugggccucuuuucaucaguauguuuagggaaagcacauuuauugaaacauuaaccaaaaugaaacauaauuaggaggccgggagcgauggcucacgccuguaaucccagcacuuugggagaccaaggcauguggauugcuugaggucaggaguucaagaccauccuugccgacuuggugaaauccuguuucuacugaaaauacaaaaaacuagcuggguguggugacgcgugccuguaaucccagcuacucuggaggcuaaagcaagagaaucgcuugaaccugggaggcagagguugcagugagucgagaucgugccacugcacuccagccugggcaacagagacuccgucucaaacaaccaaaaaaacaaaaacaagcauaauuagggugguaacgcuuauacauaggggcagguggaauaauugaagcauucuggagccagaaauaaucaacugauuaagaauaaucuggcugggugcgguggcucacgccuguaaucccagcuacucaggaggcugaggcaggagaaucgcuugaaccugggagguggagguugcagugagccgagaucgcgccauugcacuccagccugggcuauggagcaagacuccaucucaaaaaaaaaaaaaaaaaaaauccuguuucugcagaaauaucccagguguccugggucagcagugccccauagauuccacggacguuuacccuaaguuuuccaaugggaguucauaccucuauacccagugagaauauuuucugaguaaugggaaugagauuggagauguaggguagagaagauccauacagucuuuggguuaaacuuuuuccucuuugccuaggaaagauuaaugcuaaucuuaaccacagauuuguaguaagaauguaucaguuuugucauucaguucuagacuccaguuuucuuuauuguaauaccaauauuuuagaguaaauuuugaaaugaaucaguacaaaagauauguaguaaguggaaaguuaguccgcaccuuauccuugggacucuuucccagggacagcuaguuaccuacuauuuaucucuccugaguuacuucauauguaugcaugcaaacauguuauucucuggguguuguuccuuccauauauagcagcaaauacaccaaacucuguauuuugcuuuuugucacuuuaucuuagagaauacucaaugcaaauacauguguauauaccucauguuuaaaaaaucuacauaguaaaauuagccaggcaugguagugugugccuguaaucccagcuacucgggaggcuguggugggagaaucacuugaacccugagaucacaccacuggacuccagccugggccacagagcaagauucugucucaaaaaacaaaaacaaaaacaaaaaaacuacagaguaguauucuaggcuaugcauaucauaaauuugauuuccuaaugauaggcauagaugauuugccugggcggcaaauuagcguuggcugugucucaggaagaagccaacaggaggaaccuuauuuugagucagguuccaaagacagaaacauugucugacauuuguuuuugggcuuauaugaauaaaucuguacacauauauuuuuaauguuuuaaucguaauauguauacuauuuggaaauguggcuuuuuaguuaacagagugcauguuuuaccccauugcacuuaaacauuaacuuggggauaauuaaaugagucugucacuuggacaggcaggaauuguaccccccacaaacccauaaaccgccaauuuuuuuuuuuugagacagagccucauucuguugcccaggcuggagugcaguggugcgaucugggcccacuguaagcucagccucccggguucaugccauucuccugccucagccucccaaguagcugggacuacaggcgcccgucacaaugcccggcuaauuuuuuguauuuuuaguagagucgggguuucaccauguuagccaggauggucucuaucuccugaccuugugauccgcccgcuuuggccucccaaagugcuggaauuacaggugugagccaccgcaccuggccgguuuuuuuuuuuuuuuuugagauggagucuugcucuguugccaggcuggagugcaauggcaugaucuccgcucacugcaaccuccaccucccggguucaagugauucuccugccucagccuccugaguagcugggacuacaggcgugugccaccacgcacagcuaauuuuuguaauuuuaguagagaugggguuucauuaauaaucauuaauauuagacaacugucagacucacagugguggauacaaacuuucucaaauucugauuuuuacucuaaagcucaaauuuuaucauuggcaacaaauauugucaguugcuuucccugaacagacagcuucccuucuuucauuuuugagaaaauaucugccaguaucccaguugguuuaucaaucauucuuucucuuuuuuuuuuugagacggagucucacucugucacccaggcuggagugcaguggcaugaucucggcucacugcaaccuccaccucccagguuccagcaauucuccugccucagccucccgaguagcugggauuacaggggcuagcagccacaccuggcuaauuuuugcauuuuuaguagagacaggguuuuaccauguuggccaggcugaucuugaacuccugaccucaugauaugcccaccuuggccucccaaagugcugggauuacaggugugagccauugcgcccggcucuauuauuucuuuucuuucuuucuuuuucuuuuuuuuuuuugagauggaguuucgcucuuguugcccaggcuggagugcaauggcgcgaucucggcucaccacaaccuccgccucccgaauucaagugauucucuugccuaagccucccgaguagcugggauuacaggcaugugccaccacacccgucuaguuuuguauuuuuauuagagauggggguuucuccauguuggucaggcuggucucgaacucccaaccucaggagaucugccugccucagccucccaaaguacugggauuacaguuuugagccaccugacccgguuugcuuauuauuucuuuuaaauuuaaaaaauaauaaauaaaggggccaugagagcgaagaguuugagaaagguuggucuaaagguuuuaacauaagaaucccuggguuauuugcuuaaaaagaagaaagaaucuauggaucugccugagagggucugauguaguuuaucuggggucauccucacaggcauagcagauauucugauucagaugguccuugguccuuaguuugagaaauguggcuuuacaaggcccauagaauauaaagucuucuuuggauuagugaagucauguccacaggguuuagaaaauguuuuuguuuuagagauaaagguaaguggaagaguagacauguagugaaugagggaaaauguuuuagagauuucuuuuuauucuguuuacucuucuugguaugcacguaccugaauauuaaggauauuuuaugaagucaugacauuaccagauuaauguugguuuuguuuuaagguacuuucugacugcugggguuaauuccuacagacgauucugguaaagaauagccuuuaaguuuuaaaaguguugacuuauuucagaugucuuaauaaaguuaacuuccaguuauuacauguaacguauauaaagcucucauuuuccuuuauucucguuaauuguuugcauaacaaauucaaagggaaauuugcuuggcagagaucagauagcagagaugagauuuaaaaacagguaauuuggcuacuagccugggaguuugaagauuccaaguuugcauccauguguagucacuuaacauuucuguccuuaucuguaaaugggaauaacaccuacuugauaggguuguuacauuaucuuggccaccucagguucucuuuggcugagugauugacuggaaaacgcaaugugaauucaugcuucagacuggguucuuuuuuuuuuuuuuuuuugagauggaguuucacucuuauugcccaggcuggagugcaauggcacgaucucagcucacugcaaccucugccucccagguucaagcgauucuccugccucaggcucccgaguagcugggauuacaggcaugcaccaccaugccuggcuaauuuuuuuguauuuuuaguagagacgggguuucacuguguuggucagacugguuucaaacuccugaccucaggugauccaccugcuucagucucccaaagugcugggauuacaggcaugagccaccgcacccagcccaggcuagguucuauaugggugugcuuuuuagaauuuagaucaugggcuauccccaacacaaacuggauaauguuucuuucuagauucucucuaagcguguauucucuuucuuuccuaggcacagccaccacuucacuuacauugugggauuauaauuucaugaguaguggaauuuccuuaaccuucucuugugugggagcugaaggacaaaaugagauauucucugaagagugguuacaucaugcaaaacuaugauguguaaugaggucacuuaguuuucuaaguacauuauacauuuugauaagauuuucauagaaaagcuugucuccuuggggagaucacucaucuuccaucuugacuauuauuuaaacuuuaugggucagauuuaucuuuuuaaaaacuuaaccauaaagcucaauuaauuuuuuuuuuuuuuuuuugagacggagucucgcucuguugcccaggcuggaguguaguggcgcgaucucggcucacugcaagcucugccucccagguucaugccauucuccugccucagccuccugacuagaugggacuacaggcgcccgccacgaugcccggcuaauuuuuuguauuuuuaguagagacgggguuucaccguguuaggauggucucgaucuccugaccucgugauccacccgccucggccucccaaagugcugggauuacaagcgugagccaccgcgcccggcucaauuaauauauuuuaaaaauuaauagacuuuauuauuuuuauuuuauuuuauuuuugaggcagagucucgcucugucacccaggcugagugcaguggugugaucuuggcucacugcaaacuccaccucccgggcucaagugauucuccugccucagccuccuaaguagcuaggauuacaggugccugccaccauacccggcuaguuuuuguaauuuuaguagauacguguuuucuuucuuuucuuuucuuuuuuuugagauggaguuucacucuuuuugcccaggcuggagugcaauggcaugaucucggcucacugcaaccuccgccucccagguucaagugauucuccugccucagccucccaaguagcugagauuauaguugucugccaccacgccuggcuaauuuuuuguauguuugauagagacaggguuucacuauguuagccaggaugucucgaucucuugaccucgugauccgccugccuuggccucccaaagugcugggauuacaggcgugagccacugcggccagucuagacuuuauuuuuuaaagcaguguuaguuuuacagaaaaauuauguggaaaguacagagaguuuccauauaccccuuacuuucucccacaacuucuauuauuaacaucuugcauuaguauaguacgucccuuacaacuaaugaaccaacucgauacauuauuauuaaccaaauuccugaguuuauuuuauuucuauuuuuauuuuauuauuauuauuuuuuagagguagggucucacuguguuguccaggccagguugcaguggcaucaucauagcuugcuauagccugaaacuccugggcucaagcaauccuccugccucagucucccaaaguguuggaauuacaggugugagccacucuguccagccugaaguccauaguuuacauuacauuucacucuguugagcauucuauggauuuugacaaaugugugaugauguauauuugccaguacacaauuauauaaaauaguuuuacugcccuagaaacccccugugcuccaccuauucauuccucugcugaaccacuggcaaccacugaucuuuuauaauaucuccauaguuuugucuuuuccagaaugucauauaguuggacauacaguguguagccuuuucagauuggcuucuuucaguaaaugauaugcauuucagguuucuucauguuuuuuuguggcuugauagguuguuucuuuucauuggugaguaauacucuauuguauggauauaccacauguuguuuaucaaacauucaccugaaggauagacaucuugguugcuuccaaguuugagcaguuaugaauaaagcugcuauaaacauuccagugcaggacuuuucaccuccucuggauaaauaucaaggagugcaauugcuagaucauaugguaagaguauguuuaguuuuguaagaagcuaucaaacuauauucaaagugacuguaccauuauacauucccaucagcagugagugagaguuccuguuacuccacaucuucaccagcauuuaguggugucaguguuuuggauuuuagccauuuuaauggguguauaaugguauaccuauuaaaauugguuuuuuuuggagacagaguuucacaguuucacucuuguugcccuggcuggagugcaauggcgcaaucucggcucacugcagccuccgccucccaguuucaagugauucuccugccucagccucccaaguagcugggauuacaggugcacgccaccauguucugcuaauuuuuuuguauuuuaguagagaugggguuucacuguguuacccaggcuggucuugaacuccugagcucagguaauccaccugccucagcuucccaaaguguuaggauuacaggcaugagccaccgcaccuggccucaauuuuuuuuuuuuuuuuuuugagacagaguuuugcuccuguugaccaggcuggagugcaguggcacaaucucggcucacugcaaccuccgccuccugaguucaagcgauucuccugccacagccuccugaguagcugggauuauaggcgcccgccacuacgccuggcuaauuuuuuuuuuuuuuuuaauuagagacgagguuucuccauguuggucaggcuggucuugaacuccccguucucaggugauccgccugccucagccucccaaagugcugagauuacaggugugagccaccgugccccgccuguuuuggcuuuuacugugaagacguguuagccgcugugaugacuagcaaguguggcccuccacccagucgcucugggcucccagcuccugcauccugcugcaaacuugacaucuucccucaaguaacuuguaguugucuccugucuacuugcccaaaauauaacucuuaaacuuuucucucugcaaguuugugccucucucccugucugacuuccccaucuaaauaaaugguagaccaccaucuacuccuuugugcaagccagaaaucuaggaaucauccuuaaauucccuguucugucuuaucucugcuuucauucaaagcaucagcaaauccuguugguucuaccucugaaguuuucucaaauacuguuacuugacucauccugacuuuuguuucugcuuuauguuaggcuaaaugcccugaaaacucuuuuguacaaaacaccuagaaauacuggauaaacugggcuuaacagggaggcccggugugguggcucacgccuguaaucccagaacuuugggaggccaagguggguggaucaccugaggucaggaguuccagaccagccuggccaauacguagugaaaccccaccucuacuaaaaaaaaaaaaaaaaauuagcuggguguuguggugcacaccuguagguggugcaugcuugaacuugggaggcggagguugcagcgagcugagaucgcgccacugcacuucagccugggugacagagcaggauucugucucuuaaaaaaaaaaacaaaaaaagaaaaacaggaaaaucuucagaagcaaaaaccaaacaaucucaccaaagaaaugagaagauggcugggcgcgguggcucacgccuguaaucccagcacuuugggaggccgaggcgggcagaucacccgagaugggcagaucacccgaggucaggaauucgagaccagccuggccaauauggugaaaccccgucucugcuaaaaauacaaaaauuagccaggugugguggcaggcgccuguaaucccagcuacucaggaggcugaggcaggagaaucgcuugaaccugggaggcggagguugcagugagccgagaucaugccacuguacucuagccuggacgacagagcaagacucugucucaaaaaaaaaaaaggcugggugugguggcucaugccuauaauccuagcacuuugggaggccaaggugggcggaucacuugaggccaggugaacauggcgaaaccccaucucuacuaaaaauacuaaaguuagcugggcaugguggugggugccuguaaucccagcuacucgggaggcgaggcaggagaaucgcuugaaccaggagguggagguuacagugaaccgagaucucgccaccgcacucuagucugggcgacagagcaagacuccgucucaaaaaacaacaacaaaaaaccaacacauggccaaagugcagugacuuacaucuguauaaucccaauguuuugggaggcugaggcaggaggaucgcuugaguccaggaauuugagaccagccugggcaacauagaccucaucaccaaaaaaaaaauauuuuuuaauuagcuggguuuggcagcauguaccuguaguccuagcuacucaggaggcugaggugggaggaucacuuaggcccaggaguuugauaguucgagguuauagugagcuaugauccugccacugcacuccagccugggccacagagugagacccugucucuuagaaacaaaacaaaacaaaaaaaagaaacugaauuaaaaacaacaagaacaaaaaugcugcuuuuuguuauugaguuguagcccaaguuucuugaggguaaagcauugaaaagcaggcaguaauagauuugcuguuuaaagagauuuacuugcagcacuauucacaauagcaaagacauggaaucaaccuaaaugcccaucagugacaaauuggauaaagaaaaugugguacauacacuguggaauacuaugcagccauaaaaaacaacgagaucauguuuuuguuuguuuguuuguuuguuuguuuuugagauggagucuugcucuauugcccaggcuggaaugcagguggcacgauuucagcucacugcaaccuccgccucccagguucaagcaauucucugccucagccucccgaguagcugggauuacaggugcccuccaccaugccuggcuaauuuuuguauuucuaguagagaugggguuucaccguguugggcaggcuguucuugaacuccugaccucaugauccucccaccucggccucccaaagugccgggauuacgugugagccaccgugcucggcugagaucauguuuuugcaggaacauggauggagcuggaggcuauuauccuuagcaaaguaaugcaggaacagaaaaccgaagaccacguguucucacuuauaagugggagcuaaaugauaaggacuugugaacacaaagaaggaaaccacagauacugggguuuacuugaggguggagagugggaggagggagaggaacagaaaagauaacuauuggguauugggcuuaauacuuaauauuuuaucaaaauaagcuguacaacaaaccccucugacaugaguuuaccuauauaacaaacuugcacguguaaccccaaaccuaaaauaaaaguuaaaaaaaaaaaaaaaggcugguugcauugggaggcugaggcaggcagagcacuugaggccaggaauucgagaccagcuuggcuaacguggagaaacccugucucuacuaaaaauucaaaaauuagccaggugugguggugcaugccugcagucccagcuaccagggaggcugaggcaggagaauugcuugaacucaggaggcagagguugcagugagcugagauugcaccacugcauuccagccugggcgacagggcgagaccuugucucaaaaaacaaaacaaaacaaaacaaaaaccugucacuuugggaauaucucaaaccuagucauccaagugguuguacgauuuuagugucugcauaucaauauuuagugugaucuacuuucuuagauucucaaauacugccaaugggcacaugucaugaaauaaugucuuuuagaggacaagagagugcuaaagucucauuauugcaguuuaagaaaaacaauucuguaacaguuuaacuuuauaggaaaugccuuuuguuuauuuauuuuuuuucuuuugaggcuuagauuuuuauuuuuauguuuuuagagauggggucuuccuauguuacccaggcuggccuugaauuccugggcucaagugaucuuccugcuucagccuccugaguagcugggacuagacguccacuacugcuccuggcuggaaguuuagauuuuaauuuaaacucuucuauugggaaacuuuguauguuugcuuuaccacuuaacauuugcaugcauuauuguaccuauugucuccuacuuaaggaagggcaguuuaugcuguuauaugaagugaauuaaccuccuaugguacuucaguuuucucuaugcuaaaaguguguucuagauuuuugaaaaacuuacuuaauuuucauucauuuauucaaauauuugagcauucuguaguugcuggggaaauagcagugaacugaagaaugucuuuguucuuauggggcuuaaguuccuaguugaucauauuggaaggagauacaugaaaaaagaaauauaugaacaauggagggcgaugaguacuguaaaggagaauucagcaggggagauguugcuguuuuagauagaggggugucaagagacauugugcagagaccugaacgaagugagggagcaagccauggagauaucuagggaaagagccuaucagguggagagaagaguccuagggcagaaacgggcaagguguguuccaggagcagagaggggacagcugugagcaaggggagaguuguagggaaggaggcaaagagagacaucuggggcaaaauggauugacuggugggccgugguaggacuuuggauuuuuuccugaguggguuuugagcaggggaaugaaaugaucugacucugguuuuuuuuuuuuuuggagacaaaaucuugcucuguugccgaggcugaagugcaguggcgcaaucucggcucauugcaacaucuacuuccuggguucaagcuaugcuccugccucagccucccgaguagcuaggauuacaggcuugggccaccaugccggcgaauuucuguuuuuauuuuuauuuuuuauuuauuuuuauguuuauguuuuuugagacggagucucgcugugucacccaggcuggagugcaguggcgcgaucucagcucacugcaaccucugccuccccgguucaagcaacuucuccugccucagccucccgaguagcugagauuacaggcgccugccacuacaccuggcuaauuuuuguauuuuuaguagaaacgggauuucaccuuguuggccaggcuggucucgaacuccugaccuuaauuuaucugcucgccuuggccucccaaagugcugggaugacagguuugagccaccgugccagccaggacucuuauuuugaaaggaucuguaauguggagaauagaagguagagggacaaggaugaaagcauccaggccaguuagccuaguccagcuaucuagguaagagaugcugguggccuggauuaaggcugcgucagugggagguugugagaaaggcucaccuuccuuuuuuuuuuuuuuuuuuuuuuuugagacaggaucuuacucugucucccaggcuggagugcaguggugcaaucucagcuuacuacaaccuccgccuccugggcucaagugauacccccaccucagccucccaaguagcugggaucacaggcuugcgccacuauauccggcuaauuuuuguauauuucguagagacaggguuuugccauguugccuaggcuggucucaaacuccugagcucaagugauccacccgccucagccuccuaaagugcugggauuauaggccugagccauugugcccggucacuuccagauuuugaagacagagccaacaggauuuguuaauggauuagguguggcaggaggagggggaggaagagagagagagacuggaguugaaguuaaggcucauuucaagguuuuuagccucaacaugugcaggaauggaguugucacuugcuagaaugggggagacuggaggagaagccggcugggagagguuuuuaaugaagggguuggcuuuggauacauuaaguuugacaugcauuuuagacauccagguggagauauugaagaggcaguuggcuauaagugucugauguucauauuagcggauggggcuagagacauaaauuugagaauugucaguguauaaacguuguuuugaaagaaaguggggcugaauaauuuagaaaggagugcauagagaaaauaaguuuacuauuaaaauagcuuuaacaggccgggcacgguggcucaugccuguaaucccagcacuuugggaggcuggggugggcagaucaaaaggucaggaguuugagaccagccuggccaauauggugaaacccugucucuacugaaaauacaaaaauuagccaggcguuguaccgggcaccuguagucccagcuacuugggagguugaggcaggagaaucacuucaacccgggagguggagguugcagugagccaagaucacgccacugcacuccauccugggcaacagagcaagacuccgucucaaaaaaaaaaacaaaaaaaaacaaaaaaaaaaaacuuuaacagcaaagccucuuccuuuaaaauuaugaauuuuuuucuuauggaaguuggacucuuucauuauuaagucuacauucaaucacuauguuaguaaaaauguuguucuaguugccgaaugcaauaaaccagcucagacuuaguggccuaaagcagcaaucauuugacuauguucgaagaugccgugggcaggaauuuagauaacagcagggauggcuugucuuugcucugcgaugucugaggucucacugagaaaacucaagcggcuggggguaauaaucaucuggaauuuucuuuacuccuguaucugaugucugggcugcgaugacucaaaggcugauuucagcugagacuguagaccacgugccuacuuguggccuccccuuuugccuuggguuucucacagaauguggcugguucuggagaaugagacuuccaaugaaaucagguggaaaugacaucucgccgcuuucagcaugcucuauugguuggaacaguuauggacuuagcuagauucaaaggaagggaacaaagacccccuccucucagagaguggggcauaaugagagaauuuagggccauguuauccaaccaccacaaaugccuucugaauuugagguucugccucaaaaguucauaguuccuuugacugaaggacuucuauauauccaagcaucgucagccccagguauauuguuccauguaagugaccaggacuaccuuaguauuucguauagggaaagugaccugaauaaauuugagaaaagaaucuuccuucucuccaguaagcacugagguaagcauugagccauauuauagguuuaugacuuugagacucagaaauuuaaauucuuggccaggcgcaguggcucacgccuguaaccccaacacuuugggaggccaaggcaggcagaucacuugaggucaggaguuugagaccaaccuggccaaaauggugaaacuccaucucuacgaaaaauacaaaaauuagccaggugugguggcgggcaccuguaaucccagcuacuugggaggcugagguaagagaauggcuuaaguucucuuuaucugcuuuauuucaguugccucucuuagaugaauauuaaugacuuacauagcauuuuagaucaguggauguuuuugugauucuuuuauuugagcuuuggccaaagauaacaguacccacagguuuuuuccagcuacucgcucuucucccuucaguggcccucgagccuggaaaaucugacaugacaaugugcuugcucaaccuaccacuguuuuucuuuugaaaaguuuggcagccuguuucugacuccuaugaaggugaauuccucagcauucacaguuuauuagaaaaauacuuugcuucucuccaaacucgaaauucaagauaaccaaaccuauauauaggcugaucuuucaggaugcaguugucauguugaugccaugcuuuucaguaucguggccaucaucuguucaguaggggagguguacuucuguaaugggagguggugguuaugugugugugcaaguguuuauuuggugucuuaaguuagccugugggaaguucuaaaucaggaugguacgugguugccagcagagagcugcuccucaagugaaggagguagaaucaaagccaauaggaaagagccucagaugcuuauauauguaccguggggauucagagugaaagcagucauuggacuaggggugggguuagggagagccugucugacagacacaagaaagggauggauaacgccacccagagaaaaaagcauuuuaggcaagaacaaauaugaaaaaggaacaaagucuguggguggggggcaaggaggagauaaguugacuugaaggaagacaacacuuaugaaagucaccuggaggcugggugccauggcucaugccuauaaucgcagcacuuugggaggccgagguaggaggacaacuugagcccaggaguucgagaccauccugggcaacauggugagacugagucucuaccaaaaaaaaaaaaaaaagaaaauuauccagacaugguggcaugugccuguaaucccaguuacucaggaggcugaggugggaggguugcuugagcccaggagguugaggcugcagugagcugugaucguauuauugcacuccagccuggguaacagagcaagacccugucucaaaaaaugaaagucaucuguaggcuggagagaggaacuggaaggggcuaaaguuggcugaguaguuacagagccugagauaaggguaaagauuuugcauuggacaaugagauguuaguguguguuuuugagcuggggagugcugugauuuuacucuuauugaagaaucacugaaggauuauucuugaaucagugauucuugaucauucuugaauuuuucaaacagcaaaacuggaagaguuggccuauuccucagaauauuuucuaauugggcgcaguguccucacuugggagaaccuggcuacacacuuuaguuguaauucacuccagucguucauucauucaauaccuauuuuuucagcaccuauuaugagccagacacuaugcuggaugccaggguucaggguaggacacgcuagugagcaaaagccaagacucuucuugucuucauggggcuuucaguccagcauagugguuaugaguccaaguuaauggagucacaguacuugggugcaagucauggugauggugauagaaggaaggcaugugugagggccaguggcaggcaggagccugguguuuuugaggaccugaagaaggagcagagugagugccaggaacuuagccaccagcugguaccagccauacgagaggggcagagccagccaggaugucggucaugcuaguaaugaguacaaacacuuacaugcugcacgcuauugggcuccugagugcuacguguucauuagcucgaugaauuuguacagcaacccugugagguaagcacuguucucuccccuuucuauagaugaggaaauuaaggcacaaagaggauaaauaacuggcaccagcuacacgcuaagugaucgaagugguggaaccaggauucaaauccaugcuauucugccuuaagauaacaaaucuuguuuuuuagccuaagaacagagcagucaucaggaggguuuuaaguagggguguggcaagaucaaguuugugucuugaaaaggucucucuacccacaguguggaaaauggccuggaggcaagcacacagauguugggagacaguuaacagcucuugccauggcccccuaugcauuuuggcucugauguuucugccugauuuuucucuugccucugccucuuuuccugaggggauggcagguuuuaccauucagcuggaguacaaacccugaacccuuuuugguuaaauaucuacuugcuuuuccuacaguauuauuuugaguugcuguggcuguaaugucuugagggaaucgagcuugacaguaauuuauagaacaaacaguuuuuagagacuguguggcccaauugcccucucaauguuggcacuccugccaugacauuuaccaugcugagcaugugaccgccaucugaauaccaaaugccacaggaaccugggagguugucacuuacuccucccuuucucugagucaccuuugcccuucagucagucaccaagucccaucacauguagcucuguaaugucacagaagauggaugucugccucaaaacacuuacaaugcugcuaccuaaauugggcagccacgaccucccaccaggauuauugcagccugagggaucuuuuugaaauguaaaucaaacuaucacuugucuguuuaaagcuuuucaaagacuuaccccauugcccuuggaagaaagugcagauaucuugacaggagagccuucuccagccuccucuucugccguggucuccuuguacagucucuacaguguacugcuucauuagaacccuggagauuauuauuugcuaguucugggcuaagaacuggcaccuggcuuuguagagcuccucaggagauucugaggcguauucagaguugagcccugaucucugcucugauuucgagguucucguuauauuuauuaaugaucacgaaaaaauuuauuauuauucuuuggccucacuuuagcaucaucugaggaauuuuuuuuuuuuuuugacagaguuuugcucuuguugcccaggcuggagugcaauggcgugaucucagcucacugcaaccuccgccucccggguucaagagauucuccugccucagccucccaaguagcugaaauuacaggcauccaccaccaugccugcuaauguuuuuguauuuuuuaguagaggugggcuuucacaguguuggucaggcugguuuugaacuccugacgucagcugauccacccaccuaggccccccagagugcugggauuacaggugugagccaccgugcccagccguagcuuucgaaauuugaaaccuggucccacugucagagguuccaauuuggcacugguuugguucccaggcaucuuucuugcuguauauauuuuuuagugucagccaggguggagaccucuguauuacuucauggggaagaauuugggagaagauguugugaggagacagguucuaguccuagagugauuuauccuuucucguacagauuuccagguauuugaggggccacucuucuguaauucauguuuuucucuccuaaccucacuccuguugccugcaucuucuugcugagcaaaauauucaaggucuucaacuccucacacccugguugucccucccuggauguguuugguuguuuuaguguuccauuucaauuuugauacacagaauuagaauagcauccagaugugggucuguuacagcuagacuacuagauccuucaaaauccaaguacuaguaugucuauuaaaauaccauaagaucacauuggcuaguuacaaugguugguuuguggguuacuuaaaaaucaacuaaaauucuuuuuuuuuuuuugagauggaguuuugcucuuguugccuaggcuggaaugcaaugacacaaucuuggcucacugccaccucugccucccagguucaagcaauuccccugccuuagccuccugaguagcugggauuacaggcaugugccaccauggccagcuaauucuguauuuuuaguagagaugagguuuuuccauguuggucaggcuggucucgaacucccgaccucaggugauccaccugccucagccucccaaagugcugggauuacaggcgugagccacugagccuggccaaaauucccacuuucuaauacuccuguaguagcuggguacggugggucacaucuguaaucccagcacuuuuggaggcugaggcuggaggaucgcuugagccuaggaguucgagaccagccugggcaagauggccagacgccaucucuaauuuaaaaaaaagaaaaaacaagacuccuauaguggugaagaacagacauuccgaaaacagacugugcguuaugauuccagcuccaugccuuuacuaccuguguugugacuuuggauaaaucacuuaaaaaucuuuuuuuuuuuuuuuuuuuuuugagacggagucuugcucugccgcccaggcuggagugcaguggcgcgaucucggcucacugcaagcucugccucccagguucacaccauucuccugccucagccucccaaguagcugggacugcaggugcccgccacuacaccuggcuaauuuuuuguauuuuuaguagagacgggguuucaccguguuagccaggauggucucgaucuccuguccucgugauccacccgccucagccucucaaaguguugggauuacaggcgugagccaccgcacccggccaaaucacuuaaaauucugugccucaguuucuccucuguaaagugggauaaaaauaguaccuaucugauaggguuguuacaauuaugaaaugagcaaauaaguaugucaaguguuuaaaacagcgccuggcuucuuguaaaaagugcuauauaaaucauagcuauaaucauuacuuauuucgacugcucuuuaaccaagguucuuauuuuucaucuuuuucuuuuguuuugaauaucacuuaguguuuucaccuuuuacucuuuuuaggaccuagagccauccuaggugaaauacguauggagauauuugaucaggucaccacccagcucuccugaccucccuucucuccuuaaauuaacaugccaaaucacagcaucacugacuccuucccucccgauaugauaagagugugcauugaaaugcauguauuuuacuuagcagggaaagcugauuagugauuaucacacuuaaccccuagugaaucugauggauuaaccugcuuuccaggacacuaaggaaauggguuuaagauaagaaauaucuggcugggugcgguggcuuuacgccuguaaucccagcacuuugggaggccgaggugggcagaucacgaggucaggugauugagaucauccuggcuaacacgaugaaacccccucuuuacuaaaaauacaaaaaauuagccgggugugguggcgggcgccuggagucccagcuacucgggaggcugaggcaagagaauggugugaacccaggaggcagagcuugcagugagcugagauugugcccaccgcauuccagccugggcaacagagugagacuacaucucaaaaaaaaaaaaaaaaaaaguaagaaauguccaugaaagggagacccugggggaaaggaacaauaacugcagcucugaggaucuggcaccagcagcaccagcacagagggaugcuguacaaccauuauugauuuuaacuuuacaacaguucuucaaaggagagagaguucccuguuuuacugaagagaaagcccauuugguagugaaauaccauucccaaagacaaauagcuaauaaaugucaggcaggguuuugcacccaggcccauccagcucccgucucuacuguccuuucccccacaccacacugauacagaggaaugugucugguuggggaaguggaaguguucccaaguggggaggucaucugaugcacaaauuuggucuguuuuguggguuuucuuguuuuaguuuuaguuuuuguagagcucagaccuguucuuaggcagcuuuaacaaucaacugugcacucaguaauugacaaaucauguuuguuacuuuuaauuuagagggaauuagguuuguuaagcucuugcuccuucuuuagagauggggucuagcucugucacccaggcuggagcgcagugguaugaucacagcucacugcagucucaaucugcucaagugauccuccugccucagccuccaugggacuacaagcaugggccaccaugcuaggcuaauuuuaaaaaaauuuuuuuguagaggcaaggucucacgguguugcccaggcuggucuugaacuccugagcucaagcaaucccucuuccaccuuggccucucaaagugcuagaauuauaggcaugagccaccaugccuggccuuuacuucuuucauauauucaaauuuugucauauuaguagggaacuauaacucaaguuuucuuauagauugauguucauuuuuacaagcuugaucgucauugguuuuuaauuuuaaagcaaauccuguuauauguaauugaacauuacaguaauuauaguaauuuguuucagauugggcacucaaguguuaauauuuugucucuuuaggaaaucaaaacuagauuuauauauagacuucuuauugcaaguaucuagucuuaaaucuuacaaagguacuauuuggacuuaaaacuaugaaauugugugcuuacuauauaaguguacuuauuuugaguuauguuuuaaacuugaaauuccauucuuaaugucuagaguaauuaugaaugguuaaauuaugaaugacucuaauaguuuaaagcuacaguauuuauuuauuuauuuauuuaauuuauuuuuugagauggaguuucgcucuugucgcccaggcuggaguguaguggcaccaucuugguucacugcaaccucugccucgcggguucaagugauucuccugccucagccucccaaguggcugggauuacagguguauuucaccaugccuggcuaauuuuuguauuuuuaguagagacaggcuuuugccauguuagccuggcuggucucgaacuccugaccucaggugaccuacccuccucagccucccaaggauuacaagcaugagccaccacaccuggccuacaguauuuuaauguggacucucugucauccauuaugcuguuuauccuguggugaaaauuuuaugaagauugaauguuuuucucuagcgugaauugcuuucucuuacuuuucucauuuuuuuccuuccuaaucuacuugcagauacuucagauuauuuuuagaacgugguauggugagaacaaauaaauugggguuuccaaaucuuaauaaauuauguggcccucagugggauuagcaggguuguauugaaaacaccaauagaaacaaaauaguucuuuuaugcgcuuuaaauaaaaauuucuuuucaggccaggcgcaguggcucacaccuguaaucccagcacccugggaggcugaggcaggcagaucaccucaggucaggaguuuaagacaagccuggccaacauggugaagcgccgucucuacuaaaaauacaaaaauuagccggguaugauggcgcaugccuguaaucccagcuacuccagaggcugaggcaugagaaucacuugaacucaggagauggagguugcagugagcugagauggugccacugcacucuagccugggcaacagagugagauucugucucaaacaacaacaacaacaauaacaaaacaucucuuuucaggccagguacuguggcucacgccuguaaucccagcacuuugggaggccaaaacaggagggucgcuugagaccaggaguuugagaccagcuugggcagcuggucucuauuugaacaaacaaacaaacaaacacaauacucuuuucauagaaaaauguuuacuacacaauaaacuuuaaaagaauaugcagcuguauuaaugcuaugacuccaauguaaaaaaaaaaaaauauauauauauauauacacacacacaaacacauucugaaauagauuuaaaggaauuacaucaacaugucaauuuuuauuuuuucggagacagggucucgcugugucacccaagcuggaguacaguggugcaaucacagcucacugcagccuugacuuccuggccucaagugauccuccccccucagccucccaaagugcuggggucacagaccaccacaccuggcaacaugucaguuuuuguucugcauagugggauggugggauauggauguuuuuaucuuuuauuuucuuuuuuauauuuuucuaaauuuuccacauugaacauuauuuuauaaucuuucaaacauaucucuuaaaaggacugguuccuauagaauucagugcaagaaaucuucuguguuucuuuauacuuugguugccuugaucacugggccuuuccugacagcaaagaagagguuaguguaggcagcagauaaaacacagguaugcucuauuuaaaaugcauguauuuauaauaaaaguauaggugguacccaaaggaaaaugucaugacacauugcaaaguggaacagaaguuaucuuuagaucacuuucuguucuggauuauuguaugagccugauuuucgucucucuuuccgccuucccucacccucguuguaaauccacuagugcauggaugugaaguacaagucuuaacuuuaaaaaguuuuaugaagcuguguaguaaaucccuuuuguaaguggucuugacugcguuucucaauauaucuuuugguuucauuagauucaaguauauaaaugagaacuguaacuuuggacagacuuuuucagucaucuuuacgguaauaaguucccaauuagacaauaguuauuuguuuuaugacuugcuguugguagguuauccccaagggacugagaaauuccuguuuugaaaaguccaaaaagucuuugaugacuugcuguuucauuuuuuucuuuucucuucaguuauagaaaacaggauuacacccaccuugccuuuguacagugcaucuacuaucugcugacuuaaccugaguaaaugcuuugaauugagccccauauaauguccuaaggcagccuauauggaguaaugaauugucuucucucuuaugcacccagagugguaguuggcacucaaguuguuccucagauaacuuuguguguucuggggcucaaugaaguaguuauuaagucacaggcuuggggagaacauucauccuauggcauugaaugaaguguugcccaauucuagaaugucuaauaaaauuuuuuuaaaaacccacaggcuuagaauuauuccguagauaugaaguaauguaguuagaacuuaguggaguucuuuagauuaacuuguaauuugaaaaaccaaaauugaaauugugaaauaacaugggcucuuugaggucuuuuccaguaaaacaguuacaguaaagcugcuuggcagugauuuuccuagacacuuuggcuagucaucuccugugacugcuguuaauuaaauaugguuuguagcuaagcagccuguaaggagaagacuauggaaguauuugcauauucucuccuugaaaauacuaccuggucuuuggcuuuaaguuauacuuuuauuuuccccuguagaauaacuauuaaaguauuaccuauggugauuagacuaagaaguaaaacaugaaaucagucauuguuggugcccuggugccuucuuuuuuuuuuuuuugagacagagucucacucuguugcccaggcuggagugcaauggcacgaucuuggcucacugcaaccucugccucccagguucaagcgauucuccugccucagccucccaaguagcugagacuacaggcgcccaccaccacgccuggcuaauuuuugaauuuuuaguagagacaggguuucacuauauuggcuaggcuggucucaaacuccugaccuugugauccgcccaccucagccucccaaagugcugggauuauagguguuagccacugugcccagccuggugcuuuaauuuuauggaaaaaacuacuagcugguuucuguuuuaagaaauaacacaggccgggugccaugacuugcgcuuguacucccagcaguuugggaggccgaggcgggcggaucacgaggucaggaguuugagaccagccuggccaacauagugaaaccccgucucuacuaaaaauacaaaaauuagccgggcgugguggggcaugccuguagucccagcuacucgggaggcugaggcaggagaaucgcuugaaccugggagguggaggcugcagugagccaagaucgccccacugcacaccagcccgggugacaguauuucaucucaaaaaaaaaaaaaaaaaaaagaacacaauuauuguacuacuuacuagcccuccucuguccccagcuaaaaauaagaacagcaacaaccaaaaaauccuuaguuauguacuggaaaugaauuagauaauuuucaauaacuuacacguuuuuaggauauguuaguuugaaaaugcaaauauucaugcaugaccccaguguuaaucuaugauggagcagguauagugggaugcuguuucaugauuuaauuuggaccuucagggaguagacugugaugccucugcauuuguauccaagacaaauaauuaaauagucuauuuuuggcugggcaugaugccucaugccugcagucccagcacuuugggaggcugaggugggaggaucgcuugaggccaggaguucaagaucagucugggcaacaaaaugagaccuugucucuacaaaaacuacaaaaaauuagcugaacauuguggcuugugccccuagucccagcuacucaggucccugaguuaggaggauugcuugagcccaggaguuggagguuacagugaucuauauuugccacugcacuccagccugggugacagagagagacccugucucaaaaaauaaagucuguuuuuaaaauuaauuuuaaacacuggaguuuauuacaaaaagcaguugguucuuuuuuuaaaucauuuuuuuuuaggagaaccaccgcuuuuuggcuacauugucuagaguagcaguguucaauaaaaauaagauccaagucacauauguaauguuaaguuuucuuuuaguuucuuuuucuuuucuuuucuuuucucuucuuucuuucuuucuuucuuuuuuuuuuuuuugauaugcagucucacucuguugcccaggcuggagugcaguggcacgaucucggcccacugcaaccuccgccucccggguucaagcaauucuccugccucagccucccgaguagcugggacuacaggcaugugccaccauacccagcuaauuuuuguauuuuuaguagagauggagcuuugccauguuggccagucuggucucaaacuccugaccucgggugauccacaugcuuuggccucccuaagugcugggauuacaggcaugagccaccaugcccuaccaauguuaaguuuucuaguagccauauuaaaagaaguaaaaagaaaugggugaaguuaauuuuaauaauauauuuuauuuaacccaauauaucuaaaauauuaucauuucaacaugaacaagauacuuuacauucuuuuguuuuucacuaaguccucaaaauccaguguguauuuuauauugacagcauaguucaguuugaagcagccacauuucaagugcucaguagccacauguggcuagugacuccauacuggacuguguagguuuagaguuucaguaaauuuguaugcaauagaaucuacauaaauuggcauauuaugcagauuucuuuguaugcacaucaguucuugcauagcauaagucaggucaugaugcuuuuagucuaugaggcagauuuuuuuuuuuuuuuuuuugagacagagucucacuuggucacccaggcuggaguguagaugcacaaucuuggcucacugcaaccuccaugugaggcagauuuuaacuuggcccuaaugcaaauauuguaagagagaucuaauggccuuugauuucuuacagagggcaaucaauacaugccaugguuacaaugcuucagcauauaguaugcacgucagccacugcuuuuacucuggcuagugcuuaguguaccuguaccacugcccaggcagcauuuguccuguggcaggugaaucuuaggguggaagguggcaaguaacauugcuuuuuuuugagagggagucuugcuguauugcccaggcuggagugcaguggugcgaucucggcucacuacaaccuccaccucccggguucaagugauucuccugccucagccuccugaguagcugggauuacagacggccaccaccaugcucggcuaauuuuuguauuuuuaguagagacgggguuucacuauguuggccaggcuggucucgaacuccugaccucgugauccacccgccucggccucccaaaguucugggauuacaggugugagccaccgugcccagccuacauuuuuaaauuaauuaauuauaagcaggaucucacuguguuggccagacuggucuugaacugauaagaguucaagaccagccuaggcaacaugguaaaacccugucuacuaaaaaauacaaaaaaaaaaauuagcugggcaugguggugcgugccuauaaucccagcuacuugggaggcugaggcaggaaaaucgcuugaacccgggagacugaaguugcagugaggugagauugcaccacugcacuccagccuaggcgauuccaucucaaaaacaauaacaacaaaauaacauuguuggaauauuuaguuaauuuauagaagcguauuggccuaauuggggcaaauaccuuauucugacauucucucuauuugcuuuacugagcuuuuucaccaguggaauuuaagcccuugauacaugaggagggaaaauaccuuggagcugugcugcacauguaaaguacacaggagauuuagaaaacuucguagcaaaaaaaagaguguaaaguaucucauuaauaguuuuugugggcuggacacgguggcucaagccuauacucuuggcacauugggaggcugagaugcaugagucuaggaguuugagaccagccugggcaacacaguaggaccccgucucuacaaaaauaaucagccagauguggugcgcaucuguagucccaguuacuugagaggcugaggugggaggaucguuugagcugggaaguugaggcuacagugagcugugauugaaccacugcacuccagccugggugacagagugccugucuccaaaaaauaaauaaauaaauaauaauauguuuuguauguucauauguugcaauaacauuuuggauauauuaaaugaaauaaaauacauuaaaauuaauuucaccuguuucuuuucuuuucuuuuuuuuuuuuuuuuuugagauggagucucgcuaugucaucaggcuggagugcaguggcacgaucucggcucacugcaaccuccuccuccuggguucaagcgauucuucugccucagccucccuaguagcugggauuaaaggcaugugccaccacacccagcuaauuuuuguauuuuuaguagagacgggguuucaccauauuggccaggauggucucgaucuccugaccucaugauccgccugccuuggccucccaaaguucugggauuacaggcgugagccacugcacccagccucuuuuaacuuuuuaaguauggcuaccagaaaauuuaaaaugcauguguggccuguauucuauuucuguuggaugcugcugccuuagauuauuaauuauucaauguaaagacugcugggagguacuaccugcacuucccugaauauaugcuugagagcuccaccagccgucuucacaguagcaagagggguauucugagucugucccccaaagagggagggagaagugcagcccucucagguucugucagaaaaccugaucccaggccaggcgugguagcuuacgccuguaaucccagcacuuugggagguugaggcaggaggauugcuuaagcccaggaguucgagaccagccugggcaacacagugaagacccuaucucuacaaaaauuuuuuuaaaaaaauuagccaggugcagcaaugcugccuguacucccagcugcuugggaggcugagguaggaggauugccugagcccaggaguuagagguugcaggaguuagagguuccacgaucgcaccuuucauuccguuacauuugcugccuugagaacagaagaccugcugguuuuguugccaguuugcucagucauuuuuaugaaaaagccagugcuaacuaggugcuucuucgugccuucucugagaaucaagaacucuaguauguuugcguguguucagucucucauuaaauguucucacuaucccagagaaccaucucauuggaccuuggucuguacauaccuucaucuuuggcucugacuuguaauuauuuuuagaacuucucuuuuuuuuuuuuuggagacagaguuuugcucuaguugccagacuggaaugcaguggcacgaucucagcucaccucaaccucugccuuccagguucaagcaauucuccugccucaaccucuugaguagcuguaauuacaggcaugugccaccacgccuggcuaauuuuguguuuuuaguagagacaggguuucuccaaguuggucaggcuggucucaaacucccgaccucaggugaucugcccgccuuggccucccaaagugcugggauuacaggcguaagccacugcgccuggccuaauuuuagaacuuguuaaaacaacuuggccucuauugauauuuccaugacccaugcuauucagaaagaggauuacagguaauuagcuggcuggguuucucauaccagagcauuucacugggauguuccugaaccugggacaacuuuuaugccuggcauuuuucuuuccuucucuguugucccagacuaagcaauuuuuaaaauaguuauuauuuguugaguaggagaaucucaggcagaucuuccuggauccucauuuauacuuuuaaaccuguagucuuggaauuagugcucugucccccaaccccaaacauccaauuucuacauuuuggcuacaguacagguuuacuguguauaacuaaaagggcuguggaggagaaagaaaggaaccgacauuuguugggcaucuguuaugugccaugcacugagcuggaugcuguaggaauaucucaauaccucugaggagugggaauuauuaucucuauuuuauagacaagggaauagaaaucugggaguuaaguaauuuuuuaauuucacacacuucugguagauaauggauucuagaaccuggcauaauagccacuugucaucccaguguaaaagagauguguggccagaugggguggcucacauauguaaucccagcacuuugggaagccgaggcaggaggaugacuugagcccaggaguucaagaccagccugggcauguuuuguuugucucacgaaacauuuuuuaaaaaaugaguguggcaugguguugugugccuauagucccagcuccucgggaggcugaggugggaggaucucuugagcccaugaucaugccauugcacucuagccugggccacagagcaagacucugucuucaaaaaauaauaaaaaggagcugugauuaucccaagguggggauugugaauguguuuguauuguucuaaacugggagaaacaggcuggguguguuggcuuaugccuguaaucucagcacuuugggaggccaaggugggaggaucacuugaguccaggaguucaaggccacccugggcaacaggcaaaaaauagagaccccaucucuauuuuuuaaaaauaaaauaaacugggagaaagaagcaggguccuccccagagcaucuuuaucccuagucacagaccugacaccuguguugggcaauggcuacuucuagauuguuuaccccuacugggacuuguggugaacauaugcacacuuugguuuacaguugggaccccugauuuuagcaggauggcccaauggaaucagcuacagcagcuugacacacgguaccuggagcagcuccaucagcucuacagugacagcuucccaauggagcugcggcaguuucuggccccuuggauugagagucaagauugguaaguccuucuuaagugacucuccaaauuguuagguuucaguuugagucaagagacaugaacucuuaaugucaugccuugcuguuccauuaaaaaauguauggguacaggugauggggaaaaugagaucaggagauaaaggggcacccuuuggucuuguaaagccuuuuuuaucuuagaagggcaugugggcaacugucuuugacacauugaaaccgccuguauggugguggaugucuugaagguugauuuggaccucauuuacuugggcagauccucuauauauucugauaauccagugaugugguagacauauuuuuucucugaaugugaauucugucauagcuagaacuuuggguugauacuuguaauuccccuuuaguuaaaggaaggagccacagggguguauuagucuguucucaauuugcuauaaagaaauaccugagacuggguaauuuauaagaaaagagguuuaaucggcucauaguucugcaggcuauauaggaagcauagcagcaucugcugcuggggaggccucagcaagcuuccaaucauggcggaaggcagagagggagcaggcaggucacauggccacagcaagagcaagagagcaagggggaggugccacacacuuuuaaacuaucagaucucacaagaacucacugucucgaggacaguaucaacagggaugguauuaaaccauucaugagaaacccacccccaugauccagucaccuuccaccaggccccaccucaaacaguggggguuacauuucaguaugagauuugggcagggauguagauccaaacuagaucacaggauaagggaaguagauuccauucauagagcagauaauggcacagauguccagcaacuauuuucuucacuuuaauaugcucaggcucacuacugauuuugguuuaauucaggccaguguuaauaugaccugguuuuuccagaaugcauacucugauuuggugaagggccaggaggugauucacagauguuggagauaggccaucccagccugggauuacuuauuuguacuaauaaaucugaccagaguuaauugaggguuuaaagcaaaacagcauaucugucuacuuugcucaaauauuuuacaaauacaacagauuaugagaguggguaauaauaucuggaauaauuguuuuuuuguuuugugguuuuuuuuuuuuuuuuuuugagauggagucuggcuguagcccaggcuggagugcagugguacagucucggcucacugcaccucugccucuuggauucaagcgauucucccgccucagccucccgaguagcugggauuacaggugcccaccaccacaccuggcuaauuuuuuauuuuuaguagagacagcguuucaccauguuggccagguuggucuggaacuccugaccucaggugauccgccugccucagccucccaaagugcugggauuacaggcaugagccaccaugccuggccuggaauaauuguuaauaauuauuacauugauggcauuuuauugcugagcaagaagaaucuaacaugaugaauggguuauagcaucagguuugcuuuguuuuuuuguuuuuuuccucuuucuugauggugauuucuguguuuguguguaugcgucggcuucagagccauucuuuaucauucuuccuuuuccuagggcauaugcggccagcaaagaaucacaugccacuuugguguuucauaaucuccugggagagauugaccagcaguauagccgcuuccugcaagagucgaauguucucuaucagcacaaucuacgaagaaucaagcaguuucuucagguaugaugagaaacugaggacaaggagaaacaggacccgcagagucggguguuaguguucuuuccuggaagcaucucuuuucucauuuggcuaaguaacgagaaucuaucuuguauuuucaaucacaggagaaguaauuagcccuuucucaaagcucuguauacuuacccgugagcaucauuaccugagaaucacuucucuugucacaguugaaguaauaaagugauuguuauguuaaucauacauguuagcauguuaacgcgguccacugauaggaagaugacucucacuguuacauguuaaauguuugaccauaaugggauacuucuugacuaagucaguagcuucccugcaagaccaggauaguauacuguguaaagacucagacaaggccaggcaugguggcucacgccuguaaucccaacaccuuaggagguugaggugggaggauugcuugagccugggaguuuugagaccagcuugggcaacauaacaagacaccaucucuacagaaauuuuuuuuaaaaacuagcugauugugguggcaugcaccuguagucccagcuacucagaaggcugaggugagaaaauuguuugagccugggaggucgaagcugcaauaagccgugauugcgccacugcacuccagccuggcggacagagugagagccagucucaaaaaaaaaaaaaaaagacucaggcuaaugugccuucuguuacagaaauaguaacgaccuccccuucgccccccgccgacagagagccuucacccaggcucugaagccuuuguuccguuguuuccuagaauaaaugcuuuccuugaugaauacauuaguuuuaaggugccacaguucaguccacaucuccauggucugcugcugauuuuuauucucuuucucuccuacuuauagagcagguaucuugagaagccaauggagauugcccggauuguggcccggugccugugggaagaaucacgccuucuacagacugcagccacugcggcccaggugagaccugagacaaaacaaaucccuggucugggaggaauggaaaaucaaacaacuuuauaaugagauaaauuauuagaucuacuaaaaaagaaggaaaagaaauuaaauagaucaauaaucauaaaaauacauugaaaaacucuaaaaaaaaagaaaguuccaccccccaaaauacauugaaaaacucuaaaaaaaagaaaguuccaccaaaagaauccaacagacccaaugguuuaaaaguuuuguuuuguucugacaaauuuucuuuguuuuucuuuuuuuuuuuuucugagacagaguuuugcucuuguuacccaggcuagagugcaauggcgcgaucuuggcucacugcaaccuccaccuccaggguucaagugauucuccugccucagccucaagaguagcugggauuauaggcgugugccaccacacccagcuaauuuuguauuuuuaguagagacgggguuucuucauguuggucaggcuggucucgaacuccugaccucaggugauccgcccgccucagccucccacagugcugggauuacaggcgugagccacugugcccggccuguucugacaaacuuucauaguacagauuauuccaauaucauucaaacuuuuccaaaguauaggaaaacaagggauguuuucagcuuauuuuaugaggcuggaaaaauccucauaucaaaaccuaaaaaacagccagguguaguagcucacgccuguaaucccagcacuuugggaggcugagacgggcagauugccugagccucaggaguucgagaccagcuggggcaauguagcgagaccucaucucucuuuuuuuuuuuuuuugagacagagucucucucugucguccaggcuggagugcaguggugccaucuuagcucacugcaaccuccgccucccagguucaagcgauucucuugccucagccucccgacuagcugggacuacaggugugugccaccaagccuggcuaauuuuuuguauuuuuuuuaguagagaugggguuucaccuuguuaggcaggauggucuugaucuccugacuucaugauccaccggccacagccucccaaagugcugggauuauaggcaugagccaccacgcccagccuuuuuuuuuuuuuugagacagagucuugcucuguugccaggcuggagugcaguggcgugaucucagcucacugcaacuucugccucccagguucaagcuauuccccugccucagccucccaaguagcugggacuacaggcgcgcgccaccacacccagcuaauuuuuuguguuuuuaguagagaugggguuucacuguguuagccaggauggucucgaucucuugaccucgugauccgcccgccucggccucccaaagugcugggauuacaggcgugagcaaccgcaccuggcuuaauuaaggaucuuucuaaacacaagaaagaauauuuaucagaaaccaaagggagcaugaugcacaguggugaaacacuauucucaguaaaaacagcaaaagauaaggaugucuuuuaccauugauacuuuucugagggauccagccuaugcaaaaagaaaaagaaaugaggguacaaauauuggaaagcaagggacagaacucuuauuauuuacagauagauaggucuuccucgaagauccaagagaaacaaaacuaacaauaacaauuggaacuagcaagguuuagaaaggccauuguauacaagauaaauauuuuuagaaucugcaguuccccuaaucaguagcagcaguaaccuguuagaagauguaaugaaaguaaagaucugggccaggcacgaugucucacgccuguaauccaagcacuuugggaggccaaggugggcagaucaugaggucaagagauugagaccauccuggccaacaugaugaaaccccaucucuacuaaaaauacaaaaauuagcuggguguggugguacgcgccuguagucccagcuacucgggaagcuggggcaggagaaucgcuugaaccugggaggcggagguuguagugaaccaagauugcgccacugcacuccugggcgacagagcgagacuccgacugaaaaaaaaaaaaaaaaaaaaagaaagaucugauucauaguaguaaaacuaaauguaugcaauuugcauauacuauugguauguaugggaaaauaucuggaaacacauauacuaaaucauuaaaguagucggucauaggagacuuuuuuacuuucugugagggguuuuaccgucuuuaauauccuauaaucagggacauuuuuucuuuuucuccgugacccccugcuuuuuaaaaaauuguggugaaauacacauaacauuacauuucaaauuuaccuuuguaaccuuuguuuuuuuuuuuuuuuuuugagacagucucacucugucacccaggcuggagugcaguggugugaucacagcucacugcagccucaaccaccugggcccuagcgauccuccugccucagccuuaugaguagcugggacuacaggcacaugccaccaugcccagcuaauuuuuuuuuuuuuuuuuuuugguagagaugggcucuugccauguuucccaggcugguguugaacuccugggcucaucaacugaugagaaagagcucuccaggcagaaagaagaucauguucaaagacagaaacagaaauguguauucuugggagaaguguagaaaguucagcaucugauugggucggggaagacaagcuagucaaggccacaugauguuuuaauuagucaugccuaacaguggggcccuggaagagcaguuuaccacaaggggccaacugcuucgguuugaacccgcagcccugccacuugcucuguaaccuuaaguaaacaauuuuuacucucucuguuccuccaaugggagugauaacaauaccuucuucauagaauuaauucauacauguaaaaugcuuagaacaguaucugacacauaaaugcaaaauaauuuaacugcuuucugcugcugcugacaucacuaucaucacccucaccauuacuguaggaaauggggacccagugaagaauuuuuuuuuuuucuuuugagacagagucucacucugucacccaggccggagugcagugacgcgauuucggcccacugcaaccucugccucucagguucaagcgauucucaugucucagcuucccaaguagcugggauuacaggcaugagccaccacacugggcuaauuuuuuguauuuuuagugagauaggguuucaccauauuggccaggcuggucucaaacuccugaccucaggugauccauccaccucggccucccaaagugcugggauuacaggcauaagccacuguguccggcccuagugaggaauuuuaagcagaaaacugauaugcucaggugugagcgaggugguagguaacacuuacugugcagugcccuguagcccaagagguuagcacacaggcauuugcucaggcagcacuaggauuuucugcuguggaaaaccuuuguauuuuauccugcuccacaagauaaaaauaagugguuuaagucaauuuggauagaggcuccaacuuaccaugggagguaggaaagccaaaguuaucccaaggauguuuucaaucguacggauuaggggucugcaaacugugagcguggcccaaauccagccugcugcuuguuuuuguaaaugagguuuuuucggaacccagccacacucauuuauuuaugcauuaucuguggcugcuuuggugcugcaguggcagggcuauuuguggcagggacuguaugacccaggaaaccaaaaauauuuacccucugucccuuagagaaaaaguuugcaaccccugauauaaagcuauaaguugguuauuuguggccucaacccaggccucacugcuauuuuuucuguuuacaauaccuggcaugcucuuaagugucuagaauugguuaaagauagaagaguggauguaaucccugcuaccaagggcugucaggcuaguugggauuauaaguacacaaacacucaaagugagaaaaacacagaaaaggaugugugucauuuugucuaaggaaguugaauaagauuucucaggaaaagaaacauuugaacugaauuugaaggugagugaguucagguguguuugggcugaagcccaggccaugcugaguggauagcgggugggaagagaguguggaaacacacugcaugcagggaagaguugggagucuggggugaccaaggcacagggagggaaaguugaaguuaucaauugugugaaacagcuuucuguguuggccugagauguuuauagcuggaagcaguggggagccaauacaguuuuuuacgaagguauuagagguggguuucugugggugaucguuaaucauguuuucucccuuuaaguguaguccugcuugagaaauagacaugagaaaggaaugaagguuaaaacaucagcuguauuguugguaaaacuagaauggaaaguguggcuugagcugguaaccauaggggcuuuccaaugccugugcccugaguuagaucuugggguagagagacuggaugugcagagcagcacccccaccccaccccagccauccauauggagcuucagcugccauagaccaacaaggcagagggauaggccucuagaccugcuucuagaaaccaggcugcugcucuugcuuauggugggcccuaggaaggcaagagugagaggagggaggcaccagcuuaggugcuggguucuuugaagaucuguguguacacagagucuuucucuccaucuuaccaaucagaugagucacugucacugugggaagaaguaggggcaugggucaccuucccaaaacuucuaagaaguuuguauucugugggcuuggauagggaccaugggaaaggaagagaaugguugcccauaaaacuggcuguaguguggccucaaacuucuggacuuaaaugauccucccaccucagccucccaaguagcuagaacuacagguauaugccaccaugcccagcuaguuaaaaaaaaauuuuuuuuuuuuuuugguugagaugaggucucuuucuauguucccugggccggucucaaacucccagccucaagugauccuccugccuugguuucccaaagugcuaggauuauaggugggagcuaccaugccuagcccaagccuguaauuuuuuuuuuuuuuuuuugagauggaguuucacuuuuguugcucaggcuggagugcauggcgcagucuuggcucaccacaaccuccaccucccggguucaggcgauucuccuuccucagccucccgaguagcugggauuacaggcaugcaccaccaagcucagcuaacuuuguauuuuuaguagagauggguuucuccgugucggucaggcuggucucaaacuccugaccucagguaaucugcccaccuuggccucccaaagugcugggauuacaggcaucagccaccgcaccuggcacgaaccuguaauuuuuaaguuucauaugcuauuuauuuuuuguuauuucuuuaauucauucauucauuuauucauucgagauggggccucacuauguugacuaggcuaguuuugaacuccuggccucaagcaguccucccacuucagccuucccaagugcugauauuauaggugugagcugcuacauccagccuucuuucuucuuuuucuuuuuccaugugcuauuugacauuuuccaagguaccagccuccccuucuccccaagauaauaucuuuuaauauggaauuucaucccuagggcaggacuuuuuuuuuauuaucccucagaaauauacuggacaccacguuuaaguagacauccaacaucugcugucauaaauuguuuugaauuuuuugacauacuugcccaugagguuuuugaaggcauagaccaugucuuagcugaacauguggucucuuagugccauaaaggggguuuaugguaugaccuguguagugucaccuguguagugacagcaccacugccucuguuucccuuccucuugugauggcagcagcgucucaagccaaacaagaaggguaguuagggugggauggaagcuggguagagguauuccucuccccauaguucuguguucacaugugcauugaccuccuuuuuggcagcaagggggccaggccaaccaccccacagcagccguggugacggagaagcagcagaugcuggagcagcaccuucaggauguccggaagagagugcaggugaugcaaguuacaagccucgggcagggagcuuucauuaauuuuuuuuuuuuuuuuugagacagggucuugcucugccacucaggcugggcugcaguggcaugaucacagcucacugcagccucgaccucucaggcccaagcgauccuccuaccucauccucccaaguagccgggaccacaggcaugcaccaccacgcccagcuaauuaaaaaaaaaaaauuuguagagaugggggucucccuguguuguccaggcugaucaugaacuccugggcucaagugauccucccaacucagccucucaaagugcuggcauuacaggcgugagccacugcaccuggccaacagggagccuucucuuggggauacugccugcagguccugcauguaucuuuuuugagguuuuggcuucauuugaauucuccucagaaacuuuauauuuucuguucccaaggaaaucuuucuuuacuucuguuuuuuuguuugcuuauuuuaaacaggaucuagaacagaaaaugaaagugguagagaaucuccaggaugacuuugauuucaacuauaaaacccucaagagucaaggaggcaagugaauauuagagauguuaaaaucucuagaaagugaguuuguguuguugaguugaaagacucauuugucuuaacucuguuuagaucuuaaggcgggcggggcgcaagggagguacggguccucaaaggagccuggucauuaaggacaggaguauucccucagguccaggaguauucccucagguccaggaguauucccucaggucaaggaguauucccucaggucaaggaguauucccucagguccaggaguauucccucagguccaggaguauucccucagguccaggaguauucccucagguccaggaguauucccucagguccaggaguauucccucaggucaaggaguauucccucagguccaggaguauucccucagguccaggaguauucccucagguccaggaguauucccucagguccaggaguauucccucagguccaggaguauucccucaggucaaggaguauucccucagguccaggaguauucccucagguccaggaguauucccucagguccaggaguauucccucaggucaaggaguauucccucagguccaggaguauucccucagguccaggaguauucccucagguccaggaguauucccucagguccaggaguauucccucagguccaggaguauucccucagguccaggaguauucccucagguccaggaguauucccucagguccaggaguauucccucaggucaaggaguauucccucagguccaggaguauucccucagguccaggaguauucccucagguccaggaguauucccucaggucaaggaguauucccucaggucaaggaguauucccucaggucaaggaguuuuuucuuccuucgcagacaugcaagaucugaauggaaacaaccagucagugaccaggcagaagaugcagcagcuggaacagaugcucacugcgcuggaccagaugcggagaguaagggcauaggucggaccacuucccccaugugucucgcucacuugcgggauuucagcgucuuguggcagaacuugcuugguuucuaagaaguuccugcucuggaguugacuaaagaaugugguuagagacagucugaggaaauguuuucugacuuuguuuugguuuccaaccagagcaucgugagugagcuggcggggcuuuugucagcgauggaguacgugcagaaaacucucacggacgaggagcuggcugacuggaagaggcggcaacagauugccugcauuggaggcccgcccaacaucugccuagaucggcuagaaaacugguaaaggaugaaagaagcuuuuccuuucuuucucgaaagcuagauugaauucugaucuuaacugcaggcccacagaauugguacuauaucuccaacguggggacuuuuccauauucaaauuuagcccaagaauuaaaguuuuuacuuuauuucggccaggcgcuguggcucacaccuguaaucccagcacuuugggagaccaagaugggcggaucacuugaggucaggaguuugagaccagccuggccaacauggugaaaacacaucucuacuaaaaacauaaaaaaauuagccgggcgugguggugcgcaccuguagucccagcuacucugggcggcugaggcaggagaaucacuugaaccugggauauggaaguugcagugagcggagaucuuacuaccgcacaccaaccagccugggagacagagugagacuccaucucaaaaaaauaaaaauaaaauaaaguuuuuacuuuauuuggagaaacuuuguuuuaaaaaauguauuuauauuauuauauuuuaaguauauuuuacuuaauaauucaauuaaggcuuuugguuuaacuguauuuaacagauagacaaaccuuuuaauuuuaguuauuuuaguaaucuaaaaugacacaugcccuuuuuaagggaaaaaauucaaauacagaaaauuaaucaagagaagaaaaaauuuuuaaaugaaaucaucagcaguacuaguaguuaaaauuuaguugaugcucaaucuagacaucugucauuauguauauacacauuauguauauacacauaaagauagaaauuuauacaguuuauauuaggaucauuuuuuuuucuuuuuuuggagucagggucucacuguguuacccagucuagaguacaguuaugcagucauggcucacuggagccuugaccuccugggcucaggcagucuucccaccuuagccuucucaguagcugggacuacaggcaugcaccaccacaccuggcuaauuuuuaaauuuuuuauagagacagggucuuacuuuguugccugggcuggucucaaauuccugggcucaagggaucaucccacuucggccucucaaaagcucuggaauuauagaugugagcugccgugcccagcccaggaucuuccuuuauaugcuuuucuguaauuugcacuuuuaccuucauccagcauaucuuacugcaacccuuccugugcaaggcccuauagugagcauguugcaccagcuugccuuaggagaaacuugagauacagagccugcacuggaaauuuagcgcaacucuacaugagaaugccugucuauucauauccucacuaacccugaguguuguuaauuuacugaaagcaguuuuaaaugcuuccugaccagggaacgaagaagcuuaaguucugggaaugggaggauagaagugccagaaaagagcucaggaguucagaaaucccugcagcggucccccucccucuccuuucacuuucugucuuucuggucuuuuggucuuuguuacacuagugauaaaccaucaaagaaugauggaaugaugcuaacuucucucuuuuuuuaauuuuuuugagacagagucucacucugucacccagguuagagugcaguggcaugaucuuggcuuacugcaaccuccuccucccagguucaagcgauucuuagucacaaccuuccaaguagcugggauuacaggcccaugccaccaugccuggcuauuuuuuuguauuuuaguagaucgaccugccucggccucucaaauuuuugggauuacaggugucagccacugcaccuggccuaauaucucuauucuuggagauagauuuaaugagcuuuuucucccucucuauucacuuauuccuugugcauguuaucaauauuuugaaacauaaugucauguccuuugaucaguugaaggcugacauugaaaaggcuuauggggauuggguguuguggcucacgccuguaaaucccaaugcuuugggaggcagagucgggaggaucacuugaacccaggaguuugagaccagccugggcaacaaagugagaucccaucccuacaaaaauuuaaaaaacuagacaugugccauuacacuucagccugggugacagagugagacuccaucucaaaaaacuaaacuaaacuaaacaggcaugguggcacacaccuauaguucuagcuacucaggaagcugagguaggaggaucacucauguccaggaguuggaggaggcagugagcuaugaucaugccauugcacugcacuaggccacagagugggacccugucucaaaaaaaaaaaaagaaagaaagaaaagaaagggcucauguaguucaagcccuucucuucaugcaaggggaugcuaaggcccaugauggugaagggccuggcaaagcuugcacagauagugugugacagagcuggcucaaacccaucuuugggagcugucuaaucucuuuuucugagucuuuauguucauagacaaguuaggaugaguaaaguaagugcuaaauuccauauuucguguucugcauaucugggcucagaugcuugucauuuuccagugauaacuccaucaaugccuccuagugguauaaauuuuaauacuucuugugugcccagcccccucuuagaaauuugagauuuuaggaagggacuaguaauaaaagguaaaauaaauuauuuucuggccaggcaugguggcucacaccuguaaugccaguacuucgggaggucgaggcagauggaucaccugaggucaggaguucaagaccagccuggccaacaaggcaaaaucccaucucuacuaaaaaugcaaaaauuauccgggagugguggugggugccuguaaucccagcuacuugggaggcugaggcaggagaaucacuugaacuugggaggcggagguugcagugagcugagacugugccacugcacuccagccugggcaacagaguaagacucuaucucaaaaaaaaaaaaaaaaaaaaaaaggccaggcgcaguggcuuacaccuguaaucucucaggaggcucaggcaggagaaucacuugaacccgggaaauggagguugcagugagccgagauugcaccacugcacuccagcucaaaaaauaaauaaauaaauaaauuauuuucuuuuuuuauuuauuuuuucagcauccacccaacauggugaaaaauuccucuuuucuuaaugucacugaacuguaaacuuaagaugaaaaauuguaaauuucaugcuauauauauuucaccacaauaaaaaaauuccuuguucuuauuguaguggucuccaugucuucaguauuuccuuccccuucuccaucucaccuguauacauucacuuugguaauuagcaucuuucuuaauuuauuggcaggauaacgucauuagcagaaucucaacuucagacccgucaacaaauuaagaaacuggaggaguugcagcaaaaaguuuccuacaaaggggaccccauuguacagcaccggccgaugcuggaggagagaaucguggagcuguuuagaaacuuaaugaaaagguaauuuagcauccuugucccuuucccucaucuaaaaaauaccuaaagacucacgugguagagugagaggcgggcugacuucuggucauggccguggcgcgugagcccaucuucucuuuccucagugccuuugugguggagcggcagcccugcaugcccaugcauccugaccggccccucgucaucaagaccggcguccaguucacuacuaaagucagguaggccaugccacuuccauuuccaguagagauuuuacugagggacacuguuagggugaggguagaguugguggccagggucauucuuuccagguguggugucacaggcaguacacuguugcgggguugaaauuuguugccauacuaucugcuugcucucugauucugaugucaaaagcaaaagagcagucaucuuuuugaagguaccugggcauauuccuaugauuguagaccuggagucucaggccacagcuucuccuucugcccaagggacaaaauaaugucaucuauuuucuguucuuugaggcuacucuucccuguggauuuuaagggaaagaguaaggcuuagugauggggaagcugagaggccccagggcagguggguggugggccuguagggugagguguuacuuucacacucaagucagaacaggugugcugggguuuugaccuucugcagcaaaauuucccuccucagaaacuuaguaugguguucgguuucaggauuaauagaacaaaaugccagcugcacagcauguguuccuguaauauuuuucauuauauggcuuugauuauccuuuugugaaucucucacaacuuuaaguuguuaguucuuagauguuuucucaguaccuuuggcuugaaggagugauacucaucuuuuguuuuuguuugagacagggucucacucucacccaggcuggugugcaguggcaugaucucagcucacugcaaccuccaucucccagguucaagugauucuugugccucagccuccugaguaacugggaauagaggugcgugccaccacacccggcuaauuuuuuuuuuuuugagacagagucucgcucuuucggccaggccagagugcguguugcaaucucaacucacugcaaccuccaccucccagguucaagcgauucuccugccuuagccucccugaguagcuggaccggcacacuccaccaugcccggcuaauuuuuguauuuuuaguagagacaggguuucuccauguuggccaggcuggucucaaaacuccugaccucaguaauccacccaccccggccuccaaaagugcugggauuacagaugugagccaccacgcucggccuuuuuuuuuuuuuuuuuuuuuuugagauggagucuuucucuaucacccaggcuagagugcugaggugugaucucggaucacugcagccucugccuccuggguucaagugauucuccugccucagccucccaaguagcugggauuacagguaccugccaccaugcccggcugauuuuuguauuuuuaguagagacgggguuucaccaucuuggccaggcuggucucgaacuccugaccuugugauccaccugccuuggccucccaaagugcugggauuacaggugugagucaccgcacccagcccuauuuuaauuuuuuuaaagagagagauaggggccaggcacgguggcucucgccuguaaucccagcacuuugggaggccaagguggguggaucaccugaggucgggaguucgagaccauccugaccaacauggagaaacucugucucuacuaaaaauacaaaauuagcugagcgugguggcgcgcgccuguaaucccagcuacuugagaggcugaggcaggagaaucacuugaacccaggaggcggagguugcggugaacggagauugcgccauugcacuccagccuggguaacgagagaaacugucucaaaaaaaaaaaaagagaaagagagauaggaucucgcucugucaucuaggcuagagugcaguggcaugaucauagaucacuguagccuugaacuccugggcacaagugauccucuugccucagccucccgaguaacugcgacuacagguacaugcuaccacaccccgcuaauuuuuaaauuuuuuauagaugugggcucucacuuuguugcccagacuguuauggaacuccugggcucaagggauccucccagcuuggccucccacagugcugagauuauagaugugagccuguaauuauagacagcuuggccuauuuaccuguuggaaaugaagaauuaugaauuuuacauuucuucaagaaaagguuaugggagaguuacugacuuuuuuuccuuggauuuuuucuuuuuaaauagguugcuggucaaauucccugaguugaauuaucagcuuaaaauuaaagugugcauugacaaguaaguacuccuaucuuagcucuguuuuucaaaugaggaauagaaaaaugagaacuuugacagacaucauuugaacuagagacucugucuuuauucagagaucuucauuuuguggacaaaaguuuucaaaagccuuggggugcauugucauuuacgugucugaacaaagccacaaagcuggggguacagauuugauuugugguugcuauugugacaaccagucccucuuuuccuuguuuaguuuuuuacuuguacaugucauucaugcauauuauauauaagacugagaucauguguuaauuaacgacugggauacguucugcaaaauguaucauuaggcaauuuuguugugcaaauguuguagaguauauaguccuuacacaaaccuggguggcagaaccuacugcacaccuacgcuauguggcagagccuacuggucguaggcuguaaaccuguacaguauguuacugugcugaauaccguaggcaauuguaacacaucucaaugaaguaggaauuuuucagcuccaugauaaucuuaugggaccaccaucauauaugcauuuuguuguugaccgaaacgucguuauauauucuuuccauacauagcauguggaaagaauagaucucuuuuuuuuaauuguuccacacuuuaccauauaauggaauacgcaaaauuucacaauaccuuucaggauguaaaauacauauacccuuugacgacauuagaaaagagaaaaugugggccgggcgcgguggcucaugccuguaaucccagcacuuugggaggccgaggcgggcggaucacgaggucaggagaucgagaccauccuggguaacacggugaaaccccgucucuacuaaaaauacaaaaaaacuagcugggcgugguggcgggcaccuguagucccagcuacucaggaggcugaggcaggagaauggcaugaaccugggagguggaguuugcagugagccaagaucacaccacugcacuccagccugggcgacagagacuccaucucaaaaaaaaaaaaaaagaaaagaaaagagaaaauguggcugggcgcgguggcucacgccuguaaucucagcacuuugggaggcugaggugggcagaucaccugaggucgagaguucgaaaccagcccgaccaacauggagaaaccuugucucuacuaaaaauacaaaauuagccagguguguuggcgcaugcccguaaucccagcuacacgggaggcugaggcaggagaaucacuugaacucaggagguggagguuguggugagccgagaucacaccauugcacuccagccugggcaacaagagcgaaacuaucucaaaaaaaaaaaaagaaaaaagaaaagauaaaaugcauucuuauuuuuaguugauguaauuauguggaaauuucaugaggaugcacuggaaaauaaugaaauaagggaguugacgaaggugguagguuuaauaaguacauaugcaauaugaaacauagguuccccuuccuauggggaggcaaccaacugugccugcuacgcagagguguuauguugcgcugaucaacuguaacugaauaguuuaaagaaaugcccaggagcacagagguuuuuucaugacaguaaauaacagguggucaaaguaggcuuuuugaagaaacacagagccuauuuuauuaacaacagucuguguucuuacagagacucuggggacguugcagcucucagaggguaaguucagccuagaggcuuccuuuuguuccguuuaaccuaacuucauccuccggcuacuuggucaccuacauaguugauuguuccccugugauucagaucccggaaauuuaacauucugggcacaaacacaaaagugaugaacauggaagaauccaacaacggcagccucucugcagaauucaaacacuugguaugugggaggagcuccccuucacaaagggccucuggcugccggagagggcuagggagagccucacaggacaccugccuuuuucuuuucuuacagacccugagggagcagagaugugggaaugggggccgagccaauugugauguaaguuuuguuggggaugaaagacaacugggguguuuuccuugagggagagagggguaaagauccuucuuaauccccagaauuagaaacaucaaccuguucuuucagcuguaguuauuccaaaaagucacuucaggccaaagugacaugaacagaaguuccaugugccauggagcucucuggcuuggaacauuuccgugaauaucugggaguuggcuccuccuuaaggagaaguggaaagucccuugcugaguuguucuccacacccaugugguauaaagcagcuuuccaccuugccuggggcuuuccaaauuccccauccagcuccugcggcugacccugcuuggcuccauuuuuagugcccuguuuuucucucccacugaggugggauagaggguguaaaagcaacagauuugaguuaaacuuuaaaauaaaugaccaccuugcauuagcuugcuuaggaaaagaguacauaaaauaaaaugaacaaacaaaaacccaucuuguucuuuaucccccuuauuuucugcuuuucauugauucagauuauuggauucuuauugucaagaauaaacuuuaaacaaacaaacaaaaaaagguaaaugugacggaaggcuaguuuucagucauuuuuaaaaauugugaugccccguucuuuuucuuacauuuguccccugaacaauucuuccucuuuaaaauguagcaguccuagcugggcgugcuggcucacaccccguacuuugggaugccaaggcaggcuggucacuugaggucaggaguucaagaccagccuggccaacauggugaaagcccgucucuacuaaagauacaaaaauuagcugggugugguggugcacgccuguagucccaguuacuggggaggcugaggcaugagaaucgcuugaaccugagagguggagcuugcagugagccaagauuuugccacugcacucuagccugggcaacagagugaaacucugucucaaaaaaauaaauaaaauaaaauguagcaguccuuuuuaaaaauguggaauuuuacuugacaguagagugaaguagccuguaugcaaugauaugggaaaauguacaugacauauuaagaaaaagcaaaauguaaaauaauuugaauaguauuauuaguauauguguuuuaaaaauacacuauacucuuauguguauucauauguauauuaagaaauucuggaggaauauaccagcagugcuauguguauuagugcugcuguugguauccauggcuauucuagacugucucugugauauuugcauuuuaaacugaauauauuacuuuuauaaucagaaaaauaguauuaaaaaugaauuauaauuuaauuucuuuuuucuuuuuuuuuuuugagucggagucucguucuaucggauugcaguggugcgaucucagcucacugcaaccucugccuccuagguucaagcgauucuccugucucagccucccaaguagcugggacgauaggugcaugccaccacgccuggcuaauuuuugcauuuuuaguagagacaggguuucaccauauuggucaggcuggucuugaacuccugaccucgugauccacccaucucggccuccgaaagugcugggauuacaggcaugagccgcugugcccagacuagaauucaauuuuugagaauucauugacaacucuuacuuaaaauaagguugcuguacugaugugagacauuguuguagucaguuuggaaaacaauuuggcaguauaaaaaugaacauaccuguaaaccaacggugccauucccaggauuuaauagcagagaaaucuuugcauauaugucccaggagacauauauaaaguggacaucagccugauuauaagcucuaaaugcaacccaaauaaauacccaucaacauuagaaugaauacauuauuugugguauagacacaauggaauacuccgcagcugugaaaaggaauacacugcagauacacauaaccauguggauucauuucacaucaagugaaaagugaaucccaaaagaauucauuggaguccauaaguguaagguucacaaaugucccaaacuaaacaauaccugcauugcuuagauaaacaaauaugguaaaacuguaaaaaaacaaaacaaaacaagacaaaaagggcuaggaaaugauaaacccaaaagacaaaauagcaguuauuucugagggaggagggaaggggaugggguuggggaagggcacccagagaauuuuaggagugauggacuuuuccuuaaauugaaugguggguucauauuguuuuguuauucuuugugccuuacguauuuuacaaauaaccaauuggaucuauguaauauuauaauacaaacugaguaaaggauuagguugaggaucacagcauuggaaguucuugguguugaagagaguaagugccgagcaaguugugucccuggcaguuuguuugugaccaccugguggcuuacccuucuugguguggugaggcuuggcaugucacuuuccuuggcuguggcuguuaguacugaaugccauucucucugaggaaaaguguccuucucuuuuuuauugauugacugauugauugagacagagucucacucugucacccaggcuggagugcaguggcgugaucucggcucacugcauccucugccuccuggguucaagcgauucuccugccucagccuccugaguagcugggacuacaggcgcccacuaccacacccagcuaauuuuuguauucuuaguagaaacgggguuucaccaaauuauuggccaggcuggucucgaacuccugaccaugugauccaccugccucggccucccaaaaugcugggauuguaggugugagccaucacgcucagccuuuuuuuuuauuuaauuuaauuuuuuuuuaagacagggucucacucugucaccccagcuagagugcaguggcacaaucauagcucgcugcagccuccaucuccuaggcucaagccauccucccaccucagccucucgaguagcuggggcuauaggugugcaccaccacacccagcuaauuuuuguauuuuuugcagagauggaguuuugcugugcugcuuagacuggucucgaacuccugggcucaggcaauccuccugccuuggccucccaaagugcugggauuacaggcaugagccaccacaccuggccuaagaguguccuucucguuacuguaggcuucccugauugugacugaggagcugcaccugaucaccuuugagaccgagguguaucaccaaggccucaagauugaccuagagguaaguucugcagcagaaucggugagaggcuacguacaggggugacucaggacaaaaacuuccacugggauuuuuacaagagaagguggaaugauuacuguuugcuuaacacuguguuuauuuuugcuuacuuuucuccaaaaaaauccuuggcaucccaucuggcaauaaagucuugcuugaaugcuuagaagauguguguauauucagcuuucagcaaacuugauaugaaaaucucuauuuagaaauugauuggccgggcgcgguggcucacgccuguaaucccagcacuuugggaggcugaggcggguggaucacgaggucaggaguucgagaccagccuggccaacaugacgaaaccccgucucuacuaaaauacaaaaauuagcuggguaugguggcggacgccuauaaucccagcuacucgggaggcugaggcaggagaaucacuugaaccugggaggcagagguugcagugagcugagauugugccauugcacuccagccugggugacagagugagacuccgucucaaaaaaaaaaaaaagaaauuagaacugacuuuauaaaguuugggcauaagagucuuagcagccaguguguuuaguauacagaaaauuguggcaaugacauucuccuuucccaacuuucuugauuuuuaaauuaagauauaccuagaaaagcaggaauccuggucuuugauuccugagaccucccuguuucaugugaagauacagcuucaagucuuggagaaugccuccaaggucuuaaaaauggggaaucuguggauugugagucaagcuuugagcaagucagguuuuacaagggaccgguauauuccgacugcagccugaguuguguggccacgcugggcauucuuuccacuaugagugcucacugagcugacucacucacacuccucgccuagaguuggcagcaggugugguuuauggcauguccuuucauucugagccccgugagaugcgggugaagagauuuccaaggcugugagagccccucugccuccccagcucaguccccacucccuccgcagacccacuccuugccaguuguggugaucuccaacaucugucagaugccaaaugccugggcguccauccugugguacaacaugcugaccaacaaucccaagguuagugcccccuccuuuuaguuggugccccgggaucucuugcgacuuagggguaccuaguauagacaaugagcaccaucccucaucuaaacaagcaaauguguucuuuccaauagaauguaaacuuuuuuaccaagcccccaauuggaaccugggaucaaguggccgagguccugagcuggcaguucuccuccaccaccaagcgaggacugagcaucgagcagcugacuacacuggcagagaaacucuuggguccgcauuucaccccuucucccucccgcccacccgcccagaaaagggauccggcccauagggcuguucauuugggccaugucuacugagcauuaggccauguuucuuuccugagcaaggcgcugugcuggugccaggaaacaggggaguuggggaguuggggugcagagacaguuugcaguuuucagucgaggugaucauuuuugaggugggagguagauuucuuuucuccugguugcugucucauucacccacucuaucuaacuuuagaagaucuuuuaaguguguguuggaagguggcacuaaaggcuugacauucccuguccauuuuuuuaauaaacuauaggcuaguugguuuuuuuugucuuauuuuauuuauuuauuuauuuuuuugagacgagucuugcucuguugcccaggcuggagugcaguagugugaucucggcucacugcaaccuccgccuucuggguucaagcgauucuucugccucggccucccgaguagcugagacuacaggugcucaccaccacgcccagcuaauuuuuguauuuuuaguagagacgggguuuuaccauguuggccaggauagucuccgucucuucaccucgugauccgcccaccucggccuccuaaagugcugggauuacaggcuugagccacugugcccagcguaggcuaguuuuuaaaaaagaauuaguggaauauuuuaugugccaccugggcuagaaguagcuuuguucuaauaaagcuguugccaccaaauacaccugucugacacccgaugucagcuuguuagugagugcugcuguugguucccagccuaccacccgagguugggaagagcagggggacuuguuauaucacccuccaucccugcugggcuacccagcaacacaagugagucaaaugaugggauaguguuuguccucaugugcacacacacaacagugccuaccuucaaagaugugaaagcugauuauuuuguggcccauugugggaugaauguguguguguucuguuuuaagaaauaaccucuugaccccaagcugaaaauguacuacuugacucuuuuucuuuccuucaggaccuggugugaauuauucagggugucagaucacaugggcuaaauuuugcaaaguaagcaaucuuguuaaauucucgugggaaugggaaugcucaccugcacggcugucguugagggcucuggcuugaaggcccugaacucuugguccagcggccaguaggaccugccugaagguagacgggccugaggauuugggugaugcacugcaccccuaggaagggaagggcugggauggcaguagacuuggcuuucccauuacucuuuucuccaggaaaacauggcuggcaagggcuucuccuucugggucuggcuggacaauaucauugaccuugugaaaaaguacauccuggcccuuuggaacgaaggguagguuggacagagugugcacagauguaaccaaguccccugcucucagcaagccaguggcaggggauggaugcccuguuagcaauaacaacauuguuccuccuccuuggcuccagguacaucaugggcuuuaucaguaaggagcgggagcgggccaucuugagcacuaagccuccaggcaccuuccugcuaagauucagugaaagcagcaaagaaggaggcgucacuuucacuuggguggagaaggacaucagcgguaagggaggcucccacccaccccaccugcugguggcugcugaggccucaucacugcuucuaguugcaagcaccuacugcccccugguggguggagauggccuugacucccuguuucacucagacucgcaaaacacauuugcgugacuucuaaauccuuccagcugaaggauugguuugcuuuguuuugcuugcuccagugacuauuuguugagaauuuugcaauuuaaauuguauucuucaucucuuuuucuacuuaacccuguuaauauaucuuacgcaaguaguuauauucaaguuuauuuucuaugacccaacuaguagccucuucuuaauuagaagccagccugaauauuuccacagugccaggccacugaacaggguguucagggucucaacacuaggguggcuuaagucuuuuccccuucgaggaaagaaaaaaugggcaguuuucucugagaugaccuagcuguagguuccaugaucuuuccuucccauguccugugacagguaagacccagauccaguccguggaaccauacacaaagcagcagcugaacaacaugucauuugcugaaaucaucaugggcuauaagaucauggaugcuaccaauauccuggugucuccacuggucuaucucuauccugacauucccaaggaggaggcauucggaaaguauugucggccagagagccaggagcauccugaagcugacccagguaguuguugauuuuccauguuccuggcauuuaauuuuugggaaaaguuggaaauuuugggauccuuggaggauagauaggcaaaugccugaauaaccugggggauaauuauuucuccuuaugggaaagaauuguagugagugcuuuuguuggggugaccgaugggauuugagaggagaaucagaaucacuuagaguaguguaguuccugcuccacagagagugcaugagucuaaagaggggauacagccugggcaauauggugaaaccucgucucuacaaaaaauccaaaaaaauuacccggugugguggcacgcauuuguagucguagcuacuugggaggcugaggugggaggaucaccugagccaaggaguucaaggcuguagugagcggugaucaugccaccgcacuccagccuggcugauagagugagauacugugucaaaaaauaaaaauaaagaggggaucaauacacauacgucccccaaaacaugccugaaacacgagaagggaaagugagggcaguuaacaggaugcccugcuggcacagugcuucuuaguagaugcuagaagguuugaggcccagauuucagcccagcauauggcuuuuugccuguaacugaaccaugucagugugccagauggucugaagaaaggguuucuggaggaaauuauuauuagcugcaugggaguaugguuuacacuagaguagaagagcugggagcaucacguuugaaggggaagacagugacuggguggaggggcaagggauuaguauuuagagugugcaacuauugaaaauaagguauauuuuaauguguaagaggacauguacuuauauguuauauauaaauuauuuuagcugggugaaguggcucaugccuauaguccuagcacuuugggaggcccaggcgggaggaucacuugagccugggaguuugagaacagccuagacaacauagugagacccuaucuauacaaaaauaauuuuuuuuaaauuagccacguguggugguuugugccuguaguccuagcuacucgggaggcugaggugggaggauugcuuaagcccaggagguugaggcugcagugagccaugaucgcaccacugcacuccagccugggugacagagcaagaccuugacucaccaaaaaaaaaaaaaaaaaaaagagagagaaauuaaaaauacuguaaucucagcugggcauggggguucacaccugcaguccuagcacuuugggaggcugaagcaggaggaucacuugaggccaggaacucaagaccagccuggcaacauagcaagaccccacuacacacacacacacacacacacacaaagaagagaaagaaaaaaacgaaacaaaacuguaaucucugcagcuguccucaguguggaggggguagcccugucuguuccccuucagcacuugcuguuuugacucucuggguucuuugugcaggucuugauggggagucucugguuugccauucuuuguuugauuuaacuuucuguaaucauaaagccaaugaugggcuuuuuuuuuuuuuuuuuuuuuagacuaagucuugcucuaucacccaagcuggagugcaguggcaccaucucggcucacugcaaccuccaccucccgguucaagcaauucuccugccucagccucccgaguagcugggauuaugggcuugugccaccaugcccagcugauuuuuguauuuuuuguagagaaaggguuucgccauguuggccaggcuggccucgaacuccugaccucaggugaucugcccacuucagccucccaaagugcugggauuacaggcgugagccacugugccuggccuaaugaugggcucuuuaaugugauccuuuaggguuggcgccuugcccuaguugcuguugaaaaaacuauuuuuguccaaauagcacacacacagaaaccuaccaacuucccucccacuuuuuccuaggaauuccuucugagggauuucuugagauggggcagaauggggcuuggaagagggaguuggagcuaauugaccguugccuuucuccuuuguugggguccugagucuuguuccugcuguaagaguuacucacuuccugucugccaccuaucucccuuugcaugugugcuucaguugggagaucuguuuaucagccccugccacacggcucuuuguuccuucugcagaggacguuggggucccacggcugguccuuuugacucauuuugcuuucaaggucccaccucccagucugaggcugcauccuccauuaccaucgcccuuccugugggcugggaggccagguccuuuccugcccagcgaugucagcguuuccucaggggccaggcacucaucaggagaaaggaacuaauuacuugaguaauuugccuugccuugcugagaggagugugcccugagggacuccaugugaguguggugacgggugugggggugucccuguguuauuuuaaaaugggugccuucaggacgaugagcaugugaccauuuccucucuauuuccaucacaagaguauuaugguaugagggucucagguuagauuauccucccaagacucuucucucuuccuucucuacuggaagcccacauagcauuuccuuauggcuugagggagagguucggagccacuuacaaauuagauaaaguacauuuacaaucuuguacaaagccacacaaugaagucauuuuucucagcuuuuuuuuuuuuuuuuuuuuuuuuuuugagccugagucucgcucuaucguccagacuggagugcaguggcgcgaucuugcuucacugaaaccucugccucccagguucaagagauucucauaccucagccuccugaguagcugggauuacagacaugcaccacuaugccuggcuaauuuuuggauuuuuaguagagaccggguuucacccuguuggccaggcuggucucgaaccccugaccucaagugaucuucccgccugggccucccaaagugcugggauuauaggugugagccacagugcccagccuuguuuuuguuuuuguuuuguuuugacagucugucacucugucacccaggcuggagugcaguggugcgaucucaccucacuucagccucugccucccagguucaagugauucuccugucucagccuccugaguagcugggauuacaggcgugccaccacgcccagcuauuuuuguaauuucauuaaagacaggguuuccccauguuggugaggcuggucuugaacuccuggccucaagugauccaccugcuucagccucccaaagugcagggauuacaggcaugagccacugugccuggccucagcuaucuugaaugcuggagaauuaaauccuuuucugucuagggugucagcucccuaagggcugggccaaaacaguuggauuuauaagacacuagagucuugccucaguagcuccuuugaauucugcacugaauugaucaguuucuuggcccaaaguaaacucagauggcagcccaagagccacucugcagugccuucuuucacauggucaucaugcucucugaucccucagguucugucuaagccucauguuuuaugaccgugcuguucucagcccaccucacccugccccaugccuucucaaugguuuguucaccugaauuccccagauuucaugccaguauccccaagguuccuugaccucuugguguaagcauucagcaucuaaaauucauuuuauucccgucaacgcauuucuaacuguagaacaagaauuauaaaugacaaagcucauagaaaauuggcaccuugucuucccccucccucuuauuuuauacauaaaagagaauaugggcugggcauuguggccaaggcugggcaugauagcucauacuuguaauccagcacuuugggagggugaggcagauggaucaccugaggucaggaguucaagaccagccuggccaacauggugaaaccucaucucuacuaaaauuacaaaaaaaaaauuagcuaggcaugguggcagaugccuguaauccagcuacucaggaggcugaugaaggagaaucacuugaacccuggaggcagagguuguagagagccaagauggcgcuacugcacuccaaccugggcgaaagagagcaagacuccgucucaaaaaaaaaaaagacaaaaauuagccaggcaugguggugccaccuguagucccagcugcuugggagccuaaggcaggagaaucguuuugaccugggaguaggagguugcgguaaccgagauugugccacugcacuugagccugggcaacagagugagacucugucucaaaacaauaagaacaacagcaacaaaagagagagaccaugccuugcuccaggucucuuagcuauugaagauguaccuggacccaggucuccggucuucuaguugaagcaauuguacugccuuacaaagucacauucucuuuggugcuuuuugauugacguauuuauccaacuagaaaguuacucaugcccucauccaaaaaugugguagaggccagauuagugcugguaggaauaagagauauaaccuuuggcuuuggaaccacaagcauuagcagucuccauguucuuuaaagacuuggugauauugguauuuaggcuggacaccaugcaaagacuacacaggcucgguuccugcaugcagagaaguuaucuaagagauaugaccaggccggaauagaaugcucagaccacguggaggcuguuaaacuuuuacauaaucuagggaaagaagggacacaagguggcauuagucuagggucaggugggaaaagguuaugcugaaaagucucugcagcucaggacagcuuugugcaaagaacugaaguucacagcugcuagugccugggagaucaaauaguauaaaugagggcagacaacccugaggggcagauggagcuuuccagacaaucuuggcaugaggaugagugaguuucaaaucaguccugccgaggcagauggcuuccuccagcucugcuuacugaaugcgaagucacagucaguaagaaaacugguuuucuucuucccaggcgcugccccauaccugaagaccaaguuuaucugugugacaccguaaguggcuuccuuuccccguuuugccuucauuucuaauauccucaguuaucccugggaaugggacacugggugagaguuaaucugccaaagguuggaagccccugggcuauguuuaguacucaaagugaccuuguguguuuaaaaagcuugagcuuuuauuuuucuguuggagaccagaguuugauggcuuguguguguguguuuuguucuuuuuuuuuuuuccauugugucuugucaaccccccguuuccccuccugcugccccccauuuccuacagaacgaccugcagcaauaccauugaccugccgauguccccccgcacuuuagauucauugaugcaguuuggaaauaauggugaaggugcugaacccucagcaggagggcaguuuggugaguauuugguugacagacuuugucccuauaagggaaguugguccccuuugugugaugcucucacauguacacaccgagagcuggucacucggaaugguaggagauucuagagcuuugcuuuccaaaagagaugguaugaaugccacaugugugaguauaaaucuucuagcagccacacuggaaauagacgaacuuaauuuuuacaauauauuuuauuuaacccacuaaauccaacauacucucaauuuaacauuucagaaaaaguugaggcugggugaguggcucaugccuguaaucccagcacuuugggaggccgagguggguggaucacuugaggucaggaguucgagaccagucugaccaaaaucucuaaaauauaaaaauuagcugggcaugguggcgcauaccuguaaucccagcuacucaagaagcugaggugggaggaucgcuugagccugggagguggagguugcagugagcagagaucgugccacugcacuccagccugggcgacagagugagacuccaucucaaauaaacaaaacuaaacuaaaaagaaaaaguugagaccuuuuuuuauucuuuuuuuucauacuaagccuuuaaaauccagugggcuuuugacagccacagcacagcucaguuuggacaaaccaaaucucaaaugcuugguggccacgugugucucggggcuccugaauuaaacaguagaucaagggcagaagaucucaggacagccuuagagcuucuguaaacauggagcucugggaaucaguuaaggugggaaugagaaaggacccuucccgaggcaggguccuccagggaggaggguaaaucuggcuuuucugaccaucccugggccuuaaggggcaggagauuggauagcagugguagccugggcccuguccucugaagggcugggggcguggccugccaguugcagaggguggacaacugaacuaguuuucccugucugucccuccagagucccucaccuuugacauggaguugaccucggagugcgcuaccucccccaugugaggagcugagaacggaagcugcagaaagauacgacugaggcgccuaccugcauucugccaccccucacacagccaaaccccagaucaucugaaacuacuaacuuugugguuccagauuuuuuuuaaucuccuacuucugcuaucuuugagcaaucugggcacuuuuaaaaauagagaaaugagugaaugugggugaucugcuuuuaucuaaaugcaaauaaggauguguucucugagacccaugaucaggggauguggcgggggguggcuagagggagaaaaaggaaaugucuuguguuguuuuguuccccugcccuccuuucucagcagcuuuuuguuauuguuguuguuguucuuagacaagugccuccuggugccugcggcauccuucugccuguuucuguaagcaaaugccacaggccaccuauagcuacauacuccuggcauugcacuuuuuaaccuugcugacauccaaauagaagauaggacuaucuaagcccuagguuucuuuuuaaauuaagaaauaauaacaauuaaagggcaaaaaacacuguaucagcauagccuuucuguauuuaagaaacuuaagcagccgggcaugguggcucacgccuguaaucccagcacuuugggaggccgaggcggaucauaaggucaggagaucaagaccauccuggcuaacacggugaaaccccgucucuacuaaaaguacaaaaaauuagcugggugugguggugggcgccuguagucccagcuacucgggaggcugaggcaggagaaucgcuugaaccugagaggcggagguugcagugagccaaaauugcaccacugcacacugcacuccauccugggcgacagucugagacucugucucaaaaaaaaaaaaaaaaaaaagaaacuucaguuaacagccuccuuggugcuuuaagcauucagcuuccuucaggcugguaauuuauauaaucccugaaacgggcuucaggucaaacccuuaagacaucugaagcugcaaccuggccuuugguguugaaauaggaagguuuaaggagaaucuaagcauuuuagacuuuuuuuuauaaauagacuuauuuuccuuuguaauguauuggccuuuuagugaguaaggcugggcagagggugcuuacaaccuugacucccuuucucccuggacuugaucugcuguuucagaggcuagguuguuucugugggugccuuaucagggcugggauacuucugauucuggcuuccuuccugccccacccucccgaccccagucccccugauccugcuagaggcaugucuccuugcgugucuaaaggucccucauccuguuuguuuuaggaauccuggucucaggaccucauggaagaagagggggagagaguuacagguuggacaugaugcacacuauggggccccagcgacgugucugguugagcucagggaauaugguucuuagccaguuucuuggugauauccaguggcacuuguaauggcgucuucauucaguucaugcagggcaaaggcuuacugauaaacuugagucugcccucguaugaggguguauaccuggccucccucugaggcuggugacuccucccugcuggggccccacaggugaggcagaacagcuagagggccuccccgccugcccgccuuggcuggcuagcucgccucuccugugcguaugggaacaccuagcacgugcuggaugggcugccucugacucagaggcauggccggauuuggcaacucaaaaccaccuugccucagcugaucagaguuucuguggaauucuguuuguuaaaucaaauuagcuggucucugaauuaagggggagacgaccuucucuaagaugaacaggguucgccccaguccuccugccuggagacaguugaugugucaugcagagcucuuacuucuccagcaacacucuucaguacauaauaagcuuaacugauaaacagaauauuuagaaaggugagacuugggcuuaccauuggguuuaaaucauagggaccuagggcgaggguucagggcuucucuggagcagauauugucaaguucauggccuuagguagcauguaucuggucuuaacucugauuguagcaaaaguucugagaggagcugagcccuguuguggcccauuaaagaacaggguccucaggcccugcccgcuuccuguccacugcccccuccccauccccagcccagccgagggaaucccguggguugcuuaccuaccuauaaggugguuuauaagcugcuguccuggccacugcauucaaauuccaauguguacuucauaguguaaaaauuuauauuauugugagguuuuuugucuuuuuuuuuuuuuuuuuuuuuugguauauugcuguaucuacuuuaacuuccagaaauaaacguuauauaggaaccgu

SEQ ID NO: 192307 - RNA, 5899 nt, Homo sapiens
acaacauccggggccguggcccgacaagucacaauaacagcaacugcgcagaugcgcgauucggcgggggagguggcuucgcaccacagcgcgcuugcgcgcaggcccaagcaggcgcccacccagaggggagggaggacgccguaccccgcccucacugaggcgcggagccggauccggaggcgccgagccgcauccggagccgcgcacgcgcaaucugcaugaacgaaggccagugcuuaaagacgugccauucauugccagaacucgauucucauuggagcggaggaaguucguggguggagcugguuguuuggcgccugcgucuugcggcgagcgggcuggcgugcggcgccguugcgggcgggagcggcugcaacgccggugccugaggagcgaugccgagggaaaucaucacccuacaguugggccagugcggcaaucagagugagcgaaacuccggccccucagcuagccagguuccuuagggucaaugggaucucgcugugggauccuggacuccaucuguccuugccagaaucguaguucucugaaaggcgagacaucccugacccaguguccacuugcccaaccccgaggggcccuccccugcccagucccuggcguacaguccuuuccucagacacgggagaguccugcggcuugacuucuuaucccuggacgcaggcgcccagucccccggcuccugauuggaaccugcccggaccuagauaucuucuuucuccccugcccgccccuuccccccaguuggguucgaguucuggaaacagcugugcgccgagcaugguaucagccccgagggcaucguggaggaguucgccaccgagggcacugaccgcaaggacgucuuuuucuaccaggugcccccagcgacuuggccgggggcggcaguugcccaagggggcggaagggaagggaguggccugguacugggaaccccgcugggcaguagggccaggcggcuggcuugaggagggagggccggagggagccagaguugggaggacuucggacuugggccgcccuagcugauugggcccccuccuggacuccccuugacaggcagacgaugagcacuacaucccccgggccgugcugcuggacuuggaaccccgggugauccacuccauccucaacucccccuaugccaagcucuacaacccagagaacaucuaccugucggaacauggaggaggagcuggcaacaacugggccagcggauucucccaggucguuuccuauucccuggcagggcccacaacucgcuggguagggacaggcucuaugacgucccgaagagagggaaaaccggaucagggauguaugaaugcuggagggagagaccuggcugcagggaguggacuauguaauauugucaagcgccuacacuagcuaaugcagugugccaggucauucuaagugcuuuacauauauuaauuuuucuaaaucucccaacaacccuagaaguaaguacuacagguccacagucccuuaucugccuuuccaggauccagaaagccaugaaaccaaaggacauuucauaacuaguuuaucagcaaaaacaaauuucaaugaagacaggcuguuuuauaguuucuuuuuuuuaauuuuuauuuauuuauuuuuuuugagacggagucucacucugucgcccaggcuggagugcaguggcacgcucucagcucacugcaaccucugcugcccggguucaagcgauucuccugccucagccucccgaguagcugggauuacaggugcuugccaucacgccuggcuaauuuuuguauuuuuaguagagacgggguuuuacuguguuagccaggguggucuugaucuccugaccucgugauccaccugccucggccucccaaagugcugggauugcaggcgugaaccgccaugcccggcccuauaguuucuauccaacuuacugucauuagugaugccuuuuauuacagaaauacuaauauauuugauuaacgugcuucugauuaaauaaaaauucccacuggaauuuuauuuaauauauaguauauauaccauaauaccuuucuaaaaucugaaauauuuugaauuccaaaacauaacuggccccaacacuguuagauaaggguauauggaccuguauuauuaccuucauuguacagaugaggaaacugaggcauagagcaauuaaauaagcugcccagagcuacauagaaguagaguuaaugggccaggcgugguggcucacgccuguaauccuagcacuuugggaggccaaggcaggcagaucaccugaggucaggaguucaagaccagccuagccaacauggugaaacucugauucuacuaaaaauacaaaaaauagcugggcaugguggcaugcgccuauaaucccagcuacuggggaggcugaggcaggagaaucgcuugaacccaggagacggagguugccaugagccaagaucgcgccacugcacuccagccugggagaaagagagagacuccaucgcaaaaaaaaauagagcuaauguaugaacccagguagucuggguguagagugcuuucuuguaaccacugcaccguacugccucucaauguagauaaaagcagguagcuaugcuccauaaaaggacuucuggguguuauaaggagaauugaggguggcuuuucugaggucagagaccucccaugguucugucccacucugacccuccccuaugucuguacagggagaaaagauccaugaggacauuuuugacaucauagaccgggaggcagaugguagugacagucuagagguaagugucccaggaaugcugguaggagccgacaugggcaaggcuuggcagcacccucuagaagcgaccuguuaggaacaagacccacucauguacccuuugcacuggacagaagcuaucaggccuugccagaaacaaggcaguugccuaagcuguauaagugaggggacuggaugggaagcaagggcucgggaaaaugggaguccuaaaaaacuaugagaugggucuaguuugacauccugccacuagauaccuguacacugacugccccuuccccaugcagggcuuugugcugugucacuccauugcuggggggacaggcucuggacuggguuccuaccucuuagaacggcugaaugacagguaaguuuguguuuggggauuaggaaaggucuccaacuuggcuuccuaaaugacuaggggacccagcagauauaacuccauauuugcuggaacaggaaagaguucuuauauucccuccuauagagaggaaaaugaaguuacaaugacugagaaccccaucacacucccaguagugggaacuggagccuagaaccugagcccuggaugaaagucgagggaguguggccaggucucaauuuggaagcccagagucuaagaugucucugcccuucccccuguagggcuacagacuuccaaaagucaaggcucccuucucuacugauuugaccccaccccaguuucgccaucaagauuuaucugcuucuggacaguuguuagggagcgccauguucaccaggccuucggucuguugcccugauccuuuccccaacccccaccagguauccuaagaagcuggugcagacauacucaguguuucccaaccaggacgagaugagcgauguggugguccagccuuacaauucacuccucacacucaagaggcugacgcagaaugcagacuguguggugaguccuggauucuaccucucccaacucucaacaccccauacccacucgagucuauuaaaucauuuucauguauuuaaaaaaaauccauuuuagccaggugcaguggcucaugacuguaaucccaucacuuugggaggccaaggucguuggaucguuugaguuuaggaguucgagaccagccugggcaacauggcgaaaccccaucucuacuaaaaauacaaaaauuagucgggaguggugauaugugcagaaggaucacuugugccucagaggcaggggcugcagugagcugagaucaugucacugacugcacuccagccggggugacaaagugaaacccugucucaaaaaacaagaacaaaaaaaaaaacuguuuaaauaauuaagaugaaaagaaaaauuuaaaaauccauuuugagcccuccuuugcccuaggucagugcaaaucucuuuccagugagucuuucuggccaugaagcucaaaggaaauuaagcuucagagccuagggucaggcagagcuccuguuuuucuuauccccauugaucugugauccucuucuguccccccagguggugcuggacaacacagcccugaaccggauugccacagaccgccugcacauccagaacccauccuucucccagaucaaccagcuggugggcccccacuccuggacuccuuuggacuugaagcccuccuuguuggagggucauuuggggaagggaggucccacccaggcugaggcccauaacauggcacgccuguccccaggugucuaccaucaugucagccagcaccaccacccugcgcuacccuggcuacaugaacaaugaccucaucggccucaucgccucgcucauucccaccccacggcuccacuuccucaugaccggcuacaccccucucacuacggaccagucaguaagagcagccuucagugucccaggccaggccggcccugggcccaacaggcccuguccuagccuuucucucuuccccacugccccaggagcuacccuuuguggaccccaaggcgcggcgcucagggacuggcacagagugggcgacuuucuugcugacuugcucuccacccucccucugccuuuggcuucugccaaagagaagccaaagggggacugugcccugagcgcuggccgggucccugucucacuguccuaucagguggccagcgugaggaagaccacgguccuggaugucaugaggcggcugcugcagcccaagaacgugaugguguccacaggccgagaccgccagaccaaccacugcuacaucgccauccucaacaucauccagggagagguggaccccacccagguaggggaggccccuucaucccacacccuggaccugcagggguagaggagaggccaccuccacugcuccuaugcccaccccagguccacaagagcuugcagaggauccgggaacgcaaguuggccaacuucaucccguggggccccgccagcauccagguggcccugucgaggaagucucccuaccugcccucggcccaccgggucagcgggcucaugauggccaaccacaccagcaucuccucggugagucucaaaguuugcaccuuuuuucccugaaucaguuuccugacuauaccucaccucucugcaucugcuggcccugcuucuagcuuuuuugcugugggcauagcccagccuugguuccccagcuuucugggccacguuauucuuugaaguucuuuguaaccccuguuuucugcacaccccaagcucuucgagagaaccugucgccaguaugacaagcugcguaagcgggaggccuuccuggagcaguuccgcaaggaggacauguucaaggacaacuuugaugagauggacacauccagggagauugugcagcagcucaucgaugaguaccaugcggccacacggccagacuacaucuccuggggcacccaggagcagugagucccccaggacagggacccucaucugccuuacugguuggcccaagcccugccugacugaccacccccucagagcacagaucagggaccucacgcaucucuuucucauauacauggacucucuguuggccugcaaacacauuuacuucuccucuuaugagacuauuuaucuuuaauaaagcacuggauauaaaucaa

SEQ ID NO: 192308 - RNA, 6940 nt, Homo sapiens
guccuucccacccuuagucccaggcaucugacuaccgggaaccucagccagaguccgggagccccccaccccguccaggagccaacagagcccccgucuugcuggcgugagaauacauugcucuccuuugguugaaucagcugucccucuucgugggaaaaugaaccagaagacaauccucgugcuccucauucuggccgucaucaccaucuuugccuugguuuguguccugcuggugggcagggguggagaugggggugaacccagccagcuuccccauugccccucuguaucucccagugcccagccuuggacacacccuggccagagccagcuguuugcagaccugagccgagaggagcugacggcugugaugcgcuuucugacccagcggcuggggccagggcugguggaugcagcccaggcccggcccucggacaacugugucuucucaguggaguugcagcugccucccaaggcugcagcccuggcucacuuggacagggggagccccccaccugcccgggaggcacuggccaucgucuucuuuggcaggcaaccccagcccaacgugagugagcuggugguggggccacugccucaccccuccuacaugcgggacgugacuguggagcgucauggaggcccccugcccuaucaccgacgccccgugcuguuccaagaguaccuggacauagaccagaugaucuucaacagagagcugccccaggcuucugggcuucuccaccacuguugcuucuacaagcaccggggacggaaccuggugacaaugaccacggcuccccguggucugcaaucaggggaccgggccaccugguuuggccucuacuacaacaucucgggcgcuggguucuuccugcaccacgugggcuuggagcugcuagugaaccacaaggcccuugacccugcccgcuggacuauccagaagguguucuaucaaggccgcuacuacgacagccuggcccagcuggaggcccaguuugaggccggccuggugaauguggugcugaucccagacaauggcacagguggguccuggucccugaaguccccugugcccccggguccagcucccccucuacaguucuauccccaaggcccccgcuucaguguccagggaagucgaguggccuccucacuguggacuuucuccuuuggccucggagcauucaguggcccaaggaucuuugacguucgcuuccaaggagaaagacuaguuuaugagauaagccuccaagaggccuuggccaucuaugguggaaauuccccagcagcaaugacgacccgcuauguggauggaggcuuuggcaugggcaaguacaccacgccccugacccgugggguggacugccccuacuuggccaccuacguggacuggcacuuccuuuuggagucccaggcccccaagacaauacgugaugccuuuuguguguuugaacagaaccagggccucccccugcggcgacaccacucagaucucuacucgcacuacuuugggggucuugcggaaacggugcuggucgucagaucuauguccaccuugcucaacuaugacuaugugugggauacggucuuccaccccaguggggccauagaaauacgauucuaugccacgggcuacaucagcucggcauuccucuuuggugcuacugggaaguacgggaaccaagugucagagcacacccugggcacgguccacacccacagcgcccacuucaagguggaucuggauguagcagguaagacauuuugguggggagaaggcuucuggaagaagggcugaaaaguuguuuccauuagcuuuggguuuuauguagauuaucccagaaaggaagacguggauuuuuguacuuccccuuuugcuggaugggagagaguuggcugcugaguuuuauuuggaucuuagcucacuggcugggugcaaagcugcagccuuccucuacgugaccucauccaaagaucuugggaaauggccgagcucagggaggaggcaggauuugggcuaacaguguccccauugcccucuucucucccuuguacuuauaugggcucugcugcugggagcagccuucuguuugucagcucaguucugugucuggccugugguggugguguuuuggaggaucucuuugcauucuaccacgucccuggcaugugcaggucagucauuccagguuguacauuuccuuuggagauggacccuccucccugauuuuccuucuuucucugggcacaauucaccuaagugugaggggucacauggaucccguggagcauucuggauagauccuggagucuggucacagagagagccaaggcuacaugauggcuuggagucuucaucuuugucuuuucacugucuuuccccacauugagucagucaccagguguuuuuuuuugguuuuguuuuauuuuguuuuguuucuguuuugcaccugcaguaucucggcaggucagacugucaugccgugcaggugccagcccucucucugcuguuuuugcucuuguugcucucagagccaagagccacucugcacccagagggccucccauccacaccagccugcccuuuacucagcucucacuuucgucaucaccugugggauccugucugcagaacccccucaaaacucuuuccuucacggugcagcuccacccugccuugcugugcucugcacagcuacacccaaauucuccaugucccuggacacgcacuucacauguuacagucaggcauccuccuguuugcuuaugcuuugucucugcuuagaauguccuuccauaucaucuuuucugguaauguccuuuaaggccaggcugaaaaguugcccggaagggcccccuuuuccugccugcaacuguauuccugugauccggaaguugccuaggccaugcuccucucacaggacaggccagucagugguuugucugucugcguggaaagcaagaggguaaggaugaucauucaucucuauccccagggacgaguacaguccucucugcuaaugaauguugaaagaaugaaugagugaaauggaaugaacucccugaugaaguauuuuaauuuacaggucaacagcuuuggcuaaaggauuggagguauccuggggagagggaagagaaggaggggcacacucaguucugggcugcucuuuggcccccacucugaagccagaugggggcagaguccagaggggccagggcaguugccugacaggcccuccccuaucccacccugagcaggacuggagaacugggucugggccgaggauauggucuuuguccccauggcugugcccuggagcccugagcaccagcugcagaggcugcaggugacccggaagcugcuggagauggaggagcaggccgccuuccucgugggaagcgccaccccucgcuaccuguaccuggccagcaaccacagcaacaaguggggucacccccggggcuaccgcauccagaugcucagcuuugcuggagagccgcugccccaaaacagcuccauggcgagaggcuucagcugggagaggugaguggcgggcagucagagaggaggggggcagugagagugggaaaggaguguuggcggacacucagcucacacuguaggugaggggagagcucucucaggaaggcuuuucuuuuccuuuuuuuuuuuuuuuuuugagauggaguuuugcucuguugcccaggccggagugcaguggagcaaucucacugcauccuccgccucccaguuucaagcgauucuccugccucagccuccccaguagcugggauuacaggugcacgccaccacacauggcuaauuuuuguauuuuuaguagagauaggguuucaccauguuggccaggcuggucucgaacuccugaccucaugauccacccuccuuggucucccaaagugcugugauuacaggcaugagccacaaugccuggccaaagguuuuucuaguuauccaaagaaaccaugaugggcacauuuuccccuuggaggcuaaagcccaggagugagaacucucuucuguuuuggaugggagagggguuguacuguuaaauggcuggggauaaacaggaggacuugaccccccuuagggugacgucggggauucuguagcgccgagucaguugugugacugcaauuggggaagcugagcucugagcacucaguucccuuucaucauaaucaggcagcaggauggggucaauggccauggaggccugaccagugccucccuagguaccagcuggcugugacccagcggaaggaggaggagcccaguagcagcagcguuuucaaucagaaugacccuugggcccccacuguggauuucagugacuucaucaacaaugagaccauugcuggaaaggucagcuggccgggguagaggguacaggaugagccuugcuuucucuugggagggucccugaaaaccaccugcacuucucagggguggugcugauuccugccuucugcacuucaguauaucugaucauuauccuuugagggaaccuuccugagcuggguguccauaugcagacacugagugaggcccugggccuguccuugagaucuuagagcccucuuaguuccaguuucauggacugaguccuuuccaggcuccaggacucaggagggauggaaguuaccagggaaaaugacaucuccuguaucugaagcuucucccauuccugacuugaugaauuucacaauguuggccugguucugcuucccaagcgcugguucuuuuuccuccacccuucuuuccucaguuguggggaacucuuggagaguuaggggaagaggagcugaaguagccugugggugucacccucuggggguagauaggcaaugggcgauaugaugggaaaugucagagauggaggcugcaagccagggacagggaagcagguguuccuaauaugaaauggacuacuuaugcuuugacuccuacccagcaggaaaaaauguuuaaagacucaugauccuugggcuggugagcugaaucccuaccagggcauguccucagcaaagccagaccucgugauccucuuucuucuccccugcuaggauuugguggccugggugacagcugguuuucugcauaucccacaugcagaggacauuccuaacacagugacuguggggaacggcgugggcuucuuccuccgacccuauaacuucuuugacgaagaccccuccuucuacucugccgacuccaucuacuuccgaggggaccaggaugcuggggccugcgaggucaacccccuagcuugccugccccaggcugcugccugugcccccgaccucccugccuucucccacgggggcuucucucacaacuaggcgguccugggauggggcauguggccaagggcuccagggccagggugugagggauggggagcagcugggcacugggccggcagccugguucccucuuuccugugccaggacucucuuucuuccacuacccucccucgcauccgccucugagccaggagccuccugacccugugaugccugacacaggggacacugaaccuuguugaugccagcuguacugaguucucauccacagaggccaggcauggcccagccuggagccguggccgagggcuucccuagaugguucccuuuguugcugucuggcuuucccgaaucuuuuuaggccaccuccaaggacucuaaaagggggcuauucccuggagaccccagaguaggguugccaguccugcaaguccauagcugagcuggaaaggaugcuucugcucacauucccucucauccagguccuuuccuucucgucuuccucucucucaccuacuuccuccuccuccuccuguuccugccuucucuucuauccugcaauuucucccgaauccugaggggauaucccuaugucccagccccugguacucccccagcccucaguuuucagucaaguuccgucuccucuccagcccuauggaagucucaaggucacgggaccccuaaucagaguggccaaucccugugugucguucccuugugucuguugcuuauugggaguaggaguugcuccuaccccuguccuggggcuggguguguuucaggacagcugcuucugugcauuugugucugccugccucaugcucucuauagaggaggauggucaucgugacagcagcagcucaaguuagcauuucaagugauuugggggugcaaugauaaugaagaauggccauuuuguaccagggcucuguauucugcaacagccuguuugggaggcuggaguggaaacaaagggugggcaucaaagaugagaagccaaagccccuacaacuccagccacccagccaggaggggcuguccaaucacauucaggcaugcgaaugagcugggcccugggugaggugggggucuggccuaguggggaggggccuggccuggguggggcagggccuggccugguccaggcuugggcuccauucccaucacugcugucccuccugaggucuggauuggggauggggacaaagaaauagcaagagaugagaaacaacagaaacuuuuuucucuaaaggacugguuaaaucaauucugauacagccuuacaauacaauaguaugcagcuaaaaaauaauuguaugucuuuauauacuaauauguaauaaucuucaggugaaaaaggcaagccacagaaauguguauagcgcacuucccauuuguguuucagaaaggaguagaauauaaacacauaauugcuuauguaugccuauucagaauaaauggguaacacugauuacuuuugggaggggaaccaguagguugaggacaggagagggaagggucuuaacacuuacacccuuuuguacauuuugaauuuugaaccaugugacuguauuaccuauucaaaauaaacaauaaaugggcccaa

SEQ ID NO: 192309 - RNA, 81189 nt, Homo sapiens
guaccuugauuucguauucugagaggcugcugcuuagcgguagccccuugguuuccguggcaacggaaaagcgcgggaauuacagauaaauuaaaacugcgacugcgcggcgugagcucgcugagacuuccuggacgggggacaggcugugggguuucucagauaacugggccccugcgcucaggaggccuucacccucugcucuggguaaagguaguagagucccgggaaagggacagggggcccaagugaugcucugggguacuggcgugggagaguggauuuccgaagcugacagauggguauucuuugacgggggguaggggcggaaccugagaggcguaaggcguugugaacccuggggaggggggcaguuuguaggucgcgagggaagcgcugaggaucaggaagggggcacugaguguccgugggggaauccucgugauaggaacuggaauaugccuugagggggacacuaugucuuuaaaaacgucggcuggucaugaggucaggaguuccagaccagccugaccaacguggugaaacuccgucucuacuaaaaauacaaaaauuagccgggcguggugccgcuccagcuacucaggaggcugaggcaggagaaucgcuagaacccgggaggcggagguugcagugagccgagaucgcgccauugcacuccagccugggcgacagagcgagacugucucaaaacaaaacaaaacaaaacaaaacaaaaaacaccggcugguauguaugagaggaugggaccuuguggaagaagaggugccaggaauaugucugggaaggggaggagacaggauuuugugggagggagaacuuaagaacuggauccauuugcgccauugagaaagcgcaagagggaaguagaggagcgucaguaguaacagaugcugccggcagggaugugcuugaggaggauccagagaugagagcaggucacugggaaagguuaggggcggggaggccuugauugguguugguuuggucguuguugauuuugguuuuaugcaagaaaaagaaaacaaccagaaacauuggagaaagcuaaggcuaccaccaccuacccggucagucacuccucuguagcuuucucuuucuuggagaaaggaaaagacccaagggguuggcagcaauaugugaaaaaauucagaauuuauguugucuaauuacaaaaagcaacuucuagaaucuuuaaaaauaaaggacguugucauuaguucuuugguuuguauuauucuaaaaccuuccaaaucuuaaauuuacuuuauuuuaaaaugauaaaaugaaguugucauuuuauaaaccuuuuaaaaagauauauauauauguuuuucuaauguguuaaaguucauuggaacagaaagaaauggauuuaucugcucuucgcguugaagaaguacaaaaugucauuaaugcuaugcagaaaaucuuagagugucccaucugguaagucagcacaagaguguauuaauuugggauuccuaugauuaucuccuaugcaaaugaacagaauugaccuuacauacuagggaagaaaagacaugucuaguaagauuaggcuauuguaauugcugauuuucuuaacugaagaacuuuaaaaauauagaaaaugauuccuuguucuccauccacucugccucucccacuccucuccuuuucaacacaaauccugugguccgggaaagacagggacucugucuugauugguucugcacuggggcaggaaucuaguuuagauuaacuggcauuuuggcuuuucuuccagcucuaaaacaagcuccaucacuugaaauggcaaaauaaaaucauggaugaggccgagggcgguggcuuaugccuguaaucccagcacuuugggaggccaaggugguaggaucacgaggucaggagaucgagaccauccuggccaacauggugaaacccccucuccacuaaaaauacaaaaauuagcugggcguaguggcaugugccuguaaucccagcuacucaggaggcugaggcaggagaaucacuugaaccaggaggcagauguugcugugagccaauauggcaccacugaacuccagcgacagagcuaaacuccaucucaaaaaaaaaaaaaaaaaaaaaaaaacauggaugaucggugucguugagaggauagguauuuggaagaaccuuuguuugaaacuggcucuguacauacaaugaaauuacauacuuauuuacauacaaugaaaugcagagguuuuuuuuuuauauaggaucucugucgagaggcuggagugcaguggugcuaucacagcucacugcagccucaaccucgucaggcucaagcaauccucccaccucagccuccagaguagcagggacgauaggugugcaccaccaugcccagcuaauuuuuguauuuuuuuuucuuuuuuugagauggagucuugcucuguugcccaggcuggagugcaguggcgcgaucucagcucacugcaaacucugccucccggguucaugccauucuucugccugagccuccugaauagcugggacuacaagcacccacuaccacgcccggcuaauuuuuuguauuuuuuuuucuuuuuuaguagaggcgggauuucaccguguuagccaggauagucuugaucuccugaccuugugauccacccgccugggccucccaaagugcuaggauuacaggcauaagccacugcguccagccauucuuguauuuuucuguuguagagauaggguuuugcuauguuggccaugcuggucucaaacuccugaccucaagugaucuacccucccuuggccucucaaggugcugggauuacaggccugagccauugcacccagccauggucuaaaaaucuugauugaaauaccaccuuuucauuuccagacaccccuauuuaaaauuaccacacccccagcacacacuuuaucuucuauuccugcugcuucuccauaacacugauuacuagcugacauucuauguaauguauccauuuuuuaucucuagucccacagaauguaaacuccaggaugggauuuuuguuuuguuuacauacaucuguauguucaguaguuagaacgguacuugggaccuaguugccacucaauaaacauuugucaaauaaauaauaaacuaaacuaaauuaguucuuuaauuuuuuuaaauauggugaugguuaguagugaguaacauucaaaaaauaaguugaaaaguuguaccauugccucuuacccacaauaaaaaaggguaaauucuuuucugcuuuaugaaaguuguuuuucauauuugaagucaaguuaaucagauuaaggaaaauguauguuguguuuucagagcgauacaagauuuauaaauaaccauccucucccuugcccuucaacauuauagcuaaacaaaaauaagaggaaaacaggauucacaauuuaucaauuuauugaaaaucagagccagagaagcaggaaaugacauuguaggaaaaaacugcuuuugaaaaagcacaaaacuuacucaugacaaucagugaucaggaaaauccucaauaguguggcauuuggauacauuuauguuucauuuccaugggagagagucauaaaaauaggauguucuuucucauucuggcaaauuaaaccaucaauuaaaaacucagauacauaaaaauuaaagauguaagaaugaaaaugcuaaauuguuauuuucaaucaacuauuauguuuucuagcuuuucauugcuuuuuucuguuuccuguuaagauuaauuucuuuuuuuuuuuuuuuuuuuuuuuuugagacagacuuuggcucuuguugcccaggcuggagugcaguggcacaaucucggcucacuacaaccuccaccucccggguucaagcaauucugcugccucagccuccggaguaccugggauugcaggcaugugccaucacaccagcuaauuuuguauuuuuaguagagacaggguuucuccauauuggucagguuggucucgaacuccugaccucaggugauccuccugccuuggccuccgaaagugcugggauuacaggcgugagccaccgcucccagacuuuuuguuuuguuuuguuuuguuuuuuugagacacggucucgcucugcugccuaggcuggagugcaguggcacgaucuuggcucacugccagcuccgccucccggguucaggccauucuccugccucagccucccgaguagcugggacuacaggcgcccaccacuaugcccggcuaauuuuuuguauuuuuaguagagacgggguuucaccauguuagccaagauggucucgaucuccugaccuugugauccacccgccucagccuuccaaagugcugggauuacaguccugagccacugcgcccggccuggaccuuuuuuuuucggggugggggguuggagucuggcucugucgcccaggcuggagugcaguggcgccaucuuggcucacugcaaccuccgccugccagguucaaguucaagcgcuucuccugccucagccuccugaguagcugggauuauaggcgcacgccaccguggccggcuaauuuuguauuuuuaguagagauaggguuucaucacguuggucaggcuggucuugaaguccugaucucgugauccacccgccucggccuuccaaagugcuggcgugagccacugcgccuggcuuaagauuaauuuuuguuuguuuuguuuuugagacggagucucgcucuuucacccaggccggagugcaguggcgccaucucggcucacugcaagcuccgccucccggguucacgccauucuccugccucggccccccaaguagcugggacuacaggcguccaccaccacgcccggcuaauuuuuuguauuuuuaguagagacgggguuucaccguguuagccaggauggucuccacuuccugaccucgugauccgcccaccucggccucccaaagugcugggauuacaggcgugagccaccgcgcccggccuuaagauuaauuuuuaugguguuuuacauucauuuguauggaaaguucuaggauagggaucauauuucacuuccuuuuaauauaguacaguauagcacaauuugcaguuaugucuuaauaugugaucaggaaugaucaugacuggaaacaguguuauuugugguagcuauaggguagguaagguuuucagccuguuuuagguuucuugaacuaaaauuccuucugcugucuucuaagucaauauuggcagcuauuucugacaauugguaguucuuuguaacuuuuuaccuaugacuauaacauuuuugacuuucagaagaauuugcuaaaauguguuccccgguggguuguuguuuuucaaccuaaaccuagcugcuuuuuccagucacuuauccguauuggaagcucaaaaugcaaauauacaguaggccuaaaauauugccugguuugaaaaguguuuaaaauauuugaaucauuuuuauaguaaacauuuacucucaucaggaccuagaaggggaacauuuuaauuuuuuuucuuuucccuuuucacagucuuccuucaacauucauuaccuuuuuacauaucggaguuuucaucuguucaaaguuuguguuuacaguguguuuauauaguuuagauuauaauuaccauacugaaauauaauuguuucagaauugagucaguggugagaaugaaagccaucugguaugauaacugaauccaauuuuucuuuuacggagaauuucuuugaaauguagcuuaucucagaaauagggauuuaguaaccaaucagaguuuucuuugucaagguuguuuuucuuuuuaaagucacauuuggucccaguaauaauaccaauguugguacaaguuaucucagguugugaagcauuuuucccaagucaucucagguugugaagcauuuucccaaguagcauuuaauuuuauucuugcaauagcccaaggagucuggcagggugaauggcaagagaaggaaacagguucagguagagugguuagcccaagguggcucugcuuauauacacaacugguaguagaaacccagccuccugacuuaguucauuguuuuucuuuucacugcccugugcuaugucaaaaaccccaugauuacaagaguuguauuacaacccuucacaauaagguuacuguccacaagcuuuucuugugauccuuuucuuuuuuuuuuuucuuuuuuugagauggauucucugucacccaggcuggcccgccuuggccucccaaaaugcugggauuacagcgugagccaccgcaccuggcccuugugauccuuuucuaaaaaguuaaauauuuaaggaaaaaaccacauucuugucacacugccagguuagucguucuuugauaucuugccuggacuuuauccaaaaaauccguuucaaaaauucacauuuagagcuaaguguaguggcucacgccuguaaucccggucgaggcagauggaucacuugaggucaggacuucaagaccagccugggcaauauggugaaaccccuucccuaccaaaaauacaaaaaaauuagccggguguggcagcacgcgccuguagucccagcuacuuggaaugcugaggcacaagaaucacuucaauccgagaggcagagguugcagugagccaagaccacaccacugcacuccagccugagcagcagagugagugagacuccaucuccaaaaaaaaaaaaaaagguucacauucagaagaaagcuaaaggccggguauaguagcucacaccuguaaucccagcacuuugggaagccgaagcaggaagauugcuugaugccaggcauucaagaccagcaugggcaucauagugagauccugucucuacaaaaauuaauuaacauuaaaaauuaaaaagauggcuggcaugguggcucacuccuguaaucccaguacuuugggaggccaaggcaugguggugcaugccuuuagucccagcuacucgggaggcugaggcaggagaaucacuugaauucaggaggcggagguuacagagagccgagauggugccacugcacuccagccugggcgacagaacgagacucugucugaaaaaaaaaaagaaaauuaaaaagaccagaauaaagcuaaagauuuaaaauagccuauagguuccuaccagaaguuaccagcuaccucucugauagucuuucccuacaauauccuccuggauuauuacauuuuagcaccuugaccuaucugauguccugcauacacaggcaugguccugcucaggguuugccuucucugcucccucuuucuuggaaugcucuuccccuaauuguugcauaguguguuucuuuacauuauuaagcuauccucuagucucaccucagugaaaccuuuccugacuccccccauguacaucucacccccacauagauauugaacuaccuguuuccccuuacccugcuuaauuuuucucuuuaaugcacuuauucccauguauucuuuaauuccguaucaacugucuaccacacuagaauaugagcucuaugagagcaggcuuuauuuuguaaacugcuacauuucuaucuccuagaauaguacuugaauauaguaguagauacuuaauaaacacuuguuauauuaguauaauaaaugaacuaaucucaggaaugccuugguuuuguggauagacagguagggaugggaacuugggugauguauuuucugaaguuuuuauuuuuaagcuuauuauuauuuugagauggaguccagcucugucgcccagguuggaguacaguggcgcgaucuuggcucacugcaacgugcacuuccccgguucaagcgauucuccugccuuagccucccaaguagcugggauuacaggcgcaugccaccaugcccaguuaguuuugguauuuuuaguagagacagcguuucacuguguuggccaggcuggucucgaaauccugaccucaugauccgcccgccucggccucccaagugcugggauuacaagcaugagcccccgugucuggccuuauuuucuuuuuuuugagacagagucuuccucugucaccuaggcuggagugcaguggcacgauauuggcucacucugcaaccuccaccuccaggauucaagugauccuucuaccuuagucuccaaaguagcugagaccacaggcaugcgccaccacgcccggcuaauuuuuguauuuuuagcguagacaggguuucaccauauuguccaggaugaucuggaacuccugagcucaggugauccacccaccucagccucccaaagugcuaggauuacaggcaugaggcaccaugcccggccuuaagcuuaucauuuucuaaauuuccuuuagugaguacuuauuacacuguuuuuacaaaguaaucacaaaccaaacaucaugccucuucugaagugaucuaauaagaguacacaguaccaucuguaaaguguucuugccagaaaguugaaccugaaugauuaagccuguaagucuaguuuauaggaaauaaggcuagaggaacaaguuaaaccucaccauaggguuauacaaucagcaaaauccagaaugggggaaacuccacaggucaaaugaccuaauuuuaaaaauaaaugacaagggagaaaaaguaagagacaccuauagaucagaagacacuuggggcugggcaugguggcucacaccuguaaucccagcacuuugggaggccaaggcaggcggaucaccugaggucaggaguucaagaccagccggccaacauggugaaaccccaacucuacuaaaaauacgaaaaaucagccgggcgugguggcgcacgccuguaguuccaacuaccugggaggcugaggcaggagaaucacuugaacuugggaggcagagguugcagugagccgagaucgcaccauugcaugccagucugggcuacaaaagcaaaaccccaucucaaaaaaaagaagacacuuggguuuggguguguuggcucaugccuguaaaccccgugcugggaggauugcuugagcccaggaguucaaggcugcagugagguauguuugcaccacugcacuccagccuaggugacagagugugaccuuaucuuaaaaguaauaauaauuaaaauaaucugggguagggguggauaugggugaaacagcuuggccaugaguugaugguuguuggaccagggugaugguccauauaguucauuuuauuauuuuauuuacuugaaauuuugaaauacuugaaauuuuccauauuaaguuaaaaaggcauuuacaguaaacaaaaaaaaguucuaggaaggaauucaaaagaaauauaagcagaaaauuuugucuuuauggagcuuaaagaugagaugugcacccacagugauagugcagaaaaauauaucacuggaaaugaauucguacgaacuauuaucaacuaaucuuuuaaaugcugaugauaguauagaguauugaagggaucaauauaauucuguuuugauaucugaaagcucacugaagguaaggaucguauucucugcuguauucucaguuccugacacagcagacauuuaauaaauauugaacgaacuugaggccuuauguugacucagucauaacagcucaaaguugaacuuauucacuaagaauagcuuuauuuuuaaauaaauuauugagccucauuuauuuucuuuuucucccccccuacccugcuagucuggaguugaucaaggaaccugucuccacaaagugugaccacauauuuugcaaguaaguuugaauguguuauguggcuccauuauuagcuuuuguuuuuguccuucauaacccaggaaacaccuaacuuuauagaagcuuuacuuucuucaauuaagugagaacgaaaaauccaacuccauuucauucuuucucagagaguauauaguuaucaaaaguugguuguaaucauaguuccugguaaaguuuugacauauauuaucuuuuuuuuuuuuuuugagacaaagucucgcucugucgcccaggcuggagugcaguggcaugaucuuggcucacugcaaccuccgccccccgaguucaagcgauucuucuaccucagccucccagguagcugggacuacaggcacccgccaccaugcuuggcuaauuuuuguacuuuuaguagagauaagguuucaccauauuggccaggcuggucucgaacuccugaccuugugauccaccugccucggccucccaaaguucugggauuacaggcgugagccaccacacccgacugacauauauuaucuauuaggauguaacaucauuuugaacaguguuuuguauuuuuuguguccaucagugaaagcaaacugcaagcaguuuugaaauaagcacauuguguuugagccuucccaguuucuccuuucuguucauuucugcauauccuuaugcauucccccuucuaagggucaguguuugcccgcuuuguaaucauugugaagacaggaaaggaccugauaccaguuucuauuuaggccaaaauucauuuauagcagugauucaaguuauauuuacguauuugaugaucuugucuuuugaaaugaaaauguuuguuucuuaauaaaagaauuucagaaaaaguagaguagguaauuuaguagaacaagugggcuuucuccuuuucuuuauguuaagcuauggcucacaucuuaccuuaaaugucaacuaauuuguuuuuaaguauuuauguaccugguacauaaccugguaccagguacaaacuauguacuugguaaaaaguuuauuagcacaaaaagguauaugaugcaaaguauacuucccucuuacccuacaaccccugccucccuguucccuccccagacaaccacaaugaucaauuucuuauguauccuuugaggaauuuuuaaauuccagaguucuuaacuugggguuuaugaauagucuuuaugaauuuccuagaauuauauuuaaauuguauucaaaacuauggccauguacauuuuucugggaagauaguccauaauuuucaucugagugagcuaagaucaugccacugcauuccagccugggcgacaagagggagacucaaaaaaaaaaaaaaaagucccaguauuuacuacagagagcuaaagauuaaccuuuaaagcccuggggcuuucaauuuaucuggaugagaaucuuucuggaaugaacuguauguuuucuugucagcuugaguaacaaaugcugaacauacuauacuauuauuacagggacucaagggcccagugugguagcuccugcccauaaccccagcacuuugggaggccaaggcaggaagaucacuuaaggccaggaguucgaagcuguagugagcuaugaucacaccacugcacuccagccuagaugacagagugagacccugucuuuuuuuuuuuuugagaugguguuucacucuauugcccaggcuggagugcaguggugugaucucggcucacugcaaccuccaccuccuggguucaagcgauucuccugccucagccucuugaguagcugggauuacaggcaucugccaccacacccagcuaauuuuuguauuuuuagucgagacaggguuuucaccauguuggccaggcugcucucaaacuccugacuucagcuaccuuggccuuaaaaaguguugggauuacagguguaagccaccgcgccuggcugacccugucucuuaacaaaaaaagagagauuaaguuaugaauauaguugcuuugagaacuuguggaagaaggaaauuauaggcuuauaggcagagauaauaauacgagcaaauguacaaauaaaagaaaauagaggacgggcgcgguggcucacgccuauaauaccagcacuuugggaggucgaggugggcggaucacgaggucaggaaauuaagaccauccuggccaaaauggcgaaacacugucucuacuaaaacacacaaaaaacuagccuggcaugguggcacguaccuguagucccagcuacuugguaggcugcggcagggguaucacuugaaccugggaggcagagguugcccugagccgagaucaugccaaugcacuccagccugacaacagagugagacucugucugaaaaaaaagaaaagaaaagaaaauacauccaggaaaaauaagcuaacuuugcauauguguauaggaguuguguuagaaaaggaagaagcccucaaagaugggaagccauuugcaagaaagagaagguccaagaggaggcagaagggauuggaaauagaaaaaggauguaagaaagaguugauuauuacucauaaacaguaaugaaggaaaaggagaguaauucuacaggaagaugcugaggugcuuugagcccagugaaguuggagguaaagacagcuguugaggccgggcacgguggcucacgccucuaauccuagcacuuuuggagcccaaggcagguggaucaccugaggucaggagcucaagaccagccugaccaacauagagaaaccccaucucuacuaaaaauacaaaauuagacgggcguggaggcgcaugccuguaaucccaguuacuugggaggcugaggcaggagaaucacuugaaccugggaggcggagguugcagugagccgagauugcgccauugcacuccagccugggcgacaagagugaaaacugucucaaaaaaaaaaaacaacaaaaaacagcuguugagauugagaggauuagaguuggcaacuggagaagagugagaagcuugguuucaagcuugugauagucaggauugugauagucaggaaagaaccagucauaaagauauauguguguguauacauauaaauauguuauauauaugugugugugugacacauauauauuuuuguuuguuucuuugagacagugucucccucugacacccaggcuggaguucaguggugugaucauaguucacuuuuaccuugcaaucuggguucaagcaaucucucaucucagccccucaaguagcuaggacuacagguacauggcauuugcccagcuaauuuuuaaguuucuuguagagaugggccagccauauuuuaaauuguguuuugaauguuauauuagaauuaaaaguccaaagccgggugugguggcucacgccuguaaucccagcacuuugggaggcugaggugggcggaucacgaggucaggaguucgagaccagccuggccaauaugguaacaccaucucuacuaaaaauacaaaaauuagcuggguaugggggcacaugccuguagucccagcuacucaggaggcugaggcagaggaaccucuugaacccaggaggcagaggcugcagugaguugagaucgugccacuguacucuagccugggcgacagagcaagauuccgucucaaaaaaaaaaaaaguccaguauaaugcccaugugauagaucgacuuuuucaugaaaucucuucuguaauaucaauauaaucugaauaacacuuugaucuauaugaugagaaagcugggagccugggagcgauacccccaugcuuuuguuguauuaauuguauuuucuacggauaaacucuaauugcuaaaaauaaaacaacuuuauugacccaagcaagccuaaaguucugaaaucuuuuuuuuauuuuuguuuguuuguuuguuuguuuuuguuuguuuuguuuugagacggagucucgcucugucgcccaggcuggagugcgguggugcagucucggcucacugcaagcuccaccucccggguucacaccauucuccugccucagccucccaaguagcugggacuacagacgccugccaccacgcccagcuaauuuuuuuguauuuuuaguagagaaaggguuucaccguguuagccaggauggucucgaucuccugaccucgugaucugcccgccuuggccucccuaaguucugggauuacaagugugagccaccacgcccggcuguuuuuuuuuguuuuguuuugagacggagucucacuguguugcccagacuggagugcaguggcaugaucucagcucacugccaccuccaucuccuggguucaagcaaaucuccugccucagccucccgaguagcugggacuacaggcaugugccaccacaccuggcuaauuuuuguauuuuuaguagagacgggguuucacuauguuggccaggcugguccaaaacuccugaccucaggugaucugcucgccuuggccucccacagugccaggauuacaggcaugagccaccuugcccagccaguucugaaaucuuuuaugaagccuauaaaaaaagauaauaauaccaaucuagaaaauauuucuuaaggcagucaugcauuaguuugaacuuuccaaacaaaaaaaugcaauguguaauacuuuuuuuuuuuuuuuugagauggagucuuguucuguugcccaggcuggagugcagugguacaaucucggcucacugcagccucugccucucugguucaagugauucuccugccucagccucccaaguagcugggauuacaggcgugcaccaccaugcauggcuaauuuuuguauuuuuaguagagacaggguuucaccauguugacaaggcugaucucgaacuccugaccucaggugauccgcccaccucagccucccaaagugcugagauuacaggcauuagccaccacgcccagccuuuuauuuuaguagagaccauguuucaccauguugaccaagcuggucuugagcugaccucaagugauccgcccaccuccaccucccaaaauggugggauuauaggcaugagccaccgcacccagccuguaauacuuuuuugaagaucuagaaccacauuguucaaagagauagaaugugagcaauaaauguaacuuaaauuuuucaacagcuacuuuuuuuuuuuuuuuuugagacagggucuuacucuguugucccagcuggaguacaguggugcgaucaugaggcuuacuguugccuugaccuccuaggcucaagcgauccuaucaccucagucucccaaguagcugggacuguaagugcacaccaccauauccagcuaaauuuuguguuuucuguagagacgggguuucgccauguuucccaggcuggucuugaacuuugggcuuaacccgucugcccaccuaggcaucccaaagugcuaggauuacaggugugagucaucaugccuggccaguauuuuaguuagcucugucuuuucaagucauauacaaguucauuuucuuuuaaguuuaguuaacaaccuuuauacauguauucuuuuucuagcauaaagaaagauucgaggccgggugcgguggcucacgccuguaaucccagcacuuugggaggcugagaugggcacaucacgaggucaggagaucgagaccauccuggcuaacauggugaaaccccgccucuacuaaaauuacaaaaaguuagccaggcgugguagcgggcaccuguagucccagcuacucaggaggcugaggcaggagaauggcgugaacccaggaggcagagcuugcagugagcagagauugugccacugcacuccagccugagagacagagcgagacuccgucuaaaaaaaaaaaaaaagauucgaauccuuaucuugguugauuuuugcguaucuaguuccacugaauuauuuauauaauuguauagacuacagcacgagacagcuuagcuugucacucuacuguacuauauucugcaguacuaucauaagggaauuuccucccuaccccugcucugaauuguucaauuguacuauuugcuggaguaaugcuugaugccuucuugauccauuauacuagaguauauguaguauuuguagauucugaaggagugggagccucuauucugaguuuuaaagguacuuauguacaguggagguagcuuuuugacagccucaucuuccaaacuauagagucauuguuuuguugagugcaauaugguacuugaagcaucuauaucggcgaagaaggacccaagucuccuugaccuuaccuaccuacauucacuuucucugguaggaagauugugggugccucucuccagacuuaguuuccaugucaaaaaagaaaaaaggaagauugugggcuuugcuacaauccaauucuggauccaauauaaccuucauugcuuaauuacugugugaucugggacaagccucuacucuauaaaaaugaagauaaggccaggcuugauggcucaugccuguaaucccagcacguugggaugccaaggcaggaggaucacuugaggucaggaguucgagaccagacugggcaauauagugaaaccacaucuguacaaaaauaaagauagaaaguagcccagcgcaauggcucacaccuguaaucccagcacuuugggaggcugaagcaggcgaucacuugaggucgggaguucaagacuguagacagauagauagguagguagauagauagagauauagauauaguugggguuuuuuuguuuuguuuuguuuuguuuuugagauggaguuucgcucuuguugcccaggcuggagugcaauggcgcgaucucaguuuacugcaaccuccgccucccggguucaagagauucuccugccucagccuccugaguagccaggauuacaggcauaugccaccaugcccggcuaauuuuuguauuuuuaguagagacaggguuucuccguguuggucaggcuggucuugaacuccugaccucucccaaaguguugggauuacaggcgugagccaccgcuccuggccuuuuuuuuuuuuuuuuuuuuuuuuuugagacagagucuuccucuguugcccaggguggagugcaguggcacucuucucagcucauugcaaccucugccauccuggguuccagugauucucaugccucagccucccaaguagcugggacucaggcgugugcccaccacgccuggcuaauuuuguuguauuuuuaguagagacaggguuucaccauguuagccaggcuggucucaaacuccaggccucaagugaucugccugccucagccuccugggauugcagacaugagccacugcacccggccaagagaggguaauaaauguuaaauuaccuggcuaguaaaaaauauucucuaagugucuuuucucacaauucccaaugccuuuuuuuuuuuuuuggcacaaucucacucuguugcccaggcuggaaugcaauggugcaauauuggcucacuguaacccccgccucacagguucaacuuauucucaugccucagccucccgaguaacugggacuacagugcaccaccaccacacccagcuaauuuuugaauauuuaguagagacaggguuucaccauguuggccaggcuggucuugaacuccuggccucaagugauucacccaccccgcaagugcugggauuacagguguggaccaccgugcacagcccuagugacuuuuuuuuuagccccuuaaucuuuucuuuccugggucucuucauugucagugucugcuauuuacucccuaccuagucacccccuucaccaguauauuauguccuuuauguuuuauuuugcaggaucuuauuuugcuuuucuauugaauccccuccaucuagaauaguacuagacauaguaaauauugguuguaugagugaaucgcugcuuuuaauuaucaucaccauugcucucucuacuucuggucuaugauccacuuugaguuaacuuuuguuauuuggugugagauaggaguauaauuucauucuuuuacaugugguuauacuuuugucucaacacuguuuguuaaaaacacaaaaaguauuauuuucccauuuaaucaucuuuggccugggcacgguggcucaugccuguaaucccagcacucuggaaggccaaggcagauggaucaauuugaggccaggaguucaagacuagccaacauggugaaacuaaaaauacaaaaaauuagcuggguaugguggugcaugucuguaaucccagcuacucgggaggcugaggcacgagaauugcuugagccuaggagguggagguuguagugagcugagauugugucacuacccuccagccugggugauagagugagucugucucaaaaaaaaaaaaaaaaaauuaagaaaauaaaaaucgucggccaggcaugguggcucacaccuguaaucccagcacuuugggaggcagaggcgggcagaucacgaggucaggagauggagaccauccuggcuaacauggugaaaccccgucucuacuaaaaauaaaaaaauuagccgggcauggugcugggcgccuguagucccagcugcucgggaggcugaggcaggagaauggcgugaacccaggagguggagcuugcagugagccgagaucgugccacugcacuccagccugggagacagagcgagacuccgucucaaaaaaaaaaaaaaaaaaaauugucuugguauuuauuauuguugaaaaucgcuugaucacagauguauguaugaguuuauuucuguacugucaauuccauuuuauugauguaugugucuauucuuaugcuauuaccacacuuucuugauuacuauagcuuuguggugagguguugagauuuuaaacuaauuauaagcaucuuacaugaacuacuuaccguuuauauuugauuaugcagcaugaaauaauuaugaauauaucauuaaauaugccauauuaacuuuuauuaaguuuuaugugaucauaacaguaagccauaugcauguaaguucaguuuucauagaucauugcuuauguaguuuagguuuuugcuuaugcagcauccaaaaacaauuaggaaacuauugcuuguaauucaccugccauuacuuuuuaaauggcucuuaagggcaguugugagauuaucuuuucauggcuauuugccuuuugaguauucuuucuacaaaaggaaguaaauuaaauuguucuuucuuucuuuauaauuuauagauuuugcaugcugaaacuucucaaccagaagaaagggccuucacaguguccuuuauguaagaaugauauaaccaaaagguauauaauuugguaaugaugcuagguuggaagcaaccacaguaggaaaaaguagaaauuauuuaauaacauagcguuccuauaaaaccauucaucagaaaaauuuauaaaagaguuuuuagcacacaguaaauuauuuccaaaguuauuuuccugaaaguuuuaugggacaucugccuuauacagguauuagaaacuuacugccuuucucuaaugcuucuaguguaaaaacuugcagacuuauguaaaguagggcuguaucgccgugcccccauugucuguuaaucuuguuuuuauauuuuugauuguguuuccuuuucuuuuuuuuuuuuuuuuuaagacaggguccugcucugucacugaggcuggagugcaguggcgugaucucggcucacuguagccucugucucccagccucuuccugccuuagccucccaaauagcugggacuacaggcacacgcuaccaugcccggccaauuuuuguauuuuuuguagagaugagguuuuaccauguugcccaggcugguaacuccugagcucaggugaucugcccaccucggccucccaaagugcugggguucacagguguguguuuauuucuaucuaauuauuuacacaaacacaauguauuuauauauuguguaucucuucugcuacaauguaaauucuaugagaguaguaauuuugucugucucaacacuguuuuuccuaaguuugguacauaguaggcacucagaugcuuaaaggaaugaaugaauugugcuuuaauuccacuuuacuaaacccaaaucucccuuuggacauuguuaucuauguguuuucaaagaaguauaaucauaauuugacagaaauccuugagaggcagaacuaagugagggauugggcaggguucagauguuaagaacaguaagcucagcagggugugauugcucaugccuauaacccuagcacucuaggaggcugaggugggaugauugcuugaggccaggaguuugaaaucagccugggcaacauagugagaccccaucacuaccaacaaaauaaauaaauaaauguacaugguggcauaugcccauaguccuagcuacuugggaggcuauagugggaggauagcuugaguacagaagucugaggcugcagugagcuaugauuguggcacugcaugcuagccugggcaauagagcaagacccugucucuaaauuaaacaaaaaaaaaaguacucuaguuuucuaugcaaugcauuauaucugcuguggauuuagggcaguauuauaucagauaauuuuaggcauuugguaggcuuaaaugaaugacaaaaaguuacuaaaucacugccaucacacgguuuauacagaugucaaugauguauugauuauagagguuuucuacuguugcugcaucuuauuuuuauuuguuuacaugucuuuucuuauuuuaguguccuuaaaagguugauaaucacuugcugaguguguuucucaaacaauuuaauuucaggagccuacaagaaaguacgagauuuagucaacuuguugaagagcuauugaaaaucauuugugcuuuucagcuugacacagguuuggaguguaaguguugaauaucccaagaaugacacucaagugcuguccaugaaaacucaggaaguuugcacaauuacuuucuaugacguggugauaagaccuuuuagucuagguuaauuuuaguucuguaucuguaaucuauuuuuaaaaaauuacucccacuggucucacaccuuauuuuaucaaucguaaggugcacauuuuucacaucuuaacaucucugaaauugggaacauuuuacuauugagggugugucauuuguuuaauuugugugcuuucuuucuuagugauacagaaaauaauagugcaacuuacauuguuggugucuuagcuuuagugaaauacaguauugauaggcaaauuucuuaguguuaagguagaaaacaaggacucuaaauaacuuugauggucuguguauuuguuuuuguuuccuaggaguaaaauuuccaguugauuuuuuaaaauuugauuuuuaaaaaaaaucacagguaaccuuaaugcauugucuuaacacaacaaagagcauacauaggguuucucuugguuucuuugauuauaauucauacauuuuucucuaacugcaaacauaauguuuucccuuguauuuuacagaugcaaacagcuauaauuuugcaaaaaaggaaaauaacucuccugaacaucuaaaagaugaaguuucuaucauccaaaguaugggcuacagaaaccgugccaaaagacuucuacagagugaacccgaaaauccuuccuugguaaaaccauuuguuuucuucuucuucuucuucuucuuuucuuuuuuuuuucuuuuuuuuuuuugagauggagucuugcucuguggcccaggcuagaagcaguccuccugccuuagcccccuuaguagcugggauuacaggcacgcgccaccaugccaggcuaauuuuuguauuuuuaguagagacgggguuucaucauguuggccaggcuggucucgaacuccuaaccucaggugauccacccaccucggcuccccaaauugcugggauuacaggugugagccacugugcccggccgguaaaaccauuuucauuuauucuggcaacaucucuuuauugagcauugugaauauguuagugaaugugcuagaugcucauagauuuauauaaaaaguuagugaagaaggaaagaugguauauuaagugguuagacaaguguucuaaucaguuagaguucagagaaggucaggguaccugauauaaucaagagagagaccuuacagccaggugaggugaauguaccuauaaucccagcuacuuaggaggcugaaaugggaggaucacuugaguccagguuugagaccagcccaggcaacauagcaagauccccaucagauacaccaaaaagacagauuucuuuuuuuuuuuuuuuuuugagacagagucucgcucugucgcccaggcuggagcgcagugacacgaugucagcucacugcaaccuccgccucccagguucaagugauucuccugccucagccuccugaguaguugggacuacagggguacgacaccagaccuggcuaauuuuuguaauuuuaguagagucgggguuucaccauauuggucaggcuggucucgaacuccugaccucaggugauccacccuccuuggccucccagagugcugggauuacaggcgugagccaccaagcccggccaaaaaagagagcucuuauaggcccuuccuugcuuuggagcuuuaucugcucugugaugcuuaucuaaaauagccauaaggucacugauauuuuuaagcauuuggaaauuacuucagcugggugccauggcucaugccuauaaucccaacccuuugggaggcugagguaggagguccuuugagcccagcuugggcaacacagugagacacugucucugcaauuaaaaaaaaaaaaaaguagcugggugccguggcucacgccuguaauuccagcacuaggaggcuugaggauugccugagcucaggaguucaagaccaguuugggcaacauagcaaguccuugucuauauuaaaaguuuuuuuaaauuaucugggcaugguggugugugccuguagucccagcuacuugggaagcugagacagaaggaucacuugaguccaggagauguagacuacagugagcuaugaucacuccacugcacuucagcgugggcggcaaagcaagaucuaguugcaaaaaaaaaaagaacuggcugggugcggcggcuaacaccugcaaucccagcaccuugggaggcugaggccaguggaucaugaggucaggagauugagaccacccuggccaacauggugaaacccggucucuacuaaaaauacaaaaauuagcugggugugguggcacgugccuguaaucccagcuacuccagaggcugaggauggagaaucacuugaaccugagagucggagguugcagugagccgagauugcgccacugcacuccagccuggcgacagagcgagacuccgucucaaaaaaaaaaaaaaaaaagcuucacgccuguaaucccagcacuuugggaggccgagucaaguggaucacgagguguggagaucaagacuauccuggcucacauggugaaagcccgucucuacuaaaaacacagaaaaauuagcugagcgugauggcggacuccuguagucccagcuacucgggaggcugaggcaggagaauagcaugaacccgggagguggagcuugcagugagccgagaucccgccacugcgauccagccugggcgacagagugagacucugucucaaaaaaaaaacaaaaaaacuuagcugggcguggugguaugcaccugugguccuagcuacuugggaggcugaggcuggagcauugcuuuaacauagagagucaaggcugcaguugagcuaugacugugccacuggacuccagcgcaggugacugagacccuaucuuuuaaaaaaagggaaaauuacuugaacuuaaaagguguaauuguuaaagaaaauguagugauuugcucuguuguuacuuauaugugcaugaaugauggagaucuuaaaaaguaaucauucuggggcugggcguaguagcuugcaccuguaaucccagcacuucgggaggcugaggcaggcagauaauuugaggucaggaguuugagaccagccuggccaacauggugaaacccaucucuacuaaaaauacaaaaauuagcugggugugguggcacguaccuguaaucccagcuacucgggaggcggaggcacaagaauugcuugaaccuaggacgcggagguugcagcgagccaagaucgcgccacugcacuccagccugggccguagagugagacucugucucaaaaaagaaaaaaaaguaauuguucuagcugggcgcaguggcucuugccuguaaucccagcacuuugggaggccaaggcggguggaucucgaguccuagaguucaagaccagccuaggcaauguggugaaaccccaucgcuacaaaaaauacaaaaauuagccaggcaugguggcgugcgcauguagucccagcuccuugggaggcugaggugggaggaucacuugaacccaggagacagagguugcagugaaccgagaucacgccaccacgcuccagccugggcaacagaacaagacucugucuaaaaaaauacaaauaaaauaaaaguaguucucacaguaccagcauucauuuuucaaaagauauagagcuaaaaaggaaggaaaaaaaaaguaauguugggcuuuuaaauacucguuccuauacuaaauguucuuaggagugcugggguuuuauugucaucauuuauccuuuuuaaaaauguuauuggccaggcacgguggcucauggcuguaaucccagcacuuugggaggccgaggcaggcagaucaccugaggucaggagugugagaccagccuggccaacauggcgaaaccugucucuacuaaaaauacaaaaauuaacuaggcguggugguguacgccuguagucccagcuacucgggaggcugaggcaggagaaucaacugaaccagggagguggagguugcagugugccgagaucacgccacugcacucuagccuggcaacagagcaagauucugucucaaaaaaaaaaaacauauauacacauauaucccaaagugcugggauuacauauauauauauauauauauauauuauauauauauauauauauauguuauauauauguuauauauauauaacauauauauauguuauauauauguuauauauauauaauauauauauguuauauauauguuauauauauauauacacacacacacacauauauauguauauauauauacacacacacacacaaauuagccaggcauaguugcacacgcuuguagacccagcuacucaggaggcugaggcaggagaaucucuugaacuuaggaggcggagguugcagugagcugagauugcgccacugcacuccagccugggugacagagcaggacucuguacaccccccaaaacaaaaaaaaaaguuaucagaugugauuggaauguauaucaaguaucagcuucaaaauaugcuauauuaauacuucaaaaauuacacaaauaauacauaaucagguuugaaaaauuuaagacaacagaaaaaaaaauucaaaucacacauaucccacacauuuuauuauuacuacuacuauuauuuuguagagacugggucucacucuguugcuuaugcuggucuugaacuccuggccucaagcaguccugcuccagccucccaaagugcugggauuauaggcaugagcuaccgcucccagccccagacauuuuaguguguaaauuccugggcauuuuuuccaggcaucauacauguuagcugacugaugauggucaauuuauuuuguccauggugucaaguuucucuucaggaggaaaagcacagaacuggccaacaauugcuugacuguucuuuaccauacuguuuagcaggaaaccagucucaguguccaacucucuaaccuuggaacugugagaacucugaggacaaagcagcggauacaaccucaaaagacgucugucuacauugaauuggguaagggucucagguuuuuuaaguauuuaauaauaauugcuggauuccuuaucuuauaguuuugccaaaaaucuuggucauaauuuguauuugugguaggcagcuuugggaagugaauuuuaugagcccuauggugaguuauaaaaaauguaaaagacgcaguucccaccuugaagaaucuuacuuuaaaaagggagcaaaagaggccaggcaugguggcucacaccuguaaucccagcacuuugggaggccaaaguggguggaucaccugaggucgggaguucgagaccagccuagccaacauggagaaacucugucuguaccaaaaaauaaaaaauuagccaggugugguggcacauaacuguaaucccagcuacucgggaggcugaggcaggagaaucacuugaacccgggagguggagguugcggugaaccgagaucgcaccauugcacuccagccugggcaaaaauagcgaaacuccaucuaaaaaaaaaaaagagagcaaaagaaagaauaucugguuuuaaauauguguaaauauguuuuggaaagauggagaguagcaauaagaaaaaacaugauggauugcuacaguauuuaguuccaagauaaauuguacuagaugaggaagccuuuuaagaagagcugaauugccaggcgcaguggcucacgccuguaaucccagcacuuugggaggccgaggugggcggaucaccugaggucgggaguucaagaccagccugaccaacauggagaaaccccaucucuacuaaaaaaaaaaaaaaaaaaauuagccggggugguggcuuaugccuguaaucccagcuacucaggaggcugaggcaggagaaucgcuugaacccaggaagcagagguugcagugagccaagaucgcaccauugcacuccagccuaggcaacaagagugaaacuccaucucaaaaaaaaaaaaaaagagcugaaucuuggcugggcaggauggcucgugccuguaauccuaacgcuuuggaagaccgaggcagaaggauugguugaguccacgaguuuaagaccagccuggccaacauaggggaacccugucucuauuuuuaaaauaauaauacauuuuuggccggugcgguggcucaugccuguaaucccaauacuuugggaggcugaggcagguagaucaccugaggucagaguucgagaccagccuggauaaccuggugaaaccccucuuuacuaaaaauacaaaaaaaaaaaaaaauuagcugggugugguagcacaugcuuguaaucccagcuacuugggaggcugaggcaggagaaucgcuugaaccagggaggcggagguuacaaugagccaacacuacaccacugcacuccagccugggcaauagagugagacugcaucucaaaaaaauaauaauuuuuaaaaauaauaaauuuuuuuaagcuuauaaaaagaaaaguugaggccagcauaguagcucacaucuguaaucucagcaguggcagaggauugcuugaagccaggaguuugagaccagccugggcaacauagcaagaccucaucucuacaaaaaaauuucuuuuuuaaauuagcugggugugguggugugcaucuguagucccagcuacucaggaggcagaggugaguggauacauugaacccaggaguuugaggcuguagugagcuaugaucaugccacugcacuccaaccugggugacagagcaagaccuccaaaaaaaaaaaaaaaagagcugcugagcucagaauucaaacugggcucucaaauuggauuuucuuuuagaauauauuuauaauuaaaaaggauagccaucuuuugagcucccaggcaccaccaucuauuuaucauaacacuuacuguuuuccccccuuaugaucauaaauuccuagacaacaggcauuguaaaaauaguuauaguaguugauauuuaggagcacuuaacuauauuccaggcacuauugugcuuuucuuguauaacucauuagaugcuugucagaccucugagauuguuccuauuauacuuauuuuacagaugagaaaauuaaggcacagagaaguuaugaaauuuuuccaagguauuaaaccuaguaaguggcugagccaugauucaaaccuaggaaguuagaugucagagccugugcuuuuuuuuuguuuuuguuuuuguuuucaguagaaacgggggucucacuuuguuggccaggcuggucuugaacuccuaaccucaaauaauccacccaucucggccuccucaagugcugggauuacaggugagagccacugugccuggcgaagcccaugccuuuaaccacuucucuguauuacauacuagcuuaacuagcauuguaccugccacaguagaugcucaguaaauauuucuaguugaauaucuguuuuucaacaaguacauuuuuuuaacccuuuuaauuaagaaaacuuuuauugauuuauuuuuuggggggaaauuuuuuaggaucugauucuucugaagauaccguuaauaaggcaacuuauugcaggugagucaaagagaaccuuugucuaugaagcugguauuuuccuauuuaguuaauauuaaggauugauguuucucucuuuuuaaaaauauuuuaacuuuuauuuuagguucagggauguaugugcaguuuguuauauagguaaacacacgacuugggauuugguguauagauuuuuuucaucauccggguacuaagcauaccccacaguuuuuuguuugcuuucuuucugaauuucucccucuucccaccuuccucccucaaguaggcugguguuucuccagacuagaaucaugguauuggaagaaaccuuagagaucaucuaguuuaguucucucauuuuauaguggaggaaauacccuuuuuguuuguuggauuuaguuauuagcacuguccaaaggaauuuaggauaacaguagaacucugcacaugcuugcuucuagcagauuguucucuaaguuccucauauacaguaauauugacacagcaguaauugugacugaugaaaauguucaaggacuucauuuucaacucuuucuuuccucuguuccuuauuuccacauaucucucaagcuuugucuguauguuauauaauaaacuacaagcaaccccaacuauguuaccuaccuuccuuaggaauuauugcuugacccagguuuuuuuuuuuuuuuuuuuggagacggggucuugcccuguugccaggauggaguguaguggcgccaucucggcucacugcaaucuccaacucccugguucaagcgauucuccugucucaaucucacgaguagcugggacuacagguauacaccaccacgcccgguuaauugaccauuccauuucuuucuuucucucuuuuuuuuuuuuuuuuuugagacagagucuugcucuguugcccaggcuggaguacagaggugugaucucaccucuccgcaacgucugccucccagguugaagccauacuccugccucagccucucuaguagcugggacuacaggcgcgcgccaccacacccggcuaauuuuuguauuuuuaguagagaugggguuucaccauguuggccaggcuggucuugaacucaugaccucaagugguccacccgccucagccucccaaagugcuggaauuacaggcuugagccaccgugcccagcaaccauuucauuucaacuagaaguuucuaaaggagagagcagcuuucacuaacuaaauaagauuggucagcuuucuguaaucgaaagagcuaaaauguuugaucuuggucauuugacaguucugcauacauguaacuaguguuucuuauuaggacucugucuuuucccuauagugugggagaucaagaauuguuacaaaucaccccucaaggaaccagggaugaaaucaguuuggauucugcaaaaaaggguaauggcaaaguuugccaacuuaacaggcacugaaaagagaguggguagauacaguacuguaauuagauuauucugaagaccauuugggaccuuuacaacccacaaaaucucuuggcagaguuagaguaucauucucugucaaaugucgugguauggucugauagauuuaaaugguacuagacuaauguaccuauaauaagaccuucuguaacugauuguugcccuuucguuuuuuuuuuuguuuguuuguuuguuuuuuuuugagauggggucucacucuguugcccaggcuggagugcagugaugcaaucuuggcucacugcaaccuccaccuccaaggcucaagcuauccucccacuucagccuccugaguagcugggacuacaggcgcaugccaccacacccgguuaauuuuuugugguuuuauagagaugggguuucaccauguuaccgaggcuggucucaaacuccuggacucaagcagucugcccacuucagccucccaaagugcugcaguuacaggcuugagccacugugccuggccugcccuuuacuuuuaauugguguauuuguguuucaucuuuuaccuacugguuuuuaaauauagggagugguaagucuguagauagaacagaguauuaaguagacuuaauggccaguaaucuuuagaguacaucagaaccaguuuucugauggccaaucugcuuuuaauucacucuuagacguuagagaaauaggugugguuucugcauagggaaaauucugaaauuaaaaauuuaauggauccuaaguggaaauaaucuagguaaauaggaauuaaaugaaagaguaugagcuacaucuucaguauacuugguaguuuaugagguuaguuucucuaauauagccaguugguugauuuccaccuccaagguguaugaaguauguauuuuuuuaaugacaauucaguuuuugaguaccuuguuauuuuuguauauuuucagcugcuugugaauuuucugagacggauguaacaaauacugaacaucaucaacccaguaauaaugauuugaacaccacugagaagcgugcagcugagaggcauccagaaaaguaucaggguaguucuguuucaaacuugcauguggagccauguggcacaaauacucaugccagcucauuacagcaugagaacagcaguuuauuacucacuaaagacagaaugaauguagaaaaggcugaauucuguaauaaaagcaaacagccuggcuuagcaaggagccaacauaacagaugggcuggaaguaaggaaacauguaaugauaggcggacucccagcacagaaaaaaagguagaucugaaugcugauccccugugugagagaaaagaauggaauaagcagaaacugccaugcucagagaauccuagagauacugaagauguuccuuggauaacacuaaauagcagcauucagaaaguuaaugagugguuuuccagaagugaugaacuguuagguucugaugacucacaugauggggagucugaaucaaaugccaaaguagcugauguauuggacguucuaaaugagguagaugaauauucugguucuucagagaaaauagacuuacuggccagugauccucaugaggcuuuaauauguaaaagugaaagaguucacuccaaaucaguagagaguaauauugaagacaaaauauuugggaaaaccuaucggaagaaggcaagccuccccaacuuaagccauguaacugaaaaucuaauuauaggagcauuuguuacugagccacagauaauacaagagcguccccucacaaauaaauuaaagcguaaaaggagaccuacaucaggccuucauccugaggauuuuaucaagaaagcagauuuggcaguucaaaagacuccugaaaugauaaaucagggaacuaaccaaacggagcagaauggucaagugaugaauauuacuaauaguggucaugagaauaaaacaaaaggugauucuauucagaaugagaaaaauccuaacccaauagaaucacucgaaaaagaaucugcuuucaaaacgaaagcugaaccuauaagcagcaguauaagcaauauggaacucgaauuaaauauccacaauucaaaagcaccuaaaaagaauaggcugaggaggaagucuucuaccaggcauauucaugcgcuugaacuaguagucaguagaaaucuaagcccaccuaauuguacugaauugcaaauugauaguuguucuagcagugaagagauaaagaaaaaaaaguacaaccaaaugccagucaggcacagcagaaaccuacaacucauggaagguaaagaaccugcaacuggagccaagaagaguaacaagccaaaugaacagacaaguaaaagacaugacagcgauacuuucccagagcugaaguuaacaaaugcaccugguucuuuuacuaaguguucaaauaccagugaacuuaaagaauuugucaauccuagccuuccaagagaagaaaaagaagagaaacuagaaacaguuaaagugucuaauaaugcugaagaccccaaagaucucauguuaaguggagaaaggguuuugcaaacugaaagaucuguagagaguagcaguauuucauugguaccugguacugauuauggcacucaggaaaguaucucguuacuggaaguuagcacucuagggaaggcaaaaacagaaccaaauaaaugugugagucagugugcagcauuugaaaaccccaagggacuaauucaugguuguuccaaagauaauagaaaugacacagaaggcuuuaaguauccauugggacaugaaguuaaccacagucgggaaacaagcauagaaauggaagaaagugaacuugaugcucaguauuugcagaauacauucaagguuucaaagcgccagucauuugcuccguuuucaaauccaggaaaugcagaagaggaaugugcaacauucucugcccacucuggguccuuaaagaaacaaaguccaaaagucacuuuugaaugugaacaaaaggaagaaaaucaaggaaagaaugagucuaauaucaagccuguacagacaguuaauaucacugcaggcuuuccugugguuggucagaaagauaagccaguugauaaugccaaauguaguaucaaaggaggcucuagguuuugucuaucaucucaguucagaggcaacgaaacuggacucauuacuccaaauaaacauggacuuuuacaaaacccauaucguauaccaccacuuuuucccaucaagucauuuguuaaaacuaaauguaagaaaaaucugcuagaggaaaacuuugaggaacauucaaugucaccugaaagagaaaugggaaaugagaacauuccaaguacagugagcacaauuagccguaauaacauuagagaaaauguuuuuaaagaagccagcucaagcaauauuaaugaaguagguuccaguacuaaugaagugggcuccaguauuaaugaaauagguuccagugaugaaaacauucaagcagaacuagguagaaacagagggccaaaauugaaugcuaugcuuagauuagggguuuugcaaccugaggucuauaaacaaagucuuccuggaaguaauuguaagcauccugaaauaaaaaagcaagaauaugaagaaguaguucagacuguuaauacagauuucucuccauaucugauuucagauaacuuagaacagccuaugggaaguagucaugcaucucagguuuguucugagacaccugaugaccuguuagaugauggugaaauaaaggaagauacuaguuuugcugaaaaugacauuaaggaaaguucugcuguuuuuagcaaaagcguccagaaaggagagcuuagcaggaguccuagcccuuucacccauacacauuuggcucaggguuaccgaagaggggccaagaaauuagaguccucagaagagaacuuaucuagugaggaugaagagcuucccugcuuccaacacuuguuauuugguaaaguaaacaauauaccuucucagucuacuaggcauagcaccguugcuaccgagugucugucuaagaacacagaggagaauuuauuaucauugaagaauagcuuaaaugacugcaguaaccagguaauauuggcaaaggcaucucaggaacaucaccuuagugaggaaacaaaauguucugcuagcuuguuuucuucacagugcagugaauuggaagacuugacugcaaauacaaacacccaggauccuuucuugauugguucuuccaaacaaaugaggcaucagucugaaagccagggaguuggucugagugacaaggaauugguuucagaugaugaagaaagaggaacgggcuuggaagaaaauaaucaagaagagcaaagcauggauucaaacuuagguauuggaaccagguuuuuguguuugccccagucuauuuauagaagugagcuaaauguuuaugcuuuuggggagcacauuuuacaaauuuccaaguauaguuaaaggaacugcuucuuaaacuugaaacauguuccuccuaaggugcuuuucauagaaaaaaguccuucacacagcuaggacgucaucuuugacugaaugagcuuuaacauccuaauuacugguggacuuacuucugguuucauuuuauaaaagcaaauccaggugucccaaagcaaggaauuuaaucauuuugugugacaugaaaguaaauccaguccugccaaugagaagaaaaagacacagcaaguugcagcguuuauagucugcuuuuacaucugaaccucuguuuuuguuauuuaaggugaagcagcaucugggugugagagugaaacaagcgucucugaagacugcucagggcuauccucucagagugacauuuuaaccacucagguaaaaagcgugugugugugugcacaugcgugugugugguguccuuugcauucaguaguauguaucccacauucuuagguuugcugacaucaucucuuugaauuaauggcacaauuguuugugguucauugucuccuuaaauuagacuguaagcaccuugauggaacucauacuaccuuuuauuucacacacacgcacacgcgcacacacagccuacacauacacugccuagcucauuguagcauacuaaauacugauuuuaaugaauaagcuaaaccuucgaaacccauuugcuaaucccagcacuuugggaggccaagguggguggaucaccucaggucagaaguuugagaccagccuggccaacauggugaaaccccacaucuacuaaaaauacaaaaauuagcugggcgugguggccaaugccuuguaaucccagcuauucuggaggcugagacaggagaaucgccugaaccugggaggcggagguugcacugagcugggauuguaccacugcacuccagccugggugacaaagugagacuccaucucaaaaacaaacaaacaaaaacacaucauuuccccuauagcaaaaacaugacggcacuuacuguaucaagagaggugagaaaaaggagccacagcaggaugauucaagggacucugcauagcuccauuuuaagaauaugccuacugcaggucagagaagguaagcaaacugccuaaggccacacagccagguacagaacucucaccaauauuauugccagcaaucgcaauuuugguguuuauucuugguaccaaguuggagacuauaggguucucuuccuaauagagaccaucuagccuuucacuguuuuguggauacuucuuucucuucuucuuuuuuuuuuucccuuuuaaaaucuaguuauuuuuuucuuuuugguuucuuugacacagggucucuuacucuguuacccaggcuggaauggaguagugcagucaugguucacuguagcuuugacuuccugggcucaagcgauccuccuaccucagcuucccgaguagcugggaccacaggcgcccaccaacaccuccagcuaauuuuuaaguuuuuacuagagacaacaucucacuauguugcccaggcuggucucaaaauccugggcucaagugaucccaccucagccucccaaaaugcugggauuacaggugugugcaaccacgccuggccuauuuuuuuuuuaauugcucauaaaucaucuuuuuucuuuaaaaaaaagaaagaugggaggcuaaagcaggagaaucacuugaacccaggaggcggagguugcagugagcugagaucaugcugcugcucuccagccugggcaacaagagugaaacuccaucucaaaaaaaaaaaaaaagaaaguacacaauuuuacuuucuggaccuaauggucaaggccaauaauuuggucaccuaugaaauaaauaaaagcuuuaccauauauaugaccauuugauaauguaauaugaaauguuuauguacuaaaggcagaauagucuagaaaaaacauucuguaucacaacgucuaaaaaugaauaucaucuucaucauagaaccaggcucuuucuccuaauuuuuuuuuuugagauggaguuuugcucugucacccaggcuggaaugcaguggcacaauuuuggcucacugcaaccuucagcucccagguucaggaucaagugauuuucgugcuucagccuucuaaguagcugggauuacaggugacugccaccacacccagcucauuuuuuuguauuuuuuuaguagagagaggguuucaccauguuggccaggcucgucucgaacuccugaccucaaauaauccacccgucucagccucccaaagugcugagauuacaggcgugagccaccaggccuggccuccuaauuuuuauuuguagaaguggcaccaaaauuuuccaaguucucaugcaaaaauucaggcucaucucaguuuauuuuuuucauuuauuuaucucccacuaaauugacaacuucuaauaauuagguugguucuuuguauucccagcacaggguucuaugcagaauacacacacagcaguugcuggcaauaauauuggugagaguucuguacugggcuaugugaucuuagacaguuugcuuauguucucugaccugccguaggcacauucuuaaaaugaagcuguucagacccccucgauucauccugcuguggcuucuuuuucccaccuaaaucuuaaauacccuuuuagcugcuaguaagugaaugauguuuuuuuaugaacuuucugaagucagauuagaugaaguugagaaaagccugauauucuuauaaaguuauauaugugcaucauagaaaacuuagaaaauacagauaaacaaaaaucauccauggacgaaccuugaagacauuguguuaacugaaauaaaccggacaccaaaggacacauguuauaugcuuccacuuauaugagauaccuagaauaguuacauuugguuacucuggguacauugccuauagauaagccuugcuccacaaggagcaguuaaaaaaaaaaaaaagauaaauucauaggauggaagguagaauagugguuacuagggacuuggggagggggaaauggggaguuacuguuugaugagugcagauuucaguuugggaugaugaaaaaguucuggagauagauaguggcaaugguaacacaacagugugaaaauaaugccacugaacuguacacuuaaaaugauuaaaaugauaaguuaauuguaauuuguguuauccagaaaugguuagcaauuuauugguguauauucuuuuaguauuccugugugugcacaggggugcuuguauauacuuuaucuuuaaaauauauccaggaagcuaggcacaguggcuuacaccuguaaucccagcacuuugggagggugaggcaggaagauugccugagccccggaggucaaggcugcagugaguugugaucacgcuacugcacucuguucugggcaaccccugucugggaaaaaaaaaaaaauuagugaggcuuaguggugcacaccuguagucucagcuacuugaguggcugggguaggauugcuugaucccagcaaguugaggccguggugagccaugauggugccacugcacuccauccugggugauauggugagacccugucucaaaaacaagaaauccagauaauucugugcauuauaaucuagcuuuuacuggaucauuaaaauucuuuuuucuuuuuuuuuuuuuuuuucugagauggaguuucacucuuguugcccaggcuggagugcaguggugugaccuuggcucaccgcauccucugccucccggguucaugcgauucuccugccucagccucccgaguagcugggauuacaggcaugugccaccaugcccagcuaacuuuguauuuuuaguagagacaggguuucuccauguugaccaggcuggucucaaacuccuggccucaagugauccacccaccucggccucccaaagugcugggguuacaggcgugagccaccgcacucagccugggucguuaaaauucuuaagugacuucauuuuuaauuacuauaugggauucuaucuuuccaguguaucaugauuuauuugaccuauugcugaauguuggagguuucaggguaagaggcacaguuugcuauuauguacaucacuauaguggcauccugauagcuaaauauuugccuacaucccugauuauuuccuuagucuaaauuacugggacuaggauuuugguguuugauacauguuacuaaauuguuuuuuagaaagauuaaaccaguuuaugcucuuccagccccugugguauaugauaguucccauuuuccuguaccuugccaacacugggugauauccaguuuuaaaaucuaaaucuugcauugcuaugagaacuacaauuagagaaggcuuaucuucuacugcccauucucuguacagagcaaaucccucuagaccugaagccccuuggaguugucaagaaaccuuugagaugacuccccacucuguaucugagcugucaccaguauucuccacuucuucaggauugccauggcaacuaaauugaugaaaagauuuaggaggccuuuucucucuuugcaauuccuaugauccuuuuugaauguggguuugggacucugucaauauacccaucaucuaauucuguccauuguguuuuaaaguuuaagguugcaauuucugauuacaucugccuuagccauacuguauuauauuugacauucaauauacaauguccuuguuuuucuguauuucuaaucuuauucccagagaugugucuauuuguucaggauucauuuugcaacguguuuuuacuaagcaucuacccaaaaccguugaagucagauuucaggcugucuuacgucuaaaguagcacaggcaggaaaaacuauugaagugggauuuuuuuuucccuuuuuguacugaaccgagaaaaaguauauagaugauagagaauuccuaauuugguaucauugauaucuggguuuuuguuuguuuuuacagaagacugauuaacuauacuuauuuauuaauuuaucuucucauuaauaaacacuugcugagugcuuacugucugcuaggcauuagggagacaaauaugauuaagggaagcuuccuccuaucaaggucauguguuccauuuggguauacuaaugcauuagcaauguaaaucaaguagugagagaucaucuguucccgauaggagauggauuauugguggggacuucuguguguguguguguguguguguguguguguguguguguauguaugugauaaaauaaauauaggaaauguuaauuauagauucuaaguaguagauauauaaacacucauugcaaaguugcuucaaguuuucuguauauuugaaaauauucacaacaugucgacaaaacuagcaugauaaagccacuauuugugcuaagacuucagcuuguaucuggauuaggcuuauuauguaguaguaggaacauuagaaauaguuuuaacucauuaaauacacauguuuuaugggaagguuuuauauauauauuuauauguaaugaaugugaacaaacaagggucagauauacacucugcuucccuccagaccaguuccggcugcucugcugcacauuucaggagucuuauuagaauuagccacauucugcccacuugcccuuacuucucauauuucacaacuccuccugguggggacuuaaggagacauucaaacuaggccuugaaagaugagaauuuuuccaaguggaaaaagaggaguggcagcaaguaagguaaagguacagagucauggaauucccaggaaacguaaaguugucauguguuauaggaaaacaacuugugugagggguguugggagaaaugagagauaauaccaggguauaaagggccuuuugaaugcuauguugaggaauuuuauccuaauggcaguaaugacuaacaauuauauaguguucaaaaaguauaaaucagcagugguauaccacuaaggguuuuuuucuuuucuuuuuuuuuuugagacagaguuuugcucuguugcccaggcuggagugccguggcacgaucucagcucacugcacuuccgccaccuggguucaagugauucuucugccucagccaguguuucacugugauggccaggauggagcacuaagggucuuuauggaagaaaaagacaugauaaacaaggcuuuuagggaacuucuacaguaauguagcuguauuaaaaguagagaucagagcagcauaguagaaguagaaggcuagagcuaauugaaggagcacuucagaauuagaaucaagaagucuuagaaaccuauugguuuuauucucccuaauguauuuggccacuuaccugcuggggaauuugucuaaguuauaaaaaauaauuccuuugggaaacccaaaggaaaguuaucuauuaauaauuaccccacuacuuuuucugauuuauguaauggccacguagagguuagaugugaugguugugacaguagugacuaauacagccugugaagcauuuuggucagauaucuaugugcuuucauuccagguugacugaggcaagacuuuggcuaggguuugaucagugauguaacuacucacgaguaccacgugguggcaauggcauugcugcagaccuuggcagcaaagcaguguuagaguagcaguagaaaccuuugugaagcuaggaauacauuuucuggucauaaaaaccuccugaaaauugugaacucaguguagcaggagaaagaagauggcuuguuuuuaguaaagggcaaagucauuuuuaaggaucagaagaagaaacggagagugaaacaauguguuccugcccuacucccccacuggacuuuuuggcaaccauugcuguuccuucuaaaagugauuuuuaaacauguauauuuugaagccaggcacagugacucacgucuguaaucccagcacuuugggaggccgaggcgggcagaucaccugaggucaggaguucaagaccagccuggccaacauggugaaaccccgucucuacuaaaaauacaaaaauuaggccaggugugguggcucacgccuguaaucccagcacuuugggaggccgaggcgggaggaucauguggucaggagauccagaccauccuggcuaacacggugaaacaccauuucuacuaaaaauacaaaaaauuagcugggcaugguggcgggcgccuguaaucccagcuacucaggaggcugaagcagaagaauggcuugaaccugggaggcggagcuugcagugaaccaagauugcgccacugcacuccagccugggcaacaaagugagacuccgucucaaaaaaaaaaaaaaaaauuagucgggcaugguaacaggugccuguaaucccagcuacuugagaggcugaggcagggagaauugcuugaaccagguaggcggagguugcagugagccaagaucgcaccacugcacuccagccuggggcaacagagcaagacugucucaaaaaaaauaaauaaauaaaauaaauucuuaagaaggauauuuuggaaaacuccuuacauaccuaaauucuuuguuuaucaaauacuuggacuuagcacacucuucuuugaaauggaccaauaaacaacaggagcccauaagcaaaaagaacucauuauuuuaaaaacaguaacuauccuuacaggcuuucucagggcucuuucuguuggauccuucccucucacagguccuugcuaaugaucucuagguggacacauucuagaugagaugucccugucuagaauggcagcaccaugagggcuauauccucaguacuaggacagcgccuggugcuuaauagauaguaaauaguugucuaauuaacugagcaaacagauagauucaugaauuagcuuuuugcuuuuucuguuagaaacuaaagguucaggucaggcacaauggcgcaugucucuaaucccagcacuuugggaggccgaggcgggcugaucacuugaggucaggaguucaagaccagccuggccaacauaguaaaacccuguuucuacaaaaauuaccaaaauuagccgggcgucuuggcaagcaccuguaaugccagcuacuugagaggcugaggugggagaaucgcuugaaccugggaggaagagguugcagugagccgagauggugccaaccugggugacagagggagacuuaaaaaaaaaaagaaagaaagaaagaaaagaaacuaaagguucaaagaaucccagaaaaggaagaguccucacaagccaguaaucuaggcaggauuacugauaguauuuuuauauuuguuguauuuuuauaaaaugccauagauagagggcuuuuuucaacauuacaucagucuaaaaaucacacauuuuuauaugaacuaaccuaaaugucugaugaaucucacaacaccaagucuuugaaaugugcccauauaaauaaaauguuaacagauucaugcuaauuuuaaauaucgauaguguuuaaaugccuuaauuauuuuuucacucccuagcuuuaaaagaaaauaaccaacuucaaaaggacaucacaauaacaucaagucuauuugggggaauuugaggauuuuuucccucacuaacaucauuuggaaauaauuucaugggcauuaauugcaugaaugugguuagauuaaaagguguucagcuagaacuuguaguuccauacuaggugauuucaauuccugugcuaaaauuaauuuguaugauauauuuucauuuaauggaaagcuucucaaaguauuucauuuucuuggugccauuuaucguuuuugaagcagagggauaccaugcaacauaaccugauaaagcuccagcaggaaauggcugaacuagaagcuguguuagaacagcaugggagccagccuucuaacagcuacccuuccaucauaagugacucuucugcccuugaggaccugcgaaauccagaacaaagcacaucagaaaaagguguguauuguuggccaaacacugauaucuuaagcaaaauucuuuccuuccccuuuaucuccuucugaagaguaaggaccuagcuccaacauuuuaugauccuugcucagcacauggguaauuauggagccuugguucuugucccugcucacaacuaauauaccagucagagggacccaaggcagucauucauguugucaucugaguaccuacaacaaguagaugcuauggggagcccauggaagauacaugguauacaacauagcucuugcucuauuggaagcuaaguggaaugggagaaauuggugacaggcaaccccauaauuucagaaagcuaugaaaaaguacucagacauauuccuuauaacacuggugucacaucacaaagaccuauuuaaugugcuucugauuuauagggagagacauccuauacuucaggaacugcacuuugauccacagaaagccuagugauguagagcuccuguuaguucaaaaggaaaagaaaagaacaacacagaaagccuaauuaugcaauagagucaagugcuuuauagcaauguuacaguuaucaaaaaaaauccagauggaccucugagaggaugccauuggaguaaccaggcagaugcaguugaucagagcugacuuccuauaagaagugagcacugagcugaggaauaauggcauaaaugaaggaaagugagauggaaauuugaguuuuuaauuggaaagacaauacaucaggcagauuuuuaaauaggggcaaacaaacagacacauaggagaugcuaggcaugggguccccacuaggaugcugcuuagaaacaugcagggguggugaguacucccaaaguacacuucauuccuagcucagugauucuuaucugaguguuaaaguuccuucuucagcaccccguuccacaguccaacugggaacuuuaagaccuuucuuggagucuuucuaggaacucaagucugcuacuuauacagaacaguggcuuugguccccaguugugccuugcaguauuuuuguguucaggaagaaacaguagcucuuggauaaagaagcuagcuagaaacucuguugcuauggcagugcuucaaaauguauuuccuuaaaugcuuucuuuguaacuaucuucauuuaguucaucucucagauaaugagagaucagagucccauccccaguauaauacucuucuuuaggguacuuucaccaucuucagucuaaacacagacuagacuuucaauuauaauguguaagauuuaaaauguuauuauugugugacuuugaauaucuguguaaaucuacuaucuccucuuugguauauacguguguuuauuuuuuucuggagaucuguaacugaaaugcuuaauuucugaauuguuuuggauaucacaacuuaauaccaacauaaguuuugagccuuuuucucccuaaaucuggugugagucuaacugaaacucaaaugaacuuuuuaaaaauaauuuuuucuuuucuuuaauuuuuuuuuuaaguagagacagggacgcacuguuaacuaggcuggucuugaacuccugaucuugagccauccuccccgaccugagccucaccuuauagagagggucuugcucuguugcccaagcuggagggcaguggcauaaucacagcucacugcagccucucgaccuccucaagcgauccuccugccuuagccucccaaguagcugggacuauaggcguccaccaccauacccagcuaauuuuuuuuuuuauuuuuuguagagacaaggucucccuauguugcccaaguuggucucaaacuccuggacucaagcaguccucucaccucagccucccaaagugcugggguuacaggugugagccauggcaccuggccagaacuucuaguaaaaagaauauuguugccggguacgguggcucacgccuguaaccccagcacuuugggaggccaaggcaggcgaaucaccugaggucgggagcucgagaccagccugaccaacauggagaaaccacaucucuacuaaaacuacaaaaaauuagccgggcgugguggcacaugccuguaaucccaccuacuugggagcuacggugccuggccuaguuuauuauuucuuaauaucuguugucuuccagugucuuccuuaauucuucacaauacccuguacaaugcuuagcacacagugggcagucuguaaguuuauuaaauguuugguguggcccauacuuccuauccacaaagaauguaacauguuaagacaucuagaugagggaaugauuuaagaggaacuacaauaauauucugaaacuuggacucuggaucucugcauuuagacuuuccuaaaccagccagcaaguagaucaucaugucacaaggcuuagguugggcuugcuguucagagaaugaauuaaggauuaaggagaaaaaaaagcagaaagguuuugcucuguuuuucagguucuauugaguuguuaacuucuaacaaguuaucuuauuugcuucauugcaugaggcccauuguaguaagaagaggaauuuauaugcuaaauguucuggugauagaaugacuuuucuuuuuuuuuacaguccaaaggucuuuuuuuuuuuuuuuuaacaccuauuaugccaugaauucauagggaauagguuccagcugcucaggcuccuucccauugguucucacaaagugugcuucucuggguggagcaggcuggugcuucaguugaacccacguaccuuucucuuuggcuucuuucuuuuucugaucauuuuccuucacgcguuucaggaagcugucuuggcucuuagaguguuuaaugugcucaauacgcacauuaauucucuuggcaagaaucuugcccuuaacuuguuuacagcgaugccaacagcaugcugggucacguuguagacuuuuccaguuuugccaugguaacacuuguggggcauuccuuuuugaacaguacccguucccuugaugucuacaauuucaccuuucuuacagauucgcauauacauggccaaaggaacaacuccauguuuucuaaaaggccuagagaacauauaucaggugccucuccucuuucccuuuguguucgucauuuuggcaaauuacugaaagauggugguucuggccaaaaggaggaaugacuuuuuaauagcuguguuuguaucugagccuucccucugccuuucauuuuuuuuguuuuguuuuguuuuguuuuuguuugagaugaaguuucacuuuuguugcccaggcuggagugcaauggugugauuucggcucauuacaauguccgccucagccuccuggguagcugggauuacaggcacccgccaccacgcccagcuaauuuuuguauuuuuaguagagacaggguuucaccauguuggccgggcuggucucaaacuccugaccucaggugaucuguccaccucggccucucaaagugcugggauuguaggcgugagccacaucaccuggccacuuuuuuaacucuuuccaaugguuaauuccguuugauaugguuccuuggaacuugcacauuacccuuuaucaauuaucacccuguauuggggguggggaggaugauaccucucuucauaguuagauccuacuuacuuucaacagaguucuuaacaauccuagaaacucacagguccagaaaagacaagcauaaaggaaacuauaaauaaugcauuugaagacuaacucaggaaaucaaugauuauuuccccccaggcuacccagugucuuaaaaaaacaguuuaauuaauacaaucuuuuguuucaauuuucuaccuauauuuauggcuuuuagcuuuucuaauaaaagcucaaaaugaauuacagucaucagugacuuuuuaaugaauagaagacuuuugcaauuuuuaacuauuuguuuuuacuuauuaaauauuuccgccuuggccaggcaugguggcucacgccuauaaucccagcacugugagaugccaaggcaggaggaucacuugaguuuaagaguucuagaccaggcuggguaugguggcucaugccuauaaucccagcacuuugugaggccaagguuggcggaucaccugaggucaggaguuuaagaccagccuggccaacaugguaaaaccccaucucuacaaaaaauacaaaaauuagccaaggggugguggugggcaccuauaaucccaucuucuugggaggcuaaggcaggagaaucgcuugaaccuggaggcagagguugcagugagccgagaucaugccacuguauuccagccuggguaacagagcaagacucugucucaaaaaaaaaaaaaaguuugaaaccagccuggucaacacagcaagacacccaucucguugaaaaauaacggucgggcgcaguggcucacgccuguaaucccaucacuuugggaggccgaggcaggcagaucaccugaggucgggaguucgagaccagcgugaccaacauggagaaaccccaucucuacuaaaaauacaaaauuaguugggcgagguggugcauaccuguaaucccaacuacuugggaggcugaggcaggagaacagcuugaaccugggaggcagagagguuguggugagccaagaucaugccauugcacugcagccugggcaacaagagcaaacuccaucucaaaaaaaauaaauaaauaaaaauaaauaaauaaguacuucugccuuuaagccacuuccuagaaggcaguggcacaaagugauacauuuggaggaguaaauauauuacaaaaugaauuaggcugggcgcaguggcucaugucuguaauccccgcacuuugggaggccaaggcggguggaucacuugaggucaggaguucgagacuagccugaucaacaggguaaaaucccaucucuacuaaaaauaccaaaaaaacuagcugggcgugguggcaggcaccuguaaugucagcuacuaggaaggcugaggcaggagaaucgcuugaacccaggagguggagguugcagugagccaagauugcaccauugcacuucagcuugggcaacagagugagacuccgucucaaaaaaaaaaaaagaacuaacaugccagaacuuugccuucaguauguuuugugauuuuucccuucuugugccauuucaucauuaguuccauguauuauuuaagauuucuuaucaaccagcaccuugggauuuuuuuguguauguguugguuuaggggguuuauuuguuuuuuucuuuuuuuucgguaauugaaaaugugaagcaaaaugucaccuguuuuuucuuucaugucugacacucaugucuuguuuacccccgacaugcagaagcugaaauccccauuucauacagucuucaauguggaggcaguagggauggagaaaauaauguacuuugugcucuccgguacucuuucuuuccuauugucugaggggauuugggcauaauuuauuuugcugcagagauaaaaauuuguuauauauauuuuuuaucauucagggccaaggaauauagauuuuuuuuuucagccuugucucagcugggugucuuuauuuacucugucuuaaaguguuccuuuuauuaucauuauuauuuuuuaaucauugaauuccauuuggugcuagcaucugucuguugcauugcuuguguuuauaaaauucugccugauauacuuguuuaaaaaccaauuuguguaucauagauugaugcuuuugaaaaaaaucaguauucuaaccugaauuaucacuaucagaacaaagcaguaaaguagauuuguuuucucauuccauuuaaagcaguauuaacuucacagaaaaguagugaauacccuauaagccagaauccagaaggccuuucugcugacaaguuugaggugucugcagauaguucuaccaguaaaaauaaagaaccaggaguggaaagguaagaaacaucaauguaaagaugcugugguaucugacaucuuuauuuauauugaacucugauuguuaauuuuuuucaccauacuuucuccaguuuuuugcauacaggcauuuauacacuuuuauugcucuaggauacuucuuuuguuuaauccuauauagguuuuuugaaccuauaacauaagcuacaacaugagaaaugugcgguuagauagauaugucccuucugaaggucagaaaaaaauauaauggagguaaaaccugaacaagcuuggaaacugaugguagacuucuucaaggcagcccuugcccuaauuaaaauucuugucuuucuagaaaaagucuagcuguugauuuaccacagaaaauaauaauaauaauuacuauuauuauuauuuuuugagacagggucgcccugugucaccuagauugcaguggugcagucauggcucacugcauccuccguuuuucaggcucaagcaauccucccaccuuagccuccugaguagcuggguccacaagcaugcgccacccacacccacuaaguuuuuguauuuuugguagagauggaguuuuaccuuguugcccaggcuggucucaaauuccuggacucaaguaguccgcccgccuugcccucccaaagccagaaaacauuuagaauaucuuucagagauguguauuuacaccacuauuaacacagggcuguauagcaguccaguacuggacuauguaguccaguacuauucuuuuccuuacuggagggccaggcgugguggcaggugccuguaaucccagcuacucaggaggcugaggcaggagaauugcuugaaccugggaggcagagguugcagugagcugggaccgugccauugcacuccagccugggcgacagagcaagacuccgucucaaaacaaaaaaaaaaagagagagagagcaguaauucaggucucacccaucuucaauccagggggccuagccuuaguauuugacccauaguaagcacccaauaauuguuuaaauuaauuaaccucugaggcccuuuaaaucuguugauaaguaucuuauuuugcaaaguccuaagcacuuggaagagcagaggaacuauuuacuggguguguaugcuuuucuaacaauauuuuauagcuggcuuuuguuuuuagaaugaauuugaacauugaaaaggcaggcaauagggaugauucugugaauucugcuaaaacugaguagaaagaaugaguguagagaugucgacauugaucaacuuucuaucuucauaagagaucugauucuaacauauccauuuagacucaaguagaauauuguguauagagugaguggcagugaguaauuugguaaaaauuugcugaccugcuuuuauucuuuccuccuuucuuucuuccuuuccuuccuuccuuccuuccguccuuuccuuuccuuucccucccuuccuuccuucuuuccuucuuucuuuccuuucuuuccuuucuuccuuucuuuccuuccucccuuccuuuucuuuucuuucuuuccuuuccuuuucuuuccuuucuuuccuuuccuuucuuucuugacagagucuugcucugucacucaggcuggagugcaguggcgugaucucggcucacugcaaccucugucucccagguucaagcaauuuuccugccucagccucccgaguagcugagauuacaggcgccagccaccacacccagcuacugaccugcuuuuaaacagcugggagauauggugccucagaccaacccaaccccauguuauaugucaacccugacauauuggcaggcaacaugaauccagacuucuaggcugucuugcgggcucuuuuuugccagucauuucugaucucucugacaugagcuguuucauuuaugcuuuggcugcccagcaaguaugauuuguccuuucacaauugguggcgaugguuuucuccuuccauuuaucuuucuaggucauccccuucuaaaugcccaucauuagaugauaggugguacaugcacaguugcucugggagucuucagaauagaaacuacccaucucaagaggagcucauuaagguuguugauguggaggagcaacagcuggaagagucugggccacacgauuugacggaaacaucuuacuugccaaggcaagaucuagguaauauuucaucugcuguauuggaacaaacacuuugauuuuacucugaauccuacauaaagauauucugguuaaccaacuuuuagauguacuagucuaucauggacacuuuuguuauacuuaauuaagcccacuuuagaaaaauagcucaaguguuaaucaagguuuacuugaaaauuauugaaacuguuaauccaucuauauuuuaauuaaugguuuaacuaaugauuuugaggaugagggagucuugguguacucuaaauguauuauuucaggccaggcauaguggcucacgccuguaaucccaguacuccaggaggccgaggcagguggaucagcugaggucaggaguucaagaccugucuggccaacauggugaaacccugucucuacuaaaaauacaaaaaaauuaacugggugugcuagugcaugcccguaauccuagcuacucuggaggcugaggcagcagaaucacuugaacccgggaggcggagguugcggugagccaagaucacaccacugcacuccagucugggugacagagcaagacuccaucucaaaaaauauauauauauauauauacacacauauauuuuauuucaacuguuagacaagaguccaaaggccaaagaauaaaguuuuaggccaguccuuuauuagaaaaugagucaaaucccaaagcaaguuuuuuuuaugaguuaaugaauauaaaugacuacauauuuuaugccuuaaaaaucacuuuuaaugaaugguguuuuauggcuuguaaaucagaguuuuaaucaguaaagaaaguuuuuaauccucaaaaacacguuaucauaaaagacacuguuuggcaucaaaugugguauuuggccauguucauuagggucauuuuaggaaucucauacauucuacuuagcuaugcuuaauuccugauaccauggcauuuucugaaauguuucaaggaugacaucucugcuguuuuuaauuugguaaugauaucugcugauuuauuaagugaaaaaaguaauggugucauuaccuuggaugaagaaacaaaaauaaagcauuugccacauuuuucaacuuuuuuuuccuuucuuacaaaauugcuauaagcucauugcccccaaauuggacaauauagggaauaaaaaagauaauuuggggugggguuagacacgggucuuguuauguugccgaggcuggucucuaacuccuggccucaugcaaucuuccuaccuuggccucccaaagugcugggauuauaggugugagccacuucaccaagcugagaugccaccucuuaaaagauaaaauaaggacagauuacagccacugcucaugccuguaaucucaguacuuugggaggccaaggugggagaauugcucgaggccaagaguucaagaccagccugggcaauguagcgagaccugaucucuauaaaaaguaaaaaaaaaaaaaaacuagcuggggccaggcgugguggguggcuuacgccuguaaucccagcacuuugggaggccgaggcgggcagaucaccugagggcaggaguucaggaccaaccugaccaauauggagaaacccugucucuacuaaaaauacaaaauuagccaggcuugguggcuuaugccuguagucccagcuacucgggaggcugaggcaggagaaucgcuugaaccugggaggcagagguuucagugagcugagaucgcgccauugcacucuagccugggcaacaagaaugaaacuccaucucaaaaaaaaaaaaaaucagcuggaagguggcaaacaccuguggucccagcuacucaggaggcugagacaggaagaucacuugaguccaggaggucaaggcugcaggugagccauguuugugccacugcacugcagccuggaugacagaccgagacccuucucaaaaaaaaaaauauuacccguacucuuuuuugagacggaguuucacucuuguugcccaggcuggagugcaauggcgcaaucucggcucagcgcaaccuccgccuccuggguucgagcgauucuccugcuucagccuccccaguagcugggauuacaggcaugcaccaccacgcccggcuaauuuuuuguauuuuuaguagagacaggguuucuccauguuggucagacuggucucgaccucuugaccucaggugauccgcccaccuuggccucccaaagugcugggauuacaggccugagccaccgcacccggccuguacucuuauucuuuaauaauaaaauauuucuguguuucuuuagucauuuuacauaaacuuuuauuuauuuauuuauuuuuauuuauuuauuuuuuugagacggagucucgcucuguugcccaggcuggaaugcaauggcucaaucucagcucacugcaagcucugccucccggguacacgccauuccccugccucagccucccuaguagccgggacuacaggcgcccgccaccacgcccagcuaauuuuuuuuuuuguauuuucaguagagacaggguuucacuguguuagccaggauggucuugaucuccugaccucgugauccacccgucucggccucccaaagugcugggauuacaggugugagccaccgugcucggcccauaaacuuuuauuuuuaaaauaaugucaugauaaauaauauugcuuaggugucuuuaauauauuaguaacauuucuguuuuauuguacaucaacauuuauauucaaauuaaugggugaagaguacuccauuggacuagguauaucguaauuuaaucuccuauuauuggacaacuacauuguuucuaaaauuauacuauuccuaugacuaaaccuuugcauauaucuuuuaucucccuaggauauauuucuaaaacuagcauuguugacugaaaguguaaauacguguuaagguguuugcuacauaaugccauauuuccuuuuuaggaaacuaagcuacuuuggauuuccaccaacacuguauucauguacccauuuuucucuuaaccuaacuuuauuggucuuuuuaauucuuaacagagaccagaacuuuguaauucaacauucaucguuguguaaauuaaacuucucccauuccuuucagagggaaccccuuaccuggaaucuggaaucagccucuucucugaugacccugaaucugauccuucugaagacagagccccagagucagcucguguuggcaacauaccaucuucaaccucugcauugaaaguuccccaauugaaaguugcagaaucugcccagaguccagcugcugcucauacuacugauacugcuggguauaaugcaauggaagaaagugugagcagggagaagccagaauugacagcuucaacagaaagggucaacaaaagaauguccaugguggugucuggccugaccccagaagaauuugugaguguauccauauguaucucccuaaugacuaagacuuaacaacauucuggaaagaguuuuauguagguauugucaauuaauaaccuagaggaagaaaucuagaaaacaaucacaguucuguguaauuuaauuucgauuacuaauuucugaaaauuuagaucuagauaaagcuauaguguggauuauuuuauguauauuuacuugagaaaauaauuauuaaauauuaguggaaaagcuauacuuuggguaugauauaggacuuucgaauuggaauuuuccuuucuaucuguaaaagcaaguagguauaguuuuauuccccagaaggcaucuuuuucucccccuugucucacaugggugaauuuaccagcauauuuaacuaaauucagacugguuccaaauguacugccagauaguagcauuucucuaguguuuguuuucauccuggcuuguaagaaugcccugccacuucugcccugcaauaucccuugcuauuaggauuuuggcaucaccuuggguccuuaaugccagaaaugggaauugcuucauacuguggaaaaauacccauuaaaauauuaagaccaguaaaaccucguuucugcuugggcuauuuguggauuucagacauccugagaaguuuaccaccccuguaauuaauugucauugucaucacuucauaauaaaaauaauugcauggccgggcaugguggcucaagccuguaaucccagcacuuugggaggcugagguggucagaucaccuaaggucaggagaucaagaccagccugaccaacaugaagaaaccccaucuuuacuaaaaauacacaauuagccgggcgugguggcgcaugccuauaaucccagcuacucaggaggcugaggcaggagaauugcuugaacccgggaggcggagguugcggugagccgagauugcaccauugcacuccagccugggcaacaagagcgaaacucugucucaauaauaagaagaagaauugcgugaauauuucuuuaaaacuaugaugagauaacauaccagauuaucaaauggauucaguagugggugugccauuuauugcacacugagagaugaccaagucauucugaaauaucuuuauuaauauauccuuccuaggauuuuucauccuaacuucuccauagguaguuacuuagcauaacaucucuguggccagauguaucccacuacuaaaagggcaaaguaagcuguggcugcccugguagauacaaugaguaagugcacagugauggcuauaaauguuuucaucucauaaucccauguccagaccagcaauuugcucugaaagcucuuaccugugucuguuucaauggcucuugaucacuugccugcacguccagaauuccuuauuuauucauugaaaauuagcguucuuuaucccuuuguuuugcaaguucagcuuuuuagagauggcuaaaauggucuaaucuuucuuggcaaaggcaauucugagcugcagauuagacuacaaguggcuuggguacauguugucuuuaaacaagcgaagaggaaaacuuugagcucuauucagacuuggugaagugugguaaauuuaugaugaaagcuacugacuguauuacacaugauuaauucugaagcccauauuaagaugaucuuuucagcaguucagcauugcucuucuaacugaacaguuucaaggcugggauuucagcaauuaaucaguucagaauugcuaaugauccuggcggagggugguagcaaaagggggaggaugucauuagcuucucuagccugccuuuuuucagugcccuguggcaguauggagugaggcaacaugaaagaaagauggccugaccuucauggcaguauugugcaacacguaaauacuggugugaguggcuguggcuauggcuaguaaaugauggcccuugguaaacaaaguuauuuaucagacaauaccuaccagcuaggucaacugugcccauaauugaucugguuaauuucuuuugcugccuauugauuuuuauuugguugauagauaauagcuagaggacucuaaauuucuuuggggaagaacaugaaccccuucuaagccuucuuacgagagaauugaucgcuuuugcacugaccuuuaguaacauccugauuucaguguuuuguaacuaucagaggguugagucuugguuuuaagccauguauaucuguagcauaacuuucuguguaggcuaguuaccucucagcuuauaaaguguaggcugauaaauuuauaguacaguagagugucacuaugcaaagaaacgaucuuagggaaucgaaugauaucugcuauuaaagcaaaauuaauauauauuuuuucuuuuuacuuuuuuuuuuuuuuaaagacaugaaaucucacuguauugcccaggcuggucuuggucucagacucuugagcucaagcaguccucccaccucagcuucccaaagugcugggauuauaggcaugagcugccgugucuggcccaguauauauuuuuuaaguuuuaaguuuugugguacguaguagguuuauaauauuauuuugaauccuuaguuguaauuuuaugucugcugauguguacauaauuuuuauuaaacuauuuauuugagacuucagguaucuuuuuuuuuuuuuugagacggagucucgcacucucgcccaggcuagagugcaguggcgccaucucggcuuacugcaagcucugcuuccuggguucacgccauucuccugccucagccuccugaguagcugagacuacaggugcccgccaccacgccuggcuaauuuuuuguauuuuuaguagagacaggguuucaccguguuagccaggauggucucgaucuccugaccuugugaucugcccgccucagccucccaaagugcugagauuacaggcgugagccaccgcgcccagccgagacuucaggugucuuagaauuuuuuaaauguacccuuucugagaaaaacagagacuuaaagcuaggauaacugguauucuauuuuuuuuuuuuuuuuuuuuuuaccuccagccugggugacagagcaagacucugucuaaaaaaaaaaaaaaaaaaauucacuuuaaauaguuccaggacacguguagaacgugcaggauugcuacauagguaaacauaugccaugguggaauaacuaguauucugagcugugugcuagagguaacucaugauaauggaauauuugauuuaauuucagaugcucguguacaaguuugccagaaaacaccacaucacuuuaacuaaucuaauuacugaagagacuacucauguuguuaugaaaacagguauaccaagaaccuuuacagaauaccuugcaucugcugcauaaaaccacaugaggcgaggcacgguggcgcaugccuguaaucgcagcacuuugggaggccgaggcgggcagaucacgagauuaggagaucgagaccauccuggccagcauggugaaaccccgucucuacuaaaaaauaaaaaaauuagcuggguguggucgcgugcgccuguagucccagcuacucgugaggcugaggcaggagaaucacuugaaccggggagauggagguugcagugagccgagaucaugccacugcauuccagccuggcgacagagcaaggcuccgucucaaaaaaaaaaaaaaaaaacgugaaaaaauaagaauauuuguugagcauagcauggaugauagucuucuaauagucaaucaauuacuuuaugaaagacaaauaauaguuuugcugcuuccuuaccuccuuuuguuuuggguuaagauuuggagugugggccaggcacgguggcucacaccuguaaucucagcacuuugggaggccgaggcggguggaucaccugaggucaggaguucgagaccagccuggccaacguguugaaaccccgucucuacuaaaaauauaaaaauuaggugggcgugguggcaggcaccuguaaucccagcuacucaggaggcugaggcagcagaaucgcuugaacccaggagguggagguugcagugacccaagaucgcaccauugcacuccagccuggggacaagagcgagauucuugucucaaaaaaaaaaaaaaaaaaaaaagguuuggaggguggugagcugagauagucaacuauuaacuccuaucuaccugcugggacuacacuggugagguggagccuaaguccuaaaacaacaagugaggcagcuggacgcgguggcucgcaucaguaaucccagcacuuugggagccugaggcgggcagaucacaaggucaggaguucgagaccagccuggccaauaugguaaaacccagucucuacuaaaaauacauaaauuggcugggcgugguggugugcaccuguaaucccagcuacuugggaggcugacacagaagaauugcuugaacucuggaggcugagguugcagucagcugagauccugccacugcacuccagccuggcgacagagugagacucugucucaacaacaacaaaagaaagaacaagugaggcaaaaccuggagaccccagcuucauguaacaccuaguuugaguauuguugagaguuuuucaggaaaaaagucugauaacagcuccgagauagucuuaacauaugaaaaagcaaaaaagggaggagacagaucauuuguccuauaccuuucucuuuuaagguuuuaauuauaacuuguguaauacaggagaccucuggguguuuuuaguugacuauaaacuaaaucugaguacacauuucagggcugcuaaaaaugcuuauuugaaacugggccguauuaacacaagcagaggcucuggagcaagugaaguacagauccagagccccacuguauucuccaauggagugauugccugaaagaugaugucaguuuuaagcaccgugcuugguuuuuaacauggucacugacaaauuggagaguguuuauccagagguagaugguaaagauacauaaaaguaacuugaaauacugucuuuugaagaagaaaugagaagauuuaaggaaauaagacacugucuucaaguaucugaagaaccguuacccggaagagaacuguuaucuggaacaggauuaagacucacucauggggcuccagaaagcagacgagugcauggaggacgcagaagaugcagauuguguggcucaacucuaaaaucuuucuaacaaaauuaguucucuggauguguuccaguucacuugaugaugauucuuuuguuuuuguuuuuguuuuugagguguaguuuuucacucuuguugcccaggcugcuggagugcaauggcacgaucuuggcuugcugcaaccucccccucccggguucaagcgauucuccugccucagccucccgaguagcugggauuacaggaaugcaccaccauaccuaauuuuguauuuuuaguagagacaggguuuuuccaugucagucaggcuggucuuggacucccgaccucaggugauccaccuaccucggccucccaaagugcugggauuacaggugugagccaucgcgccuagccuaugaugauucuuuucacagagauacaggcacuuaaggagaggaucuaaaccccuuggacacauugccguugaacuucuaagaucuuagguuuccacuuacucaugaaaauuauaccacagggucagaggguaguguucauuggagccaggugccagaacaaguuauuacaaacuacuauuuuagagaaaaaugucauuaaaguuuaagauaccuuaagcuauagguuugcaucaaaguuaaugaaagguaaaaagaugccaagcgugguggcucaggccuguaaucccagcgcuuuggggggccaaggcgggcagaucacgaggucaggagaucgagaccauccuggcuaacacggugaaaccccaucucuaguaaaaauacaaaaaauuagccgggcaugguggcgggcaucuguagucccagcuacucaggaggcugaggcaggagaauggcaugaacccaggaggcagagcuugccgugagcugagauccagccacugcacuccagccuggcugacagagcaagacugcaucucaaaaaaaaaaaaaaaaaaaaaugcaaaucaaaucuaaaguaguucagucuuuaaacucaaagccaauacauuugcuuugaacuacaaaugaacugaaguuuuuaaguguaauaaauguuacuaaaucggcuuuuguagcaguuaaacaaaaaacuucaaaaauuguaaggauucugugagggagcauggcugcugcugcugcugcugcuugcagauagccugcuguguuuaggauuuaguuaaauacauuucuccuguuuaaaacuaaauggucuuuccuuaguuugcuuaguucuucagaagggccuuugaaacacugggaaauaaacaagugauucuuuagcuacugcuuucugaaauacuuauauaaaagcucugcacuguauucucccaucccucucaggggaauauuagaggguuaggacuccccagguagacauucuaggggugaaaauuugucauuacauugacauuucagauuuagguuuucaacaauacuguuuucuucuuucacauauugccaucuaguaauauagauguucuccguccacauuaaucaaaacuauugacauggauaauuccuaauuccuugaacacuauaauggagaucuauagcuagccuuggcgucuagaagauggguguugagaagagggaguggacagauauuuccucuggucuuaacuucauaucagccuccccuagacuuccaaauauccauaccugcugguuauaauuagugguguuuucagccucugauucugucaccagggguuuuagaaucauaaauccagauugaucuugggaguguaaaaaacugaggcucuuuagcuucuuaggacagcacuuccugauuuuguuuucaacuucuaauccuuugaguguuuuucauucugcagaugcugaguuugugugugaacggacacugaaauauuuucuaggaauugcgggaggaaaauggguaguuagcuauuucuguaaguauaauacuauuucuccccuccucccuuuaacaccucagaauugcauuuuuacaccuaacguuuaacaccuaagguuuuugcugaugcugagucugaguuaccaaaaggucuuuaauuguaauacuaaacuacuuuuaucuuuaauaucacuuuguucagauaagcuggugaugcugggaaaaugggucucuuuuauaacuaauaggaccuaaucugcuccuagcaauguuagcauaugagcuagggauuuauuuaauagucggcaggaauccaugugcagcaggcaaacuuauaauguuuaaauuaaacaucaacucugucuccagaaggaaacugcugcuacaagccuuauuaaagggcuguggcuuuagagggaaggaccucuccucugucauucuuccugugcucuuuugugaaucgcugaccucucuaucuccgugaaaagagcacguucuucugcuguauguaaccugucuuuucuaugaucucuuuaggggugacccagucuauuaaagaaagaaaaaugcugaaugagguaaguacuugauguuacaaacuaaccagagauauucauucagucauauaguuaaaaauguauuugcuuccuuccaucaaugcaccacuuuccuuaacaaugcacaaauuuuccaugauaaugaggaucaucaagaauuaugcaggccugcacuguggcucauaccuauaaucccagcgcuuugggaggcugaggcgcuuggaucaccugaugucgggaguucaagaccagccugaccaacauggagaaaccccguuucuacuaaaaauacaaaauuagccgggcuugguggcacuugccuguaauuccagcuacucgggaggcugaggcaggagaaucacuugaaccugggaggcggggguugcagugagcugagaucgcaucauugcacucuaaccugggcaacaagagcaaaacuccaucaaaagaaaaaaaaaaucgggugcaguggcucaugccuguaauccuaacacugugggaggccaagacaggcagauugccugagcucaggaguucgagaucagccugggcaacauggugaaacccugucucuacuaaaauacaaaaaauuacucagcgugguggcaugcgccuuuaguuccagcuacucaggaggcugaggcaggagaaucucuugaacccgggagguggagguugcaaugagccaagaucgugccacugcacuccaaccuggcaacagagcgagacuccgucuuaaaaaaaaaaaaaauuuugcagcgcaaaccaggauauccucuguucucauuuguucuagauuucaaaagaaacaguccuuucuuuggggaaaagagaaaggaaaaggaguuuuauaaaaggaaagaaaagauucauaagaacaagaagugggcccacuugcauauaccuuuguagaaaacuguucacuguuguugaagaaaagcucuucauauuaauaugcaguccagaugcaguggcucacacuuauaaucucagcccuuugggaggcugagacaggaagauuacuugaggccaggaguuugaaaccagccugggcaacauagugagacucugucuccacaaaauuuuuuuuuaauuagccgggcauggcagugugcuucuguagucuuagcuacugaggaagcuaagccagaagaaucacuugagcccaggaguucaaggcugcagugagcuaugaucauaccauugcacucuugcacuugcacagagcaagacccugucucuuaaaaaaaaaaaagugugugugugcauaugcauauauacauauauauacaugcaaauguaucuguuuauaauucagauugcuucaaaaagauguugcacuuuaugauacugagaacagugagaaguaaauaagauagaguguaggaggaggaauaauuucagaacagccaucugagaacuucugugacaacagaucaggcaaaaugaaaugugaaaguaauuuuauaggccaggcgugguggcucaugccuauaaucccagcacuuugaguggccaaggcagguggaucacuugaggucaggaguucgagaccagccuggucaacauggugaaaccuugucucuacuaaaaacacaaaaaaauuagucgagcgugguggcaugugccuguaauccuagcugcuggggaggcugaggcaggagaaucacuugaacccgggaggcggagguugcagugagccuagauugcaccacugcacuccagccugugagacagaaugagacccugucuuaaaaaaaaaaaaaaaguaauuuuauaaacuauugugcacaauucgauguauucauaauuaauuaaaugauuauuuuuguugguuuuaacuuuuauucaguggcuauuuauugggagccuacuguguucugggcacuaggaaugcaacaguaaauaagacuaacuaagucccugguaggauucagguucugucgaggggagauacacaauaaagaugaauuuaagauaacaauaaaugcuauggagaaauauacagaacaguggaauaguauuagcugucaaagguuguugauuacuuucguuuaaggaggccagggaaagccuuucugaaaaaauugagcugagaccuaaauaacaagaaauaauuguccuugaaaaaugaagggaaugcaucuuauaggcagaggaauagcaaacauaaaggucuugagguaauaaugagugugguuuuuugauuucuguauuuugguuuuuuugagauggugucucccucuaucccccaggcuggagugcaguggcacaaucuuggcucacugcaaacucugucuccuggguucaagcaauucuccugccuuggccuccugaguagcugguauuacaggcacgcgugcuaccacacccgacuaguuuuuauuuuuaguagagaugggguuuuaccacguuggucaggcuggucucaaacuccugaacucaagugauccaaccaccucaaccucccaaagugcugggaucacaggugugagccacugugcccggccagagcuugguuuauuuuuuaaaagauaggccaauguuggucgugugugguggcucgugccuauaaucccagcacuuugggaagccaaggcaggcaaaucacuugaggucaggaguucgagaccagccuggccaacauggugaaaccccaucucuacuaaaaauacaaaaaacuagcauggugugguggugugugccuguaaucccagugccuguaaucccagcuacuccagaggcugaggcaggagaaucacuugaaccgaaagguaggaguuacagugagccaagaucgcaucacugcacuccagccugaacgacagagcaagacuccugucucaagaaauaauaaugauaaaagguucgggcacaguggcucacaccuguaauuccagcacucuaggaggccgaggcaggcagauccccugaggucaggaguuugagaccagccuggccaacguggcaaaaccccaucucuacuaaaaaaugcaaaaauuagcugggcacggcugggugugguggcucauuccuguaaucccagcacuuugggaggucaaggcggacagaucacugagguagaaacccugucucuacuaaaaauacaaaaauuugcccagcgugguggcgcgugccucuaaucccagcuacacgggaggcugagacaagagaaucacuucaucaacccgggagguggagguuguggugagcugagaucgcaccauugcacuccagccugggcaacaagagugaaacuccaucucaaaaacaaaaaaaaauuagcugggaaugguggcaugugccuguaaucacagcuacuugggaggcuggggcaggagaaucgcuugaacccaggaggcggagauugcagugagcugagauugcgccacugcacuccaggcugggcgaaagagcaagacuccgucucaaaaauaauaauaauaauaauaauaggccaguguagcuggaguaauuugcaaauuauguguggaggcagagauuacacaaggaaugggagaaggucauagaugagggccagaucacauaguauuuggugguaaggaauucagauuuuauccuugugguaauuggugguguggagaugguuaaaaacaagguugguuugggauggguuugaagagaggacuugcuaauggauuaaauuuggaggauaagguaaagagaaauugaaggagugacacuuggguuuuggcuugaacaauagaucuuguuaguaauauuaaauuagaugaagaaggcaugguagggaauaugggggagugggaaaggcaggaagcaggaauggaaccaggaacucuguuuuagaugugagaauuuguuguuguuguuguuguuguuguuguuguuguuguuguuguugugacagcaucucguucuguugcccaggcuagagugcauggagugcgguagcacgaucucagcucacuccaaccuccgccucccgguucaagugauuuuccugccucagccucccgaguagcugggauuacaggcaccugccacaaugccuggcuaauacuuguauuuuuaguagagaugggguuuuaccauguuggccaggcuggucuuaaacuccugaccucagguaauccacccaccucggccucccaaagugcugggauugcaggugugagccacugugcccggccagaugcaugaauuuugagauguauacuagacuucuggauagagaaguuaaguaggcaguuggacacauuguaugaagcucagggguacaaggaggacuaugaacaugggagucuucugacaaauuuaucacuagacuccucauucaaguaacuaggaaaugucagauauucuuccccuaguaauagccagugguuauacucuugccuuuaguuuucuucacaauacucuuggcaacacauaaggccuucccuacaaucugaguuucagucagaauuguuucugagcguucuuccucaaauuucuccccagucucauuauucuuuauucucauguccaugaccagucauaauaguaauuaugaaaaaccucuaacuuucuuuagugcauugaauguauauuuuaucauuuugguuguguuaacuguaaaucucucaguggaaaucugaaaagccuuuauuuccuuagaugauaauauacaauugauuuaggagauagggaauuuuucaguuaccuuuauaacagcacaguauuagcagucuaaucuaaaugcuaagugaauguuuugagaggagauagauguugaaaauuaaaauacauuaagucccagugaggugaaaagccgauuguuaaguucugcacacaaaagauuugcuucagugaauugauuucaacagcugagauccuagucauuucaccuggucuaccaaaaagaaugauuuuacuugcuuuuggucaaaucucugcccagcaauucuuuuucuuucuuucuuuuuuuuguuuuauguguguguguguguguguuuuuuuuuagcagagucucacuuugucacccaggcgggaguguggugguaugaucacaguucacugcagccuccaacuccugggcucaagugauccuccagcuucagcuuuucaagaaauugggacugcaggcacaugcaacuaugccuggcugagguuuuauguaucuuuuuucuagagaaggggucucacuguguugcccagcugggucuccagcuccuggucucaagcuguccuccugccucagccucccaaagugccaaagugcuaggguuauaggugugagccauuggugcccagcuacugccugccuggcaauucugaaugccuuaaauuuuuuuuuuuuuuuuuuuuuuuuuugagacagaguuucacucugucacccaggcuggagugcaguggcaugaucguggcucacagcaaccucugccuccuggauuccagcaauucucaugccucagcuucccgaguagcugggacuacaggugcaugccaccacgcccagcuaauuuuugguuuuuuuguuuguuuguuuguuuguuuugagacggagucucgcucaguugcccaggcuggagugcaguggcgugaucuccgcucacugcaagcuccgccucccggguucacgccauucuccugccucagccucccgaguagcugggacuacaggcgccugccacuacacccggcuaauuuuuuuguauuuuaaguagagacgggguuucaccguguuagccaggauggucucgaucuccugaccucgugauccgccugucucggccucccaaaguccugggauuacaggcgugagccaccacacccggccuaauuuuuuuuuuuuuaauuuuauuuuuaauuuuuugagaugcgagauggagucucgcucuguuacccaggcuggagugcaguggcaccaucucagcucacugcaaccuccaccuccugcauucaaaagauucuccugccucagccucccaaguagcugggauuacaggugccugccaccacgcccaacuaauuuuuuguauuuuuaguagagaugagguuucaccauguuggucagacuggugucgaacuccugaccucaagugaucugccugccucagucucccaaagugcuaggauuacaggggugagccacugcgccuggccugaaugccuuaaauaugacgugucugcuccacuuccauugaaggaagcuucucuuucucuuauccugauggguuguguuugguuucuuucagcaugauuuugaagucagaggagauguggucaauggaagaaaccaccaagguccaaagcgagcaagagaaucccaggacagaaagguaaagcucccucccucaaguugacaaaaaucucaccccaccacucuguauuccacuccccuuugcagagaugggccgcuucauuuuguaagacuuauuacauacauacacagugcuagauacuuucacacagguucuuuuuucacucuuccaucccaaccacauaaauaaguauugucucuacuuuaugaaugauaaaacuaagagauuuagagaggcuguguaauuuggauucccgucucggguucagaucuuagcugauaaguggaagagcugggacuuuaagcagaugagaaucuaaagacuuugcucuuuucacuucacuggggugucuuucucucucucucucuugcucucucucucucuuuuuuuuuuucccaagacggagucucacuccauugcccaggccagagugcaguggugcgaucucagcucacugaaaacucaucuugcccaggcuggucuugaaccccugaccuugugauccucccgccuuggccuccccaagugcugggauaggcgugagccaccgugcccagccaauaauagcuaaaauuuauauaauguucacugggccaggcacagcggcucguuccuguuaucccagcacuuugggaagcugaggcaggcagaucgcuugagccaaggaguucgauaccagccugggcaacauggcaaaaccccaucucuaccaaaaaaaauauacaaaaauuagccaggcgugguggcauguacuuguaguuccagcuacucggaaggcugaguugagaguaucucuugagcccaagaagaggggacuacagugaacggagauugcgccacugcacuccagccuagacgacagacagaagaucucaaaagaaaaaaaaaaaaaaaagaucacuuuaugcugggacugcucuaaaggcccaaccauguuuuaacuaauuaacaauuuuaugacaacucuaugagcuauguacuguaauuaugccuauauuacagaugugaaaauugaggcucagagagguugaauaaguugcucaaagucacacagguaauaagugauggaacuagaaguugaacucaggaagucuagcuccaagucuaaauucuuuguuaauuuauuuuucgggccagagucuuacucugucacccaggcuggagugcagugccacuaucucugcucacugcaaccuucaccucccaaguucaaaccuuguucaauucuugugccuuggccucccaaguggcuaggauuacaggcaugugccacaacaacuagcuaauuuuuugucugauucuguuggccagucuggagugcaguggcgcaaucucagcucacugcagucuccagcucccagguucaagugauucucgugccuuagccucccaaauagcugggauuacaggcacgugccaccacaccgagauaguuuuuuguauuuuuaauagaaacaagguuucaacauguuggccaggcuggucucaaauuccagaccucagaucaucugcccgccucaggcucccaaagugcugggauuacaggcaugagccacugcacccggccuuaauuuuuauauuuuuauuagagaugggguuuugccauguuggccaggcuggccuugaucuccuggccuccagugauccacccgccuuggcuucccaaagugcugggauuacaagcaugagccacugcacccggccuccaauucuaaacucuuaacaacaauacuauaguuucuugaaaaguuguugaaggcuucacggagggaaaaaaaauggagcauucuaacaacuuugcagaugagacccaagaagacucaaugacuuucuccugaucauauuguagcagaugacuuagccagaacucugacuuccucacagggagaaagucugcaagauuucacacuuaccugucaggccugagcuggcugcuuucucagcucccuaagugcuauguucccagucugcuuuucuuccuuuuucaagugugcacuaccaggcauuucagaacaucccaggcuggucgcgguggcucacaccugugaucccagcacuuugggagcccaaggcggguggaucaccugaggucaggaguucgagaccagccuggccaacauggugaaaccccaucucuacuaaaaauacaaaaguuaacugggcguggugguaggcaccuguaauccuagcucaggauuacucgggaggcugaggcuagagaaucgguugaacccaggaggcggagguugcagugagccaagauugcgccacugcacucuagccuggggacaagagggagacuucaucucaaaaaaaaaaaaaaaaucccagcugggcacagcggcucacuucuguaaucccagcacuuuaggaggccaaggcaggaggaucacuugagcccaggaguucaagacuagccugggcaacauaguaagacccugucucuacaaaaaaauuuaaaaauuaauugggugucguagcacacucuuguauucccagcuacucaggaggcugaggugagaagaaugcuugagucugggaggucgaggcugcagugagccaugauggugcuacugcacuccagccuggccaacauugugagaccuugucucaaaacaaaacaaaacauccuucuacugagcacuuucugucccuuuauagaaacuuaagagggaaccaguagagguaauuuccuaaggaaaacugcuuugggacaugaucacaaaugaagccuggaguuuugaacugcugaggucagccuguuuuuaccuucugagccuaucaaguaauuguuccagaugccaagaaaagcugcuggccuuauuucugcuucugccuuuaccacaggggagcgccaugugagccaguccucuguuuuuccuccacuguaugcuaggcaguauuagcaccagauucuuccccucuuuaaaaagaaauucuagugcuuuggauuuuuuccuccaugcagaauagcaaugauggaaaguauguggucaaaguaaugacauucugaaaauacuaaaugucaccauaguauuuuucucuggaagagaaauguauauguagaggugaaacuucaaauuucuuuuuuuuuuuuuuuaagacgaagcuuugcucuucuugcccaggcugaaguacaauggcgugaucuuggcucaccgcaaucucugccuccaggguucaagugauucuccugccucagccuccuaaguagcuaggauuacaggcaugugccaccacgcccagcugauuuuguauuuuuaguagagaugggguuucuccauguuggucacgcuggucuugaacucccgaccccaagugauccacccaccucggccucccaaagugcuaggauuacaggccaccgcgcccggccugaaacuucaaauuucuuuuuuuuuuugagacagagucucgcuaugucacccaggcuggagugcaguggcgccgucucggcucacuaccagcuccacuccaccuccuggguucacaccauucuccugccucagccucccaaguagcugggacuacaggugcccgccaccaugcccagcuaauuuuuuguauuuuuaguagagacggguuuucacuguguuagacgggauggucuccaucucuugaccucgugauccgccugccucagccucccaaagugcugggauuacaggcgugagccacuacgccaagcccgaaacuucaaauuucuuaucucauaacuaggcauccucaucacugaguguuagccuggauauaaacauuccuaaucuuuuguacuuuucaugucagcauuuggcuccacuuggcugccuggggagaacuucuagcauuaugagcaugcagguccuaucaacagguugggggugcgguuuauucauacagguagugagaguggcacagauggaugcugucccuuaaaacaaacagacuugucuuugggagccugaggcggguggaucaugaggucaggaguucaagaccagccuggccaacauagugaaaccccguuucuacuaaaaauacaaaaaauuagccgggugugguggugugcaccuguaaucccagcuacuagggaggcugaggcaggagaaucacuugaacccaggagguggagguugcagugagccgagauggcaccauugcacuccagcccaggcgacagugcaagacugcgucucaaaaaaaaaaaaaaaacacacagacuuguccuacugccauuucuuuucacucuggcgguaaaguaagagaguguguguguguguguguguguguguguguguguguguguguguuucuguccgucugucugucaagggggagggugaccacuuucuaaaaggccauccguguauuuuuagcuuccugauuuuuuucucuaucgcagucucuuugaagccaggugaauuuuaggccuuggcaauuuucuuuuuauugcaaugggaaggucaagacacugagagucacccaaaacauauccauccaaaaugauacaauuuuaggguuuauuuuuaagugauacccaaguuauuugcuaagaaccuaugccaguguguuuaugagaauuugcacugucccacacuguugccaccagccacaugggacuguuuaaauuuaaauuuuacaaauuagccagucaugguggugugcacuuguagucccagcuacuuaggaggcugaggcaagaggauugcuugagcccagaaguucaauacugcagcaagcuaugaucgugccacuguacuccagccugagugacagaaugagaccucaucucuucaaaaaaaaagaaaaaaauuaaaauaugaaguuuaguucuucauucacccuaaccacaucuccagugcucaauaacuauaugugacucauggcuaccuuauuagcauagauauagaacauugugacuaucacagaaaguuguuuugaacaguguugccaagcccuguaaguggaagaggcagugcagugugaucugugucuucaggaaaccagguagucagacuaguucaaugaggagaggcagaaccuggcuucacuucuagauuaaaaacugcuuagguggccuaaagauacaauggccauucucagaguagugagaaggaaggaacagauguuuagggggcuagaagaaagucagagagggccgggcgcaguggcuuaugccuguaaucccagcacuuuggaaggccaagacaggcagaucacgaggucaggaguucgagaccagccugaccaacauggugaaacccugucucuacuaaaaauacaaaaauuagccgggcgugguggugcgcgccuguaaucccagcuacucaggaggcuaaggcaggagaaucgcuugaacccuggaggcagagguugcagugagcccagaucgcaccacuacgcuccagccuaggugacagagagagacuccgucucaaaaaaaaaaaaaaaagucagaggagacaaggagcauguacaccuaaaaucaacauagaccccucuguugauggggucauagugaguacuugagguaccaagucuggauaaacaucaaacuucagccaauaacuuugaguuucuagccauccaagccucuuauuaaacauacagaaggaccuuuuuucccuugcaucuaacaaguuaaagcaccugcagagaucauuagggaggagccuuggccugauuggugacaaaagugagaugcucaguccuugaaugacaaagaaugccuguagagugcaggucaacuacauaugcacuucaagaagaucuucugaaauccaguaguguucuggacauuggacugcuugucccugggaaguagcagcagaaaucaucagguggugaacagaagaaaaagaaaagcucuuccuuuuugaaagucuguuuuuugaauaaaagccaauauucuuuuauaacuagauuuuccuucucuccauuccccugucccucucucuuccucucuucuuccagaucuucagggggcuagaaaucuguugcuaugggcccuucaccaacaugcccacagguaagagccugggagaaccccagaguuccagcaccagccuuugucuuacauaguggaguauuauaagcaagaucccacgauggggguuccucagauugcugaaauguucuagaggcuauucuauuucucuaccacucuccaaacaaaacagcaccuaaauguuauccuauggcaaaaaaaaacuauaccuugucccccuucucaagagcaugaaggugguuaauaguuaggauucaguauguuauguguucagauggcguugagcugcuguuagugccaacauguuagugagaaaauaucuuuggauagguaaaaaucaaggaggaguucuccucuuccuaaaccaucuuaauuuacuuacauagaagaaagcacagcagcuggcccaccacggacgggcccagagcaggggaagauucucggugaacauuucuuuuuuuuuuucuuuuuuuuugaggucgagucucuguugcccaggccagagugcaauggcgcgaucucggcucacugcaaccuccaccucccggguucaagugauucuccugccucagccucccaaauagcugagacuacaggcgugugccaccacgcccgacuaauuuuuuguauuuuuuuuuuaguagagacgggguuucaccguguuagccaauauggucccgaucuccugaccucgugauccacccgccucagccucccaaagugcuaggauuacaggcaugagccacugugcccagcccucuccaugaacauuuucuaauuaaacuugacacuuaauacaauguuaugcuuaggacugcuauaaagcuuaccucuggaguugcgcagcacaaaggccuugguguguguauaaauuugguuuguucuuuucacagcaaaagcuacccaccuuugccuccugugccugcuucugcccagggacuuagguccucuuacaccuuagagaaaggccuuagcaucuggucacaggcagaugagugacagcaagaaaaccuggcugcaauguaauuuuguuuccauccucuuuauuaguuaucaauuggauuuuuaugaaauuuccaaguuccacucaaggauuucucaguguuuuuuuacuuugguauaguggaaaccaggguugccagaaaguauuauuuugggggugaguuagucaaccuucguucagucagacagacaggagcaccucagcaauucccagaaacgggcugaugggaaagagcaacauacaugaaugucuugaagaacacagccaacagagcccauugggcaguucugauuuuccagguacacagcaucuccacagucucuucugauuuuuauuccccugaguauauggauuccagcucagcauguagccuuucccugcugagucucuaaccaggauaacauguauuuuuuugacuggaugaauuaucuucccaucucuugacauuuacaguaauuaccaccaaguaugguauuuucaguggccgugauuaucaguuaccaacacagaauuaggaugaagggaggaagggagggaaggaagguggguguuuuuucacacagugucuuagccagcaauuuagcaaauuaauggaaauuagaucuuugauuuuuuuuucuuucaagcauuuuauuugagagacuaucaaaccuuauaccaaguggccuuauggagacugauaaccagaguacauggcauaucaguggcaaauugacuuaaaauccauaccccuacuauuuuaagaccauuguccuuuggagcagagagacagacucucccauugagaggucuugcuauaagccuucauccggagaguguaggguagagggccuggguuaaguaugcagauuacugcagugauuuuacaucuaaauguccauuuuagaucaacuggaauggaugguacagcuguguggugcuucuguggugaaggagcuuucaucauucacccuuggcacaguaaguauugggugcccugucagagagggaggacacaauauucucuccugugagcaagacuggcaccugucagucccuauggaugccccuacuguagccucagaagucuucucugcccacauaccugugccaaaagacuccaucuguaagggauggguaaggauuugagaacugcacauauuaaauauacugagggaagacuuuuucccucuaacucuuuuucccauaugucccucccccuccucucugugacugccccagcauacuguguuucaacaaaucaucaagaaaugaugggcuggaggcugggcaugguggcucaugucuguaaucccagcacuuugggaggccgaggcagguggaucacuugucaggaguuugagaccagccuggccaacauggugaaaccccaucuguacuaaaaaaaaaaaaacaaaaaguagccaggccugguggagcaugccuguaaugccagcuauuugggaaguugaggugugagcaucgcuugaacgugggaggcagagguugcagugagccaagauugcaccacugcacuccagacugggugacagagugagacuuugucuaaaaaaaaaaaaaaagagagagagagaaaagcuaggugcgguggcucacgccuguaaucccagcacuuugggaggcugaggugggcagaucacgaggucaagagaucgagaccauccuggccaaccaacauggcgaaaccccgucucuacuaaaaauacaaaaauuagcugggcguaggggcgcacgccuguagucccagcuacuugaggggcuggggcaggagaaucgcuugaaccccggaggcggagguugcagugagccaagaucgcgccacugcacuccagcccgggcgacagagcgagacuccgucucaaaaaaaaagagagagagagaaaugaugggcugggccagugccccaccccuguaaucacaacacugggaggccaaggugggagaaucgcuugagccugggagcugaagaccagccugggcaauacaguaggaccucaugucuacaaaaaaauuauuaaaaauuagccaaggcugggugcgguggcucaugccuauaaucccgggggugaaguugagcccaggaguuugagaccagccugggcaacauggcaaaacccugucucuaccaaaaauacaaaaaaauuagccagggguggugguacgugucuguaguuccagcuacuuaggaggcugagauggaaggauugcuugagcccaggaggcagagguggcagugagcugagaucacaccacugcacuccagccugggugacagagcaagacccugucucaaaaacaaacaaaaaaaaugaugaagugacaguuccaguaguccuacuuugacacuuugaaugcucuuuccuuccuggggauccaggguguccacccaauugugguugugcagccagaugccuggacagaggacaauggcuuccaugguaaggugccugcauguaccugugcuauaugggguccuuuugcauggguuugguuuaucacucauuaccuggugcuugaguagcacaguucuuggcacauuuuaaauauuuguugaaugaauggcuaaaaugucuuuuugauguuuuuauuguuauuuguuuuauauuguaaaaguaauacaugaacuguuuccauggggugggaguaagauaugaauguucaucacaaaaacauaaaucaaggccgggcaugguggcucaugccuauaauuccagcacuuugggaggucaagauggaggucaaggugggagccuagaaguucgagaccagccugggcaacauaaggagacuucaucuguacaacaaauuuaaaaaguagcugggugugguggcagaugccuguagucgcagcuacuugggaagcugaggugggaggaucacuugagcucaggagguugaugcuucagugagccacgaucacaccacuguacuccagccugggcgacagagcgagaccgugucucaaaaagaaaaaagaaaguauaaauuuacacaaaaacaauaaaauaaucccaguaauuccaccacuuggagaugaucaccauaaaacuccaccaggcauaugugcguauauauacacguguauuuuauaaaaugugaucauaauuacacuguuuugcuuuuuuccuuaagauauuacauacauuuuuccacaucguuaaauuacagugcuguuuuccugguggcuuuccuuuaacagauugaaguucauguuaauacaguugccagaggcugugggcuuucacugucaccaggagucacuccuagggccucuucagagcaaggccuuauguccugaagcauugccuuuuuuuuuuuuuuuugagguggagucucacucugucacuuagcaggcuggagugcaguggcccagucuuggcucacugcaaccuccgccuccuggguuuaaaugauucuccugccucagccucagggcggaucaccugacaucaggaguuugagaccagccuggccaauauggcgaaaccccaucucuacuaaaaauacuaaaaaaaauuagccaggcaugguggcacgcacuuguagucccagcuacuugggagacugaggcaggagaaucgcuugaacccaggauguugagguugcagugagcugagaucacaccaucacaauccagccugagugacagagugagacuccaucugaaaaaaaagaaaaaacaauuagccuggcaugguggcaggcaccuguaaucccugcuacuugggaggcugaggcaggagaauugcuugaacccgggagguggagguugcagugagcugagaucgugccauugcauuccaggcugagcaacaagagcaagacuccgucucaaaaaaaaaaaaaaaaaaaaaaaaaggccaggugcaguggcucacgccuguaaucccagcacuuugggaggccaagguggguggaucaccugaggucaggaguuccagagcagccuggccaacauugugaaacccccgucucuacuaaaaauacaaaaauuagcugggugugauggcaugugccuguaauuccagcuacucaggaggcagagacaggagaauugcuugaacccaggaggcggagguugaaugagccgagauugcgccaucacacucuagccucggcgacagagcaagacuccgucucaaaaaaaaaaaaaaaaaauuagcuucuaccucauuaauccuaagaacucauacaaccaggacccuggagucgauugauuagagccuaguccaggagaaugaauugacacuaaucucugcuuguguucucugucuccagcaauugggcagaugugugaggcaccuguggugacccgagaguggguguuggacaguguagcacucuaccagugccaggagcuggacaccuaccugauaccccagaucccccacagccacuacugacugcagccagccacagguacagagccacaggaccccaagaaugagcuuacaaaguggccuuuccaggcccugggagcuccucucacucuucaguccuucuacuguccuggcuacuaaauauuuuauguacaucagccugaaaaggacuucuggcuaugcaagggucccuuaaagauuuucugcuugaagucucccuuggaaaucugccaugagcacaaaauuaugguaauuuuucaccugagaagauuuuaaaaccauuuaaacgccaccaauugagcaagaugcugauucauuauuuaucagcccuauucuuucuauucaggcuguuguuggcuuagggcuggaagcacagaguggcuuggccucaagagaauagcugguuucccuaaguuuacuucucuaaaacccuguguucacaaaggcagagagucagacccuucaauggaaggagagugcuugggaucgauuaugugacuuaaagucagaauaguccuugggcaguucucaaauguuggaguggaacauuggggaggaaauucugaggcagguauuagaaaugaaaaggaaacuugaaaccugggcaugguggcucacgccuguaaucccagcacuuugggaggccaaggugggcagaucacuggaggucaggaguucgaaaccagccuggccaacauggugaaaccccaucucuacuaaaaauacagaaauuagccggucauggugguggacaccuguaaucccagcuacucagguggcuaaggcaggagaaucacuucagcccgggagguggagguugcagugagccaagaucauaccacggcacuccagccugggugacagugagacuguggcucaaaaaaaaaaaaaaaaaaaggaaaaugaaacuagaagagauuucuaaaagucugagauauauuugcuagauuucuaaagaauguguucuaaaacagcagaagauuuucaagaaccgguuuccaaagacagucuucuaauuccucauuaguaauaaguaaaauguuuauuguuguagcucugguauauaauccauuccucuuaaaauauaagaccucuggcaugaauauuucauaucuauaaaaugacagaucccaccaggaaggaagcuguugcuuucuuugaggugauuuuuuuccuuugcucccuguugcugaaaccauacagcuucauaaauaauuuugcuugcugaaggaagaaaaaguguuuuucauaaacccauuauccaggacuguuuauagcuguuggaaggacuaggucuucccuagcccccccagugugcaagggcagugaagacuugauuguacaaaauacguuuuguaaauguugugcuguuaacacugcaaauaaacuugguagcaaacacuucca

SEQ ID NO: 192310 - RNA, 40347 nt, Homo sapiens
gaaagcuggaacccggccggaguagcucugagcgccggcugugaggaaggagguucugggcaagcuauagccauggcuguggcuguagccauggcgggagccuuaaucgggucggagccaggccccgcggaagaacuugccaaacucgaguaccugucuuuggugucaaagguuugcacugagcuggacaaucacuuggggaucaacgacaaggaccuuggugagcucggggaggucccugggaccucaguuugggauugagggaagcggaaggaggaaggaggaaggagaaaggugguugauggaccgaaaguauguucgugugaaucugucucucucugucgcagacaccggugcccaggguacacgcugccguggccucggcuugagagcccucgagaaacuuuagaaacuuucccagagcugucagugaagcccggggcggucaucucugcuugauuguuuuuuguuuguuuuuucagccucaauuaaacauguuuaacaacaacagcagcagaugcugcgaugacgacgaugauggcugacguuuauugggugcucacuaugugcuagaugcgaugcucagcucuuuauugacauuauuuuauuuggucuucacgccacucugugacauaguaguuagcgucugugcuuuuaacuguguucuuugaccguucauccuguacucuuuuuugaggcagggccucgcucuguuucccgggcuggagugcaguggcacgaucucggcucacugcagccuccaccuccugggcucaagcaguccucccaccucagccucccgaguagcugggacuacaggcgggcgccaccaagcucgacucauuuuuaaauuuuuuguagagacgggggucucacuguauugcccaggcuggucucgaacuucugggcucaagcaguccucuucccucggccucccaaaguguugggauuacaggcgugagccauugcguccuguacuaugucuuaaacaccagucacuagauguuuuggggcaaacuacaucuggggagccgaaacugaggaauuagaaaaggcuaggguccuaaagcuaaagccauagacagauggagccuuuaugaagguacagaggauggaugggaucaagggcaaccaauggauggauugaccuuugguacguacagcaaggcuucuucaguuguaacaggagcgaggacagagaauacaguugcagauucagaugaguuuagagauugguggugggaagaugagugagagaguuccagcccacucuucaguuuccuaaaugaagauaaagucaucaaccggagggauggaagggaaggggcaggugacaggagggguuagggaaguuagacgagugaccuuugguaagauucauaguuucucugaagcuguuuuucucaucugugaagugggacgaugucuucacagggucaccauauagcauuuaggaagaugcccugcagccaguauauuuuaguuuacuuuuuucucuugccucccagccaagaugugucuguccuauauaacuuuucccgcaggauucuucucuuuuaguugauaaugaggugauaauuucgucgguuuugcuaucucguuaauauguuuccuuuauucagcaaauauugagcugggggcuaggcauaccacagagaacaagacagauuucugcuuucagggagcuuaccuuucucucuguuuucauuuuaacuccuaauaccuuggccuuuuagaagaaacaaaaaaguuauugacauuaacccccaguguuuaauuguuuugauguuaacuucauuuguguacaaaaauagagcgaaguauaaacuucauaaucuuuuaguuuauuuauagcuaaagaucucaauuaauuugcagaaaacccacaaauaugcuuuuucuguuacauacagaauuauaaaaccaguaacauuaaaaguacuaacauuggcuggguuugguggcucacgccuguaaucccagcacuuuggaaggccaagacaggccgauccccugaggucaggaguuugagaccagccuggccaacauggcgaaacgccauuucuacuaaaaaaaaaaaauacaaaaauuagcuggccauggugacuggugcuaugcaggaggcugaggcaggagaaucgcuugaacucaggagacggagguuucagugagcugaaaucacaucacugcacuccagccuggacgaaaagagcaagacuuuauuucaaaaaaaaaaaaaaaaaguacuaauauugguuuaaugcaauagacagugucuuuuguugaaacuaaauuggcagaguuggguuuaauaacagaaaggcauauauuugcuucuuuuauguuuuguuugcugacuugauucuuuugcuuuugacccugauggaugacuuauuaauuuauguauuuaauuuuugggagaguugagauaguagaguuuccgaugaaaacuggaaaaccugcuagacaaauucuaaaagaacuguaauacuggauuaucauuuaaauuaguguuauuuuuacuguuuucaccaaugaauuuuuuuaaacuauaaauuaauuuuuuauaauggauucaguuaauuuaacaauuccccuguauaauugugaaaauuaaaaauacugauuaaugggaccaggcgcaguggcucacacauguaaucccagcacuuugggaggccaaggcggguggaucacgaggucaggaguucgagaccagccugaccaacauggugaaacccugucuuacuaaaaauacaaaaauuagcagggcgugguggugcacgccuguaauccuagcuacucaggaggcugaggcaggagaaucacuugaaccugggauggggagguugcagugagaggaucgugccacugcccuccagccuuagugacagagcaagacuccgucucaaaaaaaaaaaaaaaaaagauuacugauggcuggcagugagaaugugcuucagacugcuuugggaggggcucuuuugagcaugacaugccuagcaccaugggacuuaguucucccuccacauuucuugaaagaauguagccucugaaguuagauugccuggguuuuauuccuagcuccccccaguuauuauuggguaggucagugucucaaaccgucagcuuccucauuguaaaacaugacaauaauagcaccuacuuaugaggguuguuuuggggaucaugaaguaacccauaaaaagcacuuagcauagugccuggcacguaguaauguucaaaaaguauuaaccauugacauuaucguuacuaacuuauuaugcauaagauguguucguguagccugauggcauuuggcuuucacuuuaucagaaagauaaaggcacauuccaggauggaaauuguaugguaguacuacuuuaugaguuagucaucuagaucuuucauguuauuuauucauuuacuuuucuaggauuagcauucaaaugaaagcauuacaguuuuuuugugggucucauaguaugaggcuuauuaucucagucuacucccgaguagcuaggacuacagaugcauaccaccacccccggcugauuuuuguauuuuuuguagagaugguguuuugccauguugcccaggcuggucuuuaacuccugggcucgagcaaucugcccaccacaaccucccaaagugcuggcauuacaggcgugagccacugucugaaaguagcuuaauaaauagcucuaauauuagaaguuucaagaacuaggccgggcacaguggcucaugccuguaaucccagcacuucgggaggcugaggcaguaggauuaccugaggucaggaguucaagaccagccuggccaauguggcaaaaccccgucucuacuaaaacuacaaaaauuagccaggcgugguggagggcaccuguaaucccagcuacuuaggaggcugagacaagagaauugcuugaacccgagaggcggagguugcaaugagccaagaucguaccacuguacuccagccugagagacagagugagacuguuaaaaaaaaaugaaaaaauaaaaaaaguccaggugcgguggcucaugacuguaaucccagaacuuugggaggccgaggcaggcaaaucacaaggucguggguucgagaccagccuggccaauauggugaaauccugucuguacuaaaaauauaaaaauuagccggucaugguggcaugcgccuguagccccagcuacuugggaggcugaggcagaagaaucgcuuaaacucagggggcagagguggcagugagccaagaucccgccacugcacuccagccugggcgacagagcgagacuccgucucaaaaaaaagaaaaaaaaaagaaaaaaagaaaguuucaagaacuaggcaggugugccgggcacaguggcuuaugccuguaaucccagcacuuugggaagcugaggcggguggaucacaaggucaggagaucaagaccauccuggcuaacauggugaaacccugucucugcuaaaaauacaaaaaauuagccaggcgugguggugggcgccuguagucccagcuacucgggaggcugaggcaggagaauggcgugaacccgggagguggagguugcagugagccgauaucgcaccgcugcacuccagccugggcgacagagccagacucugucuuaaaaaaaaaaaaaagaagaacuaggcagguuuguggagaaaaauuuggcaaaaaagucuuucaucaauguggagauugcaccacccagcagcugccuggcccucauauacagauugggucuguccuucuguugugugccucugugugucuacaugggcucaugcuuuuuauugucaccuuuacagucuagucuagguggcagcgugcccagguagugguuuugugagaagaggguaccaugaugugggucaaauaggucuuccuaguuuaaaugcacucaagggcuacauugagccauuuuguaguaauaucuuccuuucauuuguauaaauucucuagaauauguguggauaauuucagcagucuagauuuucucucuuguuuucuuguuuuguuuuuuuuguuuuuuuuugagacggagucucacucuguugcccaggcuggagugcaguggcgcaaugccggcuuacugcaaccucugccucccggguucaagugauucuccugccucagucucccaaguagcugggauuacaggugccugccaccacacccagcuaauuuuuguauuuuuaauagagacgggguuucacuguguuagccaggcucaucuugaacuccuaaccucaagugauccgccugccuuggccucccagaguguugggauuacaggcaugagccaccacaccuggccagauuuucucucuuuacccuuaccagaugguggucuuuguuuuuuauuacuguuggauaaccuaauuaguuuuguuuucaccauacuugaaacugauuucuuguucaugucucuucuuuucugaauucuguuucuuauuugcagcugaauuugugaucagucuugcugagaaaaauaccaccuuugauacuuuuaaggcuucucucgucaaaaauggugcagaauuuacgguauguauauguggagaagauaaucuguagauauuaauguuuuaauuuauguuuguuuguuuguuuuuuuuuuugagacagaguuuugcucugucgccugggcuggagugcaguggcgccaccucagcucacugcaagcuccgccucccggguucacgccauucucuugccucagucucccaaguagcugggacuacaggugccugccaccaugcccggcuaauuuuuuguauuuuuaguagagaugggguuucaccguguuagccaggauggucucgaucuccugaccucgugauccacccgccucggccuuccaaagugcugggauuacauaauuuauguuuuaaugucacuauugauuuuaaauuuugauaggguuuaauauaggauuuugauauaggaaggagacaauuuuauacauaucaauuaaauaagccauuaaguguguaauguuuucaugccauuaaguagugaugauuuaaccagauuuucugugauaccucuaggaaaacagggcaggauuuucaucauuaagucuuuguagguauuuacauucuuguucugugagucaggaaguuggaaacaaguuuuggggguaguucuaaaccuugggaaauaaaaugguugcagggagccuaauaacuuuucuccccaaagaguccuaaauaucggcuuucucugaagcuauuauacuagguucaugcuacaccagguugacacacuauguuucauguauuccaauuagcuaaauucaagugcguaaccacccuucccuacaggacauucuuugccuuuuaaguguauuuaagcacugauaugggagcugacaauuuucguucuauguuucuuuucaaaggauucucuuauuaguaacuugcugcgucucauacaaaccaugcggccuccagcgaagccuuccacuagcaaagguaagcagagcuuccagcugagcuuagcuucuagaaugguguagguuuugaacauccuguaaauugcauuuguuuuccucucagcaguugcugagcaaguaaauguuccaguaagauuuuucaaaugggcugggccuagcggcucacugcuggaaucccagcacuuugggaggccaaggugggaguaucacuugagcccaggaguuuuagaccagccugggcaacauagagagaccucaucucuacaaaaaaauaaaaaaauuagccaggcaugauggcgugccuccguaguuccagcuacuugggaggcuaaggaaggaguguugcuugaguccaaaagggugaagcugcagugagccauaguugcaccaauguacuuuagccugagugacagagguuuuuuuccccguuucaaggggaaaaaaaauuucaaacgacuuaagacaaaauaaaaaagauaagacauaacccaaugaguauugcuacacuccucuuucugcuacauuucgagauaguuugugaucaauguauuuagaaaauuaaauuacauuuauaguaacagguaugauuaauauauagcaaaaugccauguucuguuucaguuugauacaaaucuauuguugaaguuauuuuguuaaucauuaauaauauuaaauauauaucucuuuuuuuaaccccuucaugcucuuuaaugaaacaagauccaguuguuaaaccuaaaacagaaaaagaaaagcugaaggaacucuucccaguccuuugccaaccggacaacccuucuguucggguacugauaccauuuuaagagugucuacuauaaauauauauucucaaccccuuuucuuugucucauaguaauuuuauuaauuuuaaguuugccuuuguuguaacuuauuuuuaagaaugaaaguguuugaucacucccugagcauguacuauguauugaauuuguuaagggguucugagaaugauauucaagggaaaugagauugggaauuuggggaaguagugauuaggaauaugaaauaagguucuggaacagaugccuaaggugugaaauuagauuuuuuuuuuuugcucuguuacuuguuaaaggucuaauuuuuaaagcauuuugauuuuuaaauuucauuuuaauaaauauuuauugaguacuuacuguaugccaaacacuguucuaaguaccuggauaacagcagugaacagaacagacaagaguuucagccuuuggagauuauauccuaauuuugggguagggagcaggaaauaaacauguaaacauucugguggggaggagauaggcaauaaacaaacaaauagguauguaacauagcagauagcaauaagggcuauuuaaaaaaauaaagcuggaguggggguagggaggaagagugcagagggagaguugcuuuuuaaaauuuuuaacaccuguuuucuauuaauauaaucaucacuugcauucuuucauggcagggaugauuaauaucuaacugccuuucauagaauucuauuaaggacagaggggauuugucaaauguagcaguaauucucaagagccuuuuuuccauuucuucugcaucuauccugaaucaaguuugaaaucucugccccucuucuauuucccucacauagugauuagugauuuauagauguaccugagguacauacagauucuugaguaguuuuuuuuccuaacuuugccggccucuaccucugcagaccauguuggaugaagaugaugugaaaguugcuguggauguccugaaagaacuggaagcuuuaaugcccagcgcagcaggccaggagaagcaaagagaugcugaacaccgguuuguccuuaguguccuguccuuuggaaguuuaggguacugugacaguugaauauuauggaccagccaagcaaaauuuugggcaaguuuacagaaucuggacuggucauauaucauauuguuggaucuguuuucauugcuuccugcuaaguguauguagcaaaugcuagguuguucagaauauagaagucaggguugaaagaggcugaauauguuuguggcucaauucuuuauuggcuuauagggaugucguaguuauugaaacucuaauucaguucaaaaccuaguggguaccuaccaugugcauggcacuguacugggugcuuggggaugcgaagaugaaaucggauugguuucuuuuuuaaacaggugcuuauugauuuguuagggacaggacaaagaagaagaagcggagucgaagccgagaucgaaaccgagaucgagacagagauagggaacgaaaccgagauagagaccacaagcggagacaccgaucccgcucucgaucacguuccaggacccgggagaggaauaaagugaagucuagauaucgguccaggagcaggagucagaguccccccaaagaccggaaggaccgggacaaauauggagagcggaaucuggauagauggcgggauaagcauguggaccgcccuccuccagaagagcccaccauuggugacauuuauaauggcaaaguuaccagcaucaugcaguuugguugcuuugugcagcuggaaggacuaagguaaugacuggugcucuuuuguucacaccagugaugggcagaauuucuuuuaucacugaggauguucacauucuaaaaaguuacuuugauuaaugacacuuuagucaaaucagccauacaugguucuuagaaauugacucuuuugaaauguuacagagccauuuauuccuuucucugucuucaggagaucuguccuuugcuuguugggacagauagaauuugcuuccccaccccaugucuccccaugaggagaguguuaauacuauuuuauuguuugaccaccuucaugguacuuuucucuugaguuuaagaccauuuucuuuuguuaguuccaguaaggguagaaauugguugggggaaaaauauuuuuuggcauguuccagaugugucuggcucucccucaggaagcggugggaaggccuggugcacaucucugagcuccggcgggagggucguguggccaauguagcugaugucgugagcaaaggccagagggucaaagucaaagugcuguccuucacugggaccaagaccagccugagcaugaagguaggugagauggucagccuguucuuacaugugauggccaagggaauggaagaggacagcaagugagacagcucccuuguuuuugugccuuaggauguggaucaagagacuggagaagaucuaaacccaaauagacggcgaaaucuugucggggagaccaaugaggagaccucaaugcggaauccugauagacccacucacuugucccuugucagugcuccugaaguagaggacgacucacuggaacgcaagcgccucacccgaaucucugacccagagaagugggagaucaaacagguuggggccuuuaguuuucaugaccagauagucauucagcauguagcauggugcuuaggggugugcccuggagcacgauggccugggauaacuuuuggccacuguauuagucuguuuucacacuccugauaaagacguaccugagacugggcaauuuacuaaagaaagagguuuauuggacuuagaauuccacuugguuggggaggccucacaauuauggaggaaggugaaaggcauaucucacauggcaguagacaagagagcuugugcagggaaaugcccuuuuuaaaaccaucagaucucaugagacuuacucacuaucgugacaacagcgugggaaagagcugccuccaugauucaguuaccguccacugggucccucccacacacguggaaauucaagaugagauuuggguggggacacagccaaaccauaucagccacuuauuagccguguaauccuuagcuaagcuacucuaccucaugccucaguacccuuuucuauaaaacaggaccaguguugguggugugaggauuaauuaaaggugaaagucguugggcgugauggcucacacguguaaucccagcacuuugggaagcugaggcgggcgggucacgagcucaggaguucgagaccagccugaccgguauggugaaaccccaucuccacuaaaaauacaaaaaauuagccgggcgucauggugcgcgccuauaaucccagcuacucacgacgcugaggcaggagaaucgcuugaacccgggaggcggagguuacagugagcugagaucaugccacugcacuccagccugggcaacagaacaagacucugucucaaaaaaaaaaaaaaaaaagugaaacucuuagguuaguguuuagcauaugguaauugcuauguaagucuucauucuuuuguuuucuuuccuuuuuuuuuuuuuuuuaauugagacggagucucgcucugucacccaggcuggaguacaguggugcgaucucagcucacugcaaccucugccucccggguucaagcgauugucgugccucagccucccgaguagcugggauuacaggcgcccaccaccacgcccggcuaauuuuuuugaauuuuuaguagagacgggguuucaccauguuggccaggcuagucuugaacuccuggccucaggugauucucccaccucggccucccaaagugcugggauuacaggcgugagccacugugcccagccuauuguuuucauccuucuucacuaaauaacauaaccguggugugucaagcaccaugcagggcuagggcuauaaacgcgaauauaucaugguugcuaugcuuaaggaacucaaaguccagcagaggagacagaucuaaacaaauaauugugagggguuacauauuuuuuccuuuauuuuugaggcaaguucuuacuugcacuauugcccaggcaagagugcaguggcaugaccauggcucacugcagccucaaccuuucaggcucaagccauccucucaucucagcuucccaauuagcugugaccucaggcacaugccaccaugccuggcuaauuuuuuaauuuuuuguagagacagucuugccguguuaccagugcucaucucaaacuccugggcuccaagugauucucuugucucagccucccaaaguguugagauuacaggcaugagcugccgugucuggccuacguauuauauaauaaauguaccagagugcuguggaaacaagggaaagagcagauaacuuuuccuggggauaauacuuuugagcuuauacuuuacagcaccauguuggagaaccaccucugcaacccuggaaugggauauaugacauuugagcucccgauaucgugggucagaggagaaaaaaacuggguuuccuacaugaaaccucuguaauuaacucuccuagaaaagaagaguuuuggcugggcaugucgcugacacauguaaucucagcacuuugggaggccaaggcaggaggauugcuugaggccaggaguuugagaccagccuggacaaguagugagacccuguuucuagaaaaaauuuaaaaauuagccagguauuauggugugcgccacuagugucagcuauucaggaggcugagguaggaggauugguugagcccaggaguuugagguugcagugagcuuugaucaggucacugcacuucagccugggugacagagcaagauccugucucaaaaaaacaaaacaaaaccaaaaaacaaaaaaaaaguuuugaucuuagcagguuacaaaugcugccuucucuucuuuggcuagaugauugcugccaauguccuuuccaaagaagaauuuccagacuuugaugaagagacuggcauucucccuaagguggaugaugaagaagguaacuagucaguuggaucgagaaggguaauuggcaaguugagccauugaauugggugauuugccuguaguuuaacccaguggcuauuaaucauuuguucuuuggaucucacuacucaucucucaaaaaaaaaaggaucucaccaugauggaagcaagaaguucauuuuucugacaagugcuuauguauuauuauuauuauaccuguugcuuauaauaagcucucagggccaggcaugguggcucacgccuguaaucccagcacuuugggaggccgaggccagcagaucaccugagguuaggaguuugaaaccagccuggccaacauggugaaaccgugucucuacuaaaaaaauacaaagauuagcugggugugguggcgcaugccuaucgucccagcuacucgggagucugaggcaggagaauugcuugaacccaggagacggagguugccgugagccgagaucgcgccacuguacuccagccugagugacagagugagacucuaucaaaaaaaaaaagcuuucaggauauaaaaaguuauaauuguauuuuugggaguaaauuugaucucauauucuuaguaauuauucugaaaacccuggauccaccuagauuaccucugaguugcccuggaaacaacuuuuaacucagcccauaaugacuuuuuugaaauuaugaaaucuuaugauagaauucucuaacuuauauuguaguaguaagugagcaccuacguacucaccacccagcuuaagaaguagaauuuuacaagcaccucugaagccccuacaugcuccccucugcuuagaucuucuuucuuccuucuaggaguaaccaccgucccacauuuguguuaauuacucccuggcuuuucuuuaguuuuaccaucuacguaucuaucccuaaacauuauauuguguugucuauuuuugaacuuaacucauuuuucuuuuuuuuugacuuacauauuuuugauauuuauguugauauuuauauugguauuucacucacuuuuauugcuauagaguguuuauauauaaauugucuauaauuuauccauuuuacuuuugauggacauaugaguuguuucuugguuuuugguuaaucuuugugaauaauaguauuuugaaauugcuauauugucucuuagugcuuaugugcaaaauguucuuuuuucccuaaaugcauagaauuacuggguaggccaagugucauggcucagcccuguaaucccagcacuuugggaggcuggcugagaugguaggauugcaugagccuaggaguuugagaccagcccuggcaacauagcuaggcccugucuuuacaaaagaaaaaaaauuagccagguguagugaugugugccuguacucccagccacuggggaggcugaagugggagaauugcuugagccugggaggucgagggugcagugagccauggucaugccacugugcuguagccugggcaacagagcaacacccugucuuaaaaaaaaaaaauuacuggguaguaagaaauguguguguuugacuuugcugggcaguuccaaauuguuuucuguugguuucuguaccguuuauacuucugccauaaguguaagcaaguuccgcuugguguuguucaauugucgaacuaauuuuuuacaaauuuauuuuggguuaagaauuauuccacaaugaaguuggauggcaaaugcccuaguaccauuuagaaugucaggagagcauuuucucacaggcuuaacuucuuuucaaaguaggucugaucaguucuugggcuggagcacaaaugcucuagaaauggcuggugaugggggaauagucaccuggguuagaguuuuacuugcauugcuguccuuugaccugggaagguguuuuuuuuuuuuuuuuaauuugagacgggguuucguucuuguugcccaggcuggagugcaguggcacggucuuggcucacugaaaccucugccucccggguucaagcgauccuccugccucagccucccaaguagcugggauuacaggucuguaccaccaagcccagcuaauuuuuuuguauuuuuaguaaagaugggguuucaccauguugaccaggcuggucuggaacucuugaccucaggugaucagcccgccuuagccucccaaagugcugggauuacagguaagagccacugcacccggccuuuuuuuucuuuuuuuuuuuuaagacagagucucacucugucacccaggcuggagugcaauggcuugaucucagcucacugcaaccucugccuccugggugcaagcuauucuccugucucagccucuugaguagcugggacuacaggugcccaccaccaagccuggauaauuuuuggauuuuuaaugagaugggguuucacuguguugaccagucugaucucaaacucuugaccucaagugauccuccugccucagccugccaaagugcugagauuacaggcgugagccaccaugccccaccaggggaagcuguuuuugauaaagauuguugguaccuauggaaauuaauugucuuggugaaaauuguuauuuuuucuuguuuauggcuaauucuucuuuuggggggacuuuuagaugaggaccuugagauugaauugguugaggaagagccuccauuccugagagggcacacuaagcaaagcauggacaugagccccauuaaaauugucaaggugagaauuacuggaccuuuaaccuggaaaugucaaguggacuucuuuuucuaaaguaaugggucagguuauuagaucugcguaaguagaacuugggccacagaaaguauuacuggcuguuagccagggucuauaauaguuuuauuuuaaauggagguuggguuggcuuuauugcuuuugccuguugaauucuuuugugcuccuuuuguguauuuuggguggaagcagagauagauaggaaugcuuaaucugccaucauugccuuugccuggauuccuuagggcuugaaucuugcagauucaaaggcaauuuugaaggauuuacuugagcacuuggggcuggccaccauagaaagcuguagcacugggugcuggagagggcagagcuguaaggggaauccaaaccagaauucauagaacaauaaacauuuuagguauggaaaaggguauauuuaaaggucucccagcccagcacauaugaaaugcuuauaauccacgcauaucauucuucugcgguguucuucucauauggucaucucauagcugcaugacauuguuagugacagggaauucaccagcccuuaaggagguacauuucaucaugagauggaucugaucgcuaguucuucuuuaggcauaccugaaaccucgcucacugaaguguccacauuggucuugauuuugguucccagggucauacagaaaaauucuuauaccuuucuuauguccuucauacguuuaaagguagcacaucauuccuaucucuuuugggguucucauauucaaacuaaacauccaguuccuucaaugauguaacauuguccuuguucauuuuaucugaauaugcuacgguuuauccauuucuuucauauagucuguuacauugauaagaacuuuauuccagauguagucucauguuuuagauuacaggagcuuaacuucuacauauuauuucccggacauuuaauccauguuguuuuuucuucuguugcaccagaacccagacggcucccucucccaagcagcaaugaugcagagugccuuggccaaagaaaggcgggaacucaaacaggcccagcgggaagcugagauggauucuauucccaugggacucaacaaacacuggguugacccucugccugaugguaggacccuuggagggguguauggaccuuguuuaaaaaucugagccuuucagaacacagggaggggucacucccggcacacacuaaaaauuuacccuugggccggggcgguggcucaugccuguaaucccagcacuuugggaggccaaggcagguggaucaccugaggucaggaguucgagaccgaccuggccaacauggugaaaccaagucucuacuaaaaaaauacaaaaguuagccaggcaugguggcacacaccuguaaucccagcuacucgggaggcugaggcaggagaaucgcuuaaacccaggagguggaaguugcagugagcugagaucaggcaaguguacuccagccugggugauagaaugacacuccaucucgaaaaaaaaauuuacccuugguuuuucacuucaguuagagcauguuugguuuuuucuuaaacacauguuuaaaaccaaaaauguuuuaauagccauggucaaaucauuagacugaguuuuucuucugaaucacuuuaaaaauguuauucuagcgcggugucucaugcuguaaucccagcacuuugggaggcugaggcgggcggaucacaaggucaggagaucgagaccauccuggccaacauggugaaaccccgucuuuacuaaaaauacaaaaaauagccaggugugguggugcgcgccuguagucccagcuacucgagagacugaggcaggggaaucgcuugaacccuggaggcggagguugcagugagccaagaucgcgccacugcacuccagccuggcuacagagugagacuccgucucaaaaaaaaaauuuuuauucuaaagguaauacagcuuugaagcuuccuuuuucauauaauucuuugugcaguaaauauuagcuacuagauauagucauaacaaauacuuauuaauuuaauuuguguuuggcaacuggggauacgauuugaauuaaacagauaugaucccugcuuuuaugcgcuacaacuuagucggggauauggauauuaauuaaauaaucaccaaauaauuaaauuaugaucagugccaugugaagaaguacaggcaguguaauugacuguggugggucacuucccuggggaaaucgagacccaaaggauaaauuggacucagucugucaaguggagaugggauggagguuggggaguauguuccagccugaggaguagcccguguuggguuuguggggugggaaagaaggaacugaaagaaggcuuguguggauggaauagagagagcagugggcagugguaggggaugagauaagaacaucaggccagggcuuuguagguggcauuaggaagcugggcucaauucuaauagcacugggagauguugaaaaguucuuuuguuguuguuguuuuuguuucugagacagaguuuugcucuuguugccuaggcuggagugcaacaccaugaucuugacucacugcaaccuccaccucccugguucaagugauucuccugccucagacucccagguagcugggauuacaggcaugcaccaccacgccuagcuaauuuuuuguauuuuuaguagagacgagguuccuccauguuggucaggcuggucucgaacucgcgaccucaggugaucccccccccaucucagccucccaaagugccgggauuacaagugugagccaccgugcccagccagauguugaaaguuugcagcuggcacauggcaugaccagaguugcauuuccaaaggaugauugagggugcccugcagaaugaguuggauggggcacaugugaugauuuagaaagcuuuuaugaagagagagaaugguggcuugaacauggagguagcaaagaggagggauguacuugagaaaaguaauuuguugaauguggggcaacaggaauggucaaagaugacuuccagguuucugguaugagcacuaggaugaaugaugggaacacuggaggagaaauggguuuguggggaaagauggucaaauuccguuuuggacuuguguccgaggcaacuagaggacaucuuagguugagguauccaguguagaauugaguauaagagcucagaagagaggucugggcuggagacagaaguuugggaauuguguuaauuuagauaucaguuuggcugcauguaauagagauucaaauauuagauuagguucggcaugauggcucacgccuguaaucccaacacuuugggaggccgaggcaggagaauugcuugaggccaggaguucaagaccagucugggcaacauaguaagaccuuaucuguauuuuauuuuauuuuguuuuguuuuguuauuuuaguuuaguuuaguuuaguuuuugagauggagucucacuauguugccccagcuggagugcaguggugcagucuuggcucacugcaaccucugccuccuggguucaagcgauucuccugccucagccucaaguagcugggacuacaggugaccgccaccacgcacgaguaauuauuuugcauuuuugguagagacagcguuucaccauguuggucaggcuggucucgaacuucugaccucaaaugaucuugcccaccuuggccucccaaagugcugggauuacuggugagccaccgugccuagcccuugucucuauuuuaaaauuaaauuuuuaaaaacgacaaaaauaaaaaccaaaauauuagauuuacaguagaagguuggacauauucguucauuguuuaacaauaucaucuuccauuuccucagaauaaacccauucauucccuuuuacccuuuagugaaauguucuccaugacccuccuuuggccucugccuaagcucacuuauuugguuaguaggcauaaguauuuuuucguagccagcuuuuggcaucaaauuuguaaaauguuugcauaugcuagagagccacuaaaauucugcucauuuuuuuuugcuccucaagccacaauuccaaggugaaucuugaaaauauaagcuaggucugggcaagguggcucacaccuguaaucccagcacuuugggaggcugaggcagacagaucacuugaguuggggaauuugaaaccaagcugggcaauguggugaaacccugucucuaaaaaaauacaaaaauuaguccaggcaugguggcucaugccuguaaucccagcaguuugggaggcugaggcggguggaucaccugaggucaggaguuugagaccagccuagccaacauagugaaaccccaucugugcuaaaaacagaaaaauuaacagaugugguggcacgcaccuguaaucccagcugcuagggaggcugaggcaagagaaucacuugaaccugggaggcggagguugcagugagccgagaucacgccauugcacuccagccuggacaacaauugcgaaacuccaucuaaaaaaaaaaaaaaaaaguuuagccguguguaaucacgugcaccuguauucccagcuacucaggaggcuaacgugggaggauugcuugagcccaggagguggagguugcugagcugagaucucgccacugcacuccagccugcugggcgucugagccagacccugucucagaaaaagaaaaaaauuaaucugagagaaaccaggcacaacagaccacauauuguaugaaguauccagaauagaacccguagacauagaaaguagacuaaugguugccaagggaaaggaaaagggaggaauggggaguaacugcuaauggguacaggguuucuuucugauaugaugaaaauacucuaaauaguggggauaguugcacaacuuaaugaauauacaguaaaacacugaguuaaacacuuaaaaagaguaacacggagaccuggcuugguggcucauaccuguaaucccagcacuuugggaggccaaggagagaggauuccuugaacccaggaauuugaggcugcagugagccgugauugcgucacugcacuccagccugggaaacagagcaagacccugucucaaaaaaauaaaauaaaauaaaaaaaguguaacaugguuugugaauuacaucucgauauagcaguuauuuaaaaaggggagagugcugcgcaugguggccauaccuguaauuccauuacuuugggagggugagauggguggauugcuuuagcccaggaguucgagaccagccuggcaacauagagugaccucuucucgcuugagcccagaaggucggggcugcagugagucaggauugcaccacugcacucccacuuggaugacagagcaagacccuaccuaaaaaaaaauaauuccagugucaagcagucaggucuucacuucucucaacuaaccuuuuuucugacaucacagguguguagcaccacuuguuacagucucuuucccauucccugcugccccuucuauauucuuuucuucacauuaauuuguuucuuugaguacuuuugaucacgggucgcugaauugagaugcugcaugugcagugcccgcaugccauuuuauuuuuuuccugguacaucuugagguagcuugaggacaauacuaaguugccuguuuuccuuuccagcggaaggcagacagauugcugccaacaugagggguauugggaugaugcccaaugauauuccugaguggaagaagcaugccuuugggggcaacaaagccucuuacggaaaaaagacccagaugucaauccuugagcagagggagagccugcccaucuacaaacugaaggagcaauugguccaggugagaagacuuuuaugauguauugguggggaguaggguuauugucuaaaagaggggugauauuuuuaaacugaaacuaacgggacaaguaugugccuacuugaaguggcucauccaaaagaguuaagaaagaaggauaaaacuuucuaaauacuuuuuuuuuaaauggggcugggcgcgguaguggaugccuauaaucccagcacaucagaggccaaggcaggaggaucacuugagccuaggaguuugaaaccagccugaggcaacauagggaaucuugucucuacaaaaaauaaaaaauuugguggggcgugguggcccacaccuguaauccggcacuuugggaggcaaaggugggcggaucacaaguucaggaguucgagaccauccuggccaacacggugaaaccuugucucuacuaaaaauacaaaaaauuagcugggcgugguggcgcaugccuauaaucccagcuacucuggagucugaggcaggagaaucgcuugaaucagggagucggagguugcagugagucaagaucacgccgcugcacuccagccuggcuacagagagagacucugucuaaaaaaaaaaaaauuaccuggguguggugguccaugccuguaaucccagcuacucgggaggcugagauaagaggauugcuugagccugagaggucgcggcuacagugaacugcaaucacaccacugcacuccagccugggcgaccaagugagaccccauaucacaaauguuugugugugcguguacagacacacauacuuauguaugugucuguauaucuucuuuuuccuggggccccuagaacaguuuccaagugggcagaguauuguguugcauggaccaacagcucuguucaguaauuaaaaaugaggauacucagucaauaaacucauaugggcaacucauagagugcuucgguacucuauauucuggaguucugauuuuaagaccaccgagucuuccuugagguaaucagguuuacuaguuucuagugaauccuuucaacaauaucuuauauguauacaagcaaguacaaauauaugcacacacacgcacacacauuuuauaugaguacuguguguguuuacagguggcagugauauuauauacacuguucuacaucuuuuuccacuuaaugauauaucucagagauuuguguguguguguguguaugugugugugacagagucucgcuuugugcaggcuggaguacaguggcuugaucucagcucacugcaaccucuaccuccugggcucaagugaucuucccaccucagacucccaaguagaugggacuacaaggcauacaccaucaugcucagcuaguuuuuuguauuuuuuguagagaugcggucucacuauauuguccaggcuggucuugaacuccuggacucaagcaauccucccuccuuggccucccaaagugcuaggauuacaggcaugagccacugugccuggccuucuuaaacaaacaaacaaaaaaaauugccaggccaggcacaguggcucacaccuguaaucccaauacuuugggaggccaaggcgggcggaucaccugaggucaggaguucgagaccagccuggccaacauggugaaacccugucucuacuaaaaguacaaaaauuagccgggcgugcuggcgggcacuugcagucccagcuacuugggaggcugaggcaggagaaucacuugaauccggaagguggagguugcaaugagcugagaucaugccacugcacuccagcaugggcgacagagugagacuucaucucaaaaaaaaaaaaaaagccuuuuuuuaugggcuguauuauuuggauaggcucugguuuauuuaacuaguccuauauccauagaaacaucguugauuguaauccuuggcuguuacaaacaacguagaaauaagaaauaacuuuuggggaaagauauagaaauuugggaguuacagugggaaggaacauuuuuuauguaucuuuuaaauucauuguugacuucuuuaacuauauguguauauuccucuuuucuuugguguuagaauauaguaauuauuuuauuccagaguaauguagauuuuaaugaccauauuuauauucuguuuaaugaccauauuuauauucuggcagauuuuaaugaccauauuuauauucuguugcuuucaggccguccaugacaaucagauccugauugucauuggugagacaggaucuggaaagacaacacagaucacccaguaccuggcggaggcaggcuacacuuccaggggcaagauuggguguacccagcccagaagaguggcagcuaugucgguggccaaaagagugucagaggaguuugguuguugcuuaggccaagagguaaguagauaguggagucgcucgaaaaauaccagaagcaaaggcccaggucucuuaaucuaucaaauggaaauauuaauaauacugccuuuuuucagguuucuccugagggagagaggguucccauugucauaaucagucuguucagaguauagucuaagacauaccuuacuaugaggaaauuacuguacaucuugaucagauucuuaagauuaugagugagagugacugggcugaaaucuugccuggugauugggaaaaggagacauuuguauccuagguuuuccccuucucuucugcuuuaggugggcuacaccauucgauuugaggacugcacuagcccugaaacagucaucaaguacaugacagaugggauguugcuuagagagugcuugauugacccugaccucacucaguacgcgaucaucauguuggacgaggcacaugagaggacaauucacacugaugugcucuuuggauuguugaaaaagguaacuagaugcucuuuaaugaccccucuaccuguuggaagcugaauucuggcaguuggauuugaguaccugugucuuuggguaguccuuuucaguaagccacauaauauuucucuucagacaguucagaaacggcaggacaugaagcugauugucaccucagccaccuuggaugcagugaaguuuucucaauacuucuaugaagcucccauuuucaccaucccaggucgaacauauccaguggaaauacuguacacaaaggaaccugagacagauuaucuggaugccagccugauuacuguuaugcagauucauuuaacagaaccaccagguaaggggaaaaagcaauuuuccuuuuugggaggccuaauuuucccucuuaggccaaaaguccucauauggguaucuuuuuugcuaaucuuuuuaaaaacaacuucuaaauauucaucucucugcaagccucaggcuuguauguuugaaaugauggugguuauaaugucauauauaaacaaacuuguauuguuuacuuacuggucagaauaugaaugcauauguucuguuauuugaaguuuuauuaauaucaccauagcccuuguauaggacacacauacacacacagaaaguagaugaauguucuauucugcucguaggugauauccuggucuuccugacuggucaggaagaaauugauacugcuugugagauccuguaugaaagaaugaaaucccugggaccugauguuccagaguuaauuauccucccaguguacucugcucuucccagugagaugcagacccgaaucuuugacccagcuccaccaggcagcagaaagguaacaugggcaaaaaugaagcuuccaugugcccugaaaccauguguugugugcagccugucagccauaguagggauugcuuaggguguaugcaagucuuuuuuuuuuuuuuuuuccucgaggcagagucucgcucucacccaggcaggagugcaauggcaccaucucagcucacugcaagcuccgccucccggguucacgccauucuccugccucagccuccugaguagcugggacuacaggcaccugccaccacgccuggcuaauuuuuuguauuuuuaguagagacgggguuucaccguguuagccaguauggucucgaucuccugaccucgugauccgcccgccucagccucccaaagugcugggauuauaggugugagccaccgcgcccggccagguguaugcaagucuuguuuguuagguuucagagacugguccaaccaauuuguuuaggaaugagguccaaccaauuuguuuaguaugugaccucuccucuucuuccucuucuucauuugacaaauauuuuuugagcaucuaccaggcuuugggcuacacaugggagcugcauugugagaacaagccucuaucugcuguggggcaucccccagucaacagacuuucagcauuuagugugaaaaugccacucaugcuuggauacccaggcgggagcacccaacccugucuuccuagaggaaauaaggaucuaagguaguccuggagaacucuugaaaggcaaggggacaagcauucuaaggacacagaacuaucugugauggccuggagacgagcaaguagggccaguucagggaauggcauaguuccaguggcuggaaccaaguauaugacuguguguaugagacaacaggaaaggagacagauggauguagguauuuuuuuaguaacaguuuuauugagauauaauuuacauaccuuucaauuaacucccuccaccucccacuuauuuuuuuuuuuuuuuuugagauggggucucagucugucacccaagguggagugcagugaugugaucucagcucacugcaaccucugccuuucaggcucaagugauccuccugccucagccgccuaagcagcugggacuacaggugcaugccaccauucuuggcuaauuuugguuuuuguuuuuguuuuuguguuuuuuuuugagacagaguuucacucuuguugcccaggcuggagugcaacggcacaaucucggcucacugcaaccuucaccucccagguucaagcgauucccccgccucagccucccgaguagcugggacuauaagcacccacuaccacgccuggcuuauuuuuguauuuuuaguagagaugggguuuccccacguuggccgggcuggucucgaacuccugaccucaugugaucugccggucucggccucccaaagugcugggauuaccggcgugagccacugcgcccagccaauuuuuguauuuuuuuuguagaaacacaguuucgccauguugcccagauuggaauuuacuguuuuuuguuuguuuguuuguuuguuuguuuguuuugagauggaguuucgcucuuguugccgaggcuggagugcaauggugcgaucuuggcucaccgcaaccuccgccucccagauucaagugauucuccugccucagccucccgaguagcugugauuacaggcaugugccaccacacccggcuaauuuuguauuuuuaguagagacaggguuucuccauucuggucaggcuggucucgaacuccugaccucagaugaucugccccccucggccucccaaagcgccgggauuccaggugugagccaccgugcccagccagaauuuacccuuuuaaaguguacaguucaaaggcuuuuacccaugguauguggggauugguuccaggacccccgaggauaccaaaauccaaguaugcucaagucucuuauguaaaaugccauaguauuugcauguaaacuaugcacaucuuccugugugauacuuuaucucuagauuaccuauaauaccucauacaguguaaaugcuauauaagcaguuguuuuacuguauuuuuuauuuguauuuuuuuauuguugaauuuuuuuccucaaauauuuuuaaucugcuguugguugaauccauagauggggaaccagcagauacagagggcuaaccauauucacagaauugugcagccaucaccacaauuauauuuagaacaauuuuaucucccuaaaaagaaaugcuguacccuuuagcagucaucuacccccauuuacuccucugcucagccucuggaaaccacuaaccuauaucuuccaucucuguggauuugccuauucuagacauuucauauaaaugaaaucacauauuuguggcuggcuuauuuccagugauuuuuccagacuuagcauguuuucagaguucaucaacauuguaguauguaucaauacuucauuucuuuuucuugcugaauacuguuguguuguaugggcacaacacauuuuguuuauccauuuaucaguugauggacauuggagcugagcgcaguggcucacaccuguaauuucaucacuuugggaggcugaggcagauggaucaccugaggucaggaguucaagaccagccuggcugauauggugaaacccugucucuacuaaaaauacaaaaauuagccaggcgugguggcgggugccuguaaucccagcuaccugggaggcugggacaggagaaucaccugaacccaagaggcagagguuucagugagccgagaucgugccauugcacuccagccugggcaaugagcaaaacuaucucaaaaggaagauaaagauagacauaggagucauuuucacuuuugggcuuucuugaauaaugcugcugugaacauuuguuuacacauuuuugugugagccaggcgcaguggcuuaugccugugaucccagcauuuuuuuuuuuuuuuuuuugagacagagucuuucucugucauccaggcuggaaugcaguggcaugaucuugguucauugcaaccucugccucccagguucaagugauucuucugccucagccuccugaguagcugggauuacaggcaugugccaccaugccuggcuaauuuuuguauuuuuaguagagacaggguuuugacauguuggccuggcuggucucgaacuccugaucucagaugauccauccgccucagccucccaaagugcuaggauuacaggcaugagccaccacgccuggcagaucccagcauuuuuggagaccaaggugggaggaucccuugagcccagaaguucaagaucagccugggcaacauggugagaccccuaucucuacaaaaaaaaaaaaaaaaaaaaaucagccaggcgugguggcacaugcauagucccagcuacucaagagauugaggugggaggaucacuugagccugggagggugaggcugcuaugagccaugaucacaccacuauacuccagccaaggcuacagagcaaaccagacccugucucaaaaaagaaaaccaaguuuuuguguggacguauguuuucauuucucuuggacauauaccuaagaguagaaggcagauggacuuggccgggugugguggcucacaccuguaaucccagcacuuugggaggcugaagcggauggaucaugaggucaggaguucgagaccagccuggccaacauaaugaaacccagucuguacuaaaaauacaaaaauuagccaggcauggugacacgugccuguaaucucagcuacucgggaggcugaggcaggagaaucgcuugaacccgggagguggagguugcaguaagccgagauugcaccacugcacuccagcuugggcaacagagugagacucuaucucaaaaaaaaaaaaaaaaggcagauggacuugaguaauguuaaagaguuaaaauggacaagacuugguggguacuagcagguaaagggaagaagggugagggaagucaggcaugacugucagguuucuggcuugggcagcuggauggaagauggcacugaggagggaaacaugggaggaggcuugaguggaaagauggugaauuucuccccuauucuauuccuaauaaugagaguucuuucuaagcagggcuucuguaguucuguagcagguagaagccuuucaggaccaguaagaugcuggcaugaugcgugauauuccggugcccccagugaugauuuuuccaagcaauuguguuuuauuagcugaaccuuuggguggaagaacagugacagugccaagcugagacuaauaauccuccagaucacauagacugcuacacacacgcaaacugugaaauuccugugucaucucaugguucauuuuaugaucaguaaaaagaagcaaucucccucuuguuccacauacauauuccgcaaaauacaagcagcucauuuuuuaguccagaugucucgguaggggaaagaaaaaucucauuuugcauuggcacaugugaugccaggaaaucucugcuuucccagggugcuagaaaauuaaaauuguaguaaucaacauuggaucuagaaaaugagauacacaguagcuauuugcaccaaaugaaauuggcuuuuauuggcuguagcuuuuuccuauuccacucaccucucagguaccaucccuuuuccaacuuaaccauuaagcagaagguaccucccuucugcuguuggaggcugagcugggauuaagugucauuuuaaccgucuagagagagagauagccacauauuccuuugggaagauaucuggguucagaagaccuuuucacaccucagggcugagccugggcaccucacuccagcuuugccccucuugccugcagguugugauugccaccaauaucgcagagacaucgcugacuauugaugguaucuacuaugugguggacccaggauucgugaaacagaaaguuuacaauuccaagacagggauugaccagcucguggugacgccuauuucucagguaugacggcuuguaucaacaguuuuccugauaauccugauuagggccuuucugaaacuuuuuuaugguuauauauuucaaacuuguuuucaaagaugaacuuuuaugauacuggguacuauaaugacaugagggaaggauuuuuuguuauuuguuuuuaaucuuuuuuuaucccugaagucugauugauccuugaaguuuuuaaucuuuuuuuuuuuuuuuuuuuuugagacuaaguuucacucuuguugcccaggcuggagugcaguggcgcaaucucggcucacugcaaccucugccuccuggguucaagcgauucuccugccuuagccucccaaguagcugggauuacaggcaugugccaccacaccuagcuaauuuucuauuuuuaguagagacgggguuucaucauguuggucaggcuggucuugaacucgcaaccucagaugauccacccgucuuggccucccaaagugcugggauuacaggugugagccaccacgcccggcccuuuuuaaucuuuagaauaguauuucacuauuaaaaugcccccguaaggccagacaccuuggcucacaccuguaaucccagcacuuuggaaugcugaagugggaggauugcuugaggccaagaguucuaaacuagccugggcaacauagcaagacucugucacuauaaaaaauuuaaaaaaaauuagccugguaugggggcaugugccaccagucccagcugcuuaagagucugaggugggaggaucacuugagcccaggagucugaggcugcagugagcuaagauagcaucacugcacucuagcuggggcaacagagcagacugugucucuaaaauaauaauuuguuuaaaugccccauaaaacuagaacauaaaaaaaguuugaauccuaguacccuauauuaccuauuuuagauggaaagaucaguacuuuauuuucuaguaccuugcuuagcuacgagauagauaucugagauaauaauaaauuauaugauuuucugguuuuuugguaauuauggaauaauuuccugccuaaaugacauuuaaaaaugaauuacccgaucacuuuuuugagagaaguuuggcaacaguauauccaaaacuuaaauguucaucucuuuaaccuaacuguucugcuuauagaaauuuaucugaaaguuagaaaugauuaaauacauguccaaagguaauagaaaaggauguucaucgaaggauugguuuauaucagaggaaaccuggaaaaaauucuaaauguauuccaaaagggaaguaguuuaauaaauuaugguauauucaugccauagaauguugguggcauuaacauggugguguguaucuauauuuaaugacauaaacauguaacuauaauauuuucuuugaaaaagugagccuacaaaacagcaugaaugguauaauccaauuuuuguuuaaaaauagauggugagcauuucuucagaguaugugugagugagcugugcccaagauugaaagcauguagucuaaauguuagccaagauuauuuauggguggugcuacuagaugaugugcauuuucuuuuauacuuuuauauguugucuuaaucuuuuacaguggguauguauuacuuucauaauuugugaaagccuuaaggcuauuuuuauuuugaaacuuaaguaauaauaauagcuaacacuuuuuguuuuguuuuguuuuuugagauggggccuugcucugucgcccaguuuggagugcaguggugcaaucucagcucacugcaaccucggccuccuggguucaagugauuccucugccucagccucccaaguagcugggacuacaggcgcaugccgccaugaccaccuaauuuuuguauuuuugguagagaugggguuucacugucuuagccaggauggucuccaucuccugaccacaugauccacccgccucagccuuccaaagugcugggauuacaggcauaagccaccgcgccuggcccaauaauagcuaacacuuacaguguacuuaacguccuagauacaugcauugacuuggugcauucucgcauugauccuaugugguagauauuauuuucacagaugaggaaccugaggcacagagggguuaggugauuugccuaacaucacagagcuaguggagccaagauuugaaccuggguagccuggcuccagcuuguaugcucuauacuacuugucaggguggcggugaucaaaaaauuaguuacacaugccuguccugauuuggagagagacauguguagaaugcuguagaguccagccacugugugugauugcugccuggauuugugugguuaguuguccuuucauaaccuauccuuugguuuggagcuggcauaguaauuuguaaauccugguacuguuuguaacaacagaugguuuugucagaaaauggcccucuucagauugcuauucauuguuuccuagcaaccuauggcuaaacuacauuuuuuuuaauuaaaaaaaaaucaguguuuuugaaguaguguuuuauuauuuuugaaaaacagaagaaaaaaauuuacccaccauccuacuaccuccacuguuauuauuuugcuguuuuucauuccagucuuuuuucauguuuauuucuuucaugguugcaauuuuaguagucaaguaaguaugcaguuuuguauauuuuuuugaguauuuaauuuuccuauuagaauaauacauguucaauauuugguaaaaucuaaagaaaauagaccucaucugcaagccuacuaucagaguuagccacuguuaacauuuuaggguuuuuuucgccuagucauuuccuucuaguaguugauauauaaagacuuuuacuaaaauuauuuuacauuguuucguaacuugcauuuugcauuuaaugcgaaugaacauuuucuucugucauuuaacauugcaaacaugauuuuuauuuuuauuuuuuauuuuauuuugagucaggaucagucuuuguuguugcccaggcuguagugcaguggugugauuacggcuuacugcagccagccucgaccuccccaggcucaggugaucgucccaucugagccuccugaauacugggacuacaggcgugagccaccacaccaagcuaauuuuuguauuuuuuguagagaugaaguuucaacauauugcccuggcugaucucgaacuccugggcucaugcaaucugcccaccuuggccucccaaagugcugggauuauaggcauaagccacgacgcuuggccugcaaacauaauuuuuaaaaugacugcagagucaucauugggaugauugacguaauauguuuauuucacuuacauuuuuggucauaacuguggggaugguguucugucaucuuguuuuaugcuuucucuuuuauauugcgccacacuauuuugaagauauaugucucagaucuguauaauauuucuuccauuaacccugcuuguauugccucccucgaacaaacuuccccgaagugcugaguauggagaggggaagauaagagcauugguagucuuggaaauggucccaaaggaagugaaaucaaccccauuucugauuuugccaguuguuaauugucccccuuuuaacagauauccuggguaaagcuguuaagcaguguuuaacagauauguugcuuuuauaugcccaccccucuaggcucaggcaaagcaacgagcuggcagagcugggagaacaggcccagggaaguguuacagguuguacacagaacgugccuaccgagaugaaaugcugaccaccaacgugccggaaauccagagaaccaacuuagcaagcacagugcugucacucaagguagaaaucacugucuuguuaaaauggguugguggaacaguccaauccuggccuucauaaaugaauuucaguuuuaugaaccuuguuaaauacuuuaguaaccucaugaaagcagucccuuugagugaaaugcaaauggcugugauaacagccucucacggcaggucuggggcuaaguuggcaugucugcugugaacacacauuuuuucuuaccauaacaaccagcaggauauuagguuguaaaagguucuaguuaggagcauuuucuaaaaggaaauuagaaaaauauaaucaaugccaaacuguggacacacacaccuaaccucaaccacuuuagcgcucagauccaauucuguucuuuuagaacgagagaaaacccccuguucaaaaacuuugcaagggaacugucaguacagauuucagacuggcucucaggggcuugguuuucauucugaaucauuguucuuccucucucaguccccagugaggacuucauucucuuuuggcaggaggagcuguaugaguaauuucccagcugauggcguuucccccgacacugaugcuacccuggagcccugguacuuucuggugcagagugcucuguugucauuuauuauuuauucccugucaaagaggcuaaaacagagcuuuggaaagaaaaaagaaaccuacuccagucucugaagugccaacagagaggcaucuguggcuuggacuucagcuccaaacugcgacuuugggcaaguuuauuuacuuugcccucugcucuguguucugcucugaaaaaggggcuguuaauaguauuuguuggaaagauaagugagauaauguagguaaaggcacuuggcacagugcuugaugauugcuaacauaauucaucauaguuauuauucacacaauaaacauuuauugaacaccugcuguguuuauggucacaaucacuuuaugagaaagaaauagaaagcuuagguccuaccacaucacacuuuauauacacuugaaucgugcaucauucagucguuucuuuuauucaucgaauuagcuaauguauugaacacaugcuacaugccaggcauguagauugcacuguggugguuuugugaacauaguuuuuacccagugugaacucucugaaagcaggggccauauccuggccaucuuuauaucccucccaccuaacaugguaugagaucccucauagauauauaguagaaaugauguaugcaagagacaggacaaguugguagacuauauuauuauuauuauuauuguaaaauacauaacaacauuuacuauuguaagcuuuuuaaaguauacaauucaguggcauuaaauacauucaagauguuguacaaccaucaccaacauccauuuccagaacuuuuucauugucccaaacagaaacucuguacccauuaaacaguaacuccccuuucccccuuccucuaucccuugguaacuacucuucuacuuuuuaccucucugaauuugucuauucuagauagccucauuuaaguggaaucauacaauauucuuuuguaucugaccuguuucucuuagaauaauguuuucaagauuuauucauguuauuuucaagguuuauccauuuauuucauuccuuucuaagggugaauaguauucuguuguauguauauaccacauuuuguuuauccauucaucagcagauggacauuuggauuguuucuaccuuuuggcuauuaucaauaaugcugcugugaacauuagugugcagguaucuguuugagucugcuuucaguucuuuuggauauauaccuagaaguguaauugcugggucaugugcuaauucuguauuuagccuauuaaggaaccaccaaacuuuucuacaguggcugcaacaucuuacauucccaccagcaaugcaugagguuucugauaccucccguccucacugacauuuguuaguuucuguuuuuuaaaaaaauuauagccauccuaguggguaugaagugauauuucauuguaguuuugauuugcauuucccuaauuacuacugauguugugcaucugugcaucuuuuuaugugcuuguuggccauuuguauaucuucuuugaagaaaugucuauucaagcucugugccuauuuuuuaaauugaguuguuuguccuuuugcuguugaguuguacauauugucauuuugagagaguguuaggguuuuuuguuuuuuuuuuucuuggaagacguuuuaucauguugccuaggcuggucucaacucccggacucaagcgauucucccuccuuggccucccaaacugcugagauuacaggugugagccaccaugcccaacugagagaauauuuucaaaaaguuuccugagaaauuaugugcuuuccuuugggaggccgaggcaggcggaucacuugaggucaggaguucaagaccagcccagccaacaugguaaaacgccaucucuacugaaaauacaaaaauuagcugggcaugauggcgggugccuauaaucccagcuacuugggaugcugaggcagaagaaucgcuugaacguaggagguggagguugcagugagcugagauugggccacugcacuccagccugggugacagagugagacucugucucaaguaugugcuuucuauuauaauagucugaguuuuauguggcccagcccuggaaguuaccgccagucucaccgguggcuuccuaauugcaauugaagaaaugggaaauaaaguaacaaguagcuuccccacaugcugacacuggcuagacugacccucuuaucacaugccuucuuccuuucuguucuaggccauggguaucaaugaucugcuguccuuugauuucauggaugccccaccuauggaaacuuugaucacagccauggagcagcuguacacacugggggcccuggaugacgagggccugcucacucgcuugggccgccggguaagggacagacucaacuuccugugcuuuugggaagauucccuggucagccuuucacauccuucggucuguacaaaaucaggcugaggccguggauaagcuuugaguaaaauucuaaauguuuguuuuuaaccugaauuucuccacugucacuuuaaacuguuucuucuuuauacaaaaagguguucuguucauaauuuugccugaggauguauuacugaauguagccuuaauuagaaacggcaucugcaaaauucucaucuaccccaacaguaguuauaugcuuggucacauacaucccguuggaguuuauuugggaaaagaauaaacaacagcauucuucugauagagaaaggcaucccaaggcaucauuaugcuuugggaaaaucuguguuguuacccacucugaccaaggucuugcucuggugaauccaaaugugucuuccacagggaagcaguuguagucuuuuuuugucccucuagauggcagaguucccucuggagccaaugcuaugcaaaaugcucaucaugucugugcaucugggcugcagugaggaaaugcugaccauuguauccaugcugucugugcagaacgucuucuauaggcccaagguaggaaguucagauccaaguuuagaugggggugccaugaaguugggguaguuggccuguugccauuccaaugcuugauguggacuuuuuuuuuuuuuuuuuuuuuuuugagauggagucucacucuguugcccaggcuggagugcaguggaaugaucuugcaaucucuaccucccggguucaagcaguucuccugccucagccuccagagcagcugggauuacaggcgugcgccaccgugugcugcuaauuuuuguauuuuuaguagagacaggguugcaccauguuggccaggcuggucucaaacuccuggccucaagugauccucuugccucaguuucccaaaaugcugggauuacaggccugagccaucaugccuagccugauguggacacuuuugauagggucuuguagggcucccuagaauugcuccauguucaguuaguagcuguugagucggaaauguuccucugucccacugcuuggcaggauaaacaagcccuugcagaucagaagaaggccaaauuccaccagacugaaggggaccaccucacccugcuagcuguguacaacuccuggaagaacaacaaguucuccaacccauggugcuaugagaacuuuauccaggcucguucccugcgccgggcccaggacauucgcaagcagauguuaggcauaauggacagguaagcuggaaucugaugacucugcauguuugaguugaaccaccuugaguaucaugucuuuucaucucuguguguaccuauaaagcuauaggcaccuuuucucuugcuccucacauaacccuuuuccuccagcuuuuccaucuuuguuauauuccuucuccccaaguaaggguaugccugagaauuaccucagauaccuaagaggaagauuaucuguuaguuguugaaaaaaaugcucuuuguuugcaacccucuggaacauuauuacuguggaauugaauaccugucuaaacaaagugucugucucugagugccuccgucugcccacuguguagagcugccucuguaguacacuuagggcuggaaggaagguccuggugacuacucugggcaccccaagauggauguguugggcacugucauugugaaaauagaccugugaaagcugagugggcucauaucuuuuguccuaucuugauagacacaagcuggauguuguuuccuguggcaaguccacaguccgagugcagaaggccaucugcaguggguucuuccguaaugcugccaagaaagacccgcaggaggguuaccggacacugaucgaccagcagguggucuauauccauccuuccagugcccucuucaacagacagccagaaugguagguggacaugucccagggucuaggggcuuuucugggcagagaaaaaccuguaaauuuccugguauuuugugauugugucuucacuacucccaguauguccuaguauaacacugcuugccuuucuagagcagcagaaaccugaauuaggcacaauguaucaaacccuaugagagaauuaaaaucauaggggugagaccuaguugaaaaaaaaaauugugguuuaaaaaacuacguaguggccaggcacaguggcucaugccuguaaucccagcacuuugggaggcugaggugggcagaucagccgaggucgggaguucaagaccagccugaccaacauggagaaacccugucucuacuaaaaauacaaaauuagccagguaugguggcgcaugccuguaaucccagcuacuugggaggcugagacaggacaaucgcuugaacccaggagguggagguugcagugagccgaaaucacccauugcacuccagccugggcaacaagagcgaaacuccaucucaaaaaaaaaaaaaaaaaaaaaccaacuaccuaggggcuaggcaugguggcucacgucuguaaucccagcacuuugggaggccgaggcagguggaucaccagaggucaggaauuccaggccaaccugaccaacauagugaaaccaugucucuacuaaaaauacaaaguuagccaggcgugguggcaggcaccuguaaucccagcuacuugggaggcugagacaugagaauagcuugaacccgggaggcagagguugcagugagcugagauugugccauuguacuccagccugggagacagagugagacuccgucccaaaaaaaaaaaaaaaaagaaagaaaaaaacaacuaccuagugauguaguuuaaaaaaaaaaacuuguuuuaaaguagcauuuuuaaaaaauuggacucuaucuagaacccuaauauaaaacugauuuaaaaccaccauguuaucacaguagaaggguuagaaauguggcuccuugcauguuuggccuucuccaucccuuguggcagugugaggccccucuucagagcccuagaauucuguggaaacauucuaauaaacauccucacauuuuauagagcaagaaacagauuagagaagggaugugauuggcuccaugucacuuaacuaguuagagccagagccaggacuagaauacauucuccugagaccuuucuugugguuagaggugugcgggugcuucaguauugggguguggcugucauaaacagacugcagucuuauaggugucaggcaggagagguaauaguauaaaauguaagcucagcugaggccuacuagggaccagguugacuguagaguggggccuauauccagaggcuugaguacuaucucuguccccccucagggugguguaccaugagcuggugcucaccaccaaggaauacaugcgugaaguuaccaccaucgacccucgguggcuuguggaguuugccccagccuucuucaaggucucagacccaacuaagcuaagcaaacagaagaagcaacagcgucuugaacccuuguacaaccgcuaugaggaacccaaugccuggagaauaucucgagcuuuccgacggcgcugaaaggcaagauuguuccuuugccucuccagcagcaguagccagggcuuggacuuaucgaugacaggcugguccugaggauacagcugucccgugacugacugucuuaacugagcauuuucucaacucgacucucauuucuucccugcugguaaaauagaaacagggauuuaaaccuggcuuuggcaagagccugcagccuccaucaccccaaguccuugggcccaguugggagcucauaucuaacacagagacacauugcaucaacuucaagaaagggacaauuugugcagcuccaggaugggaagguggagugggugagcaucuugugcagggacauggugagugcccugaugccccagcuagcaggagcuacugugcucaucuaaaguguuugccccacuucccaccccgucuccagccccuguacuuuggcuugaccucguggaaauauuuauuuucuuaagg

SEQ ID NO: 192311 - RNA, 7980 nt, Homo sapiens
ggcgagaggaagcagggaggagagugauuugaguagaaaagaaacacagcauuccaggcuggccccaccucuauauugauaaguagccaaugggagcggguagcccugaucccuggccaauggaaacugagguaggcgggucaucgcgcuggggucuguagucugagcgcuacccgguugcugcugcccaaggaccgcggagucggacgcagguaggagagcggccgcgcagaccucucgccugcuccugcccaggggcccgccagggccaugugagcuugagguuccccuggagucucagccggagacaacagaagaaccgcuuacugaaacuccuuggggguucugauacacuagggggaguuuuaugggaaagaggaagcaguaauugcagugacgccccguuagaaggggcuuucuaccuccccagcauucccccaaagcagggaccacaccauucuugacccagcuccaccccugucgguaggugcuggcuucuuccccucuccuggugguggugggugguucccgcggcggccuggagccggaggggcgcgcgacccugggcugggagcuccgagggccugggaacgagaccugagaccuuggcuucucgaagguaguagggacuugggaguggugacugaaccuggucuggcuccuccuuacuuccucuuguugcgggugggacgagcuagcuuccgccucucccagccacuuuuuccugcucauuugcagcuagguuggcuccccuuuugggaauuuccucuccccuuggcacucggaguuggggggugccaccuaguggaagauaacggagcuagggucuugaagaggcugcuguccccucuggcuguuuuggcgguguaggguggcaugagagacugcgacucgccuccucaucccuguuucuguaugcgagugcuuguauucaguagaagcauacacuauacucccucaauuuaggguaaacaggaggggccacaugcacagguaauucaccagggagccgaacacuccugugcagacagacuccccuucccagcaagccauggcagcggacagccugcugagaacacccaggaagcaggcggugccagcugcaggugcuuugccugggagcuguggggcugaggagaggguccacuguccaggaccagugaacuucauccuuaucuguccaggagguggccucuuggggaugcugaguuaggggaggggcacuugaggaaagccagguggagcagagaggaugugagugacugggugggugagauuuccugccccuccccccgcagugguauccacaccuagacucgugggguaacugaggcacagacagagagcaacuucucaggcccucacaguuggcaauucuaggauuaggacccaagugcgauuuucaggcagucccuguacccuguuucuguuguaccuguugcaccauucccaggcacugcccaucgugccacuagugauaugaacccagguccaauacgcucuggggccaucaaagccugacgucaccaugaccugaugugugacguguuauaggugucccuugguaucuucacggaacugguuccaggaccccaaaaucugugggugcucaagccccugagauaaaaugguguaauauuugcauauaaccuauacauacuuuaaaucauuucuagauuacuuauaccuaauacaauggaaaugacaugucggcugggcgugguggcucaugccuguaaucccaccacuuugggaggccguggcagguggaucaccugaggucuggaguuugagaccagccugaccaacauggugaaacccccaucucuacuaaaaauacaaaaauuagccaggugugguagcgcacaccuauaaucccaccuacuugggaggcugaggcaggagaauugcuugaaccugggaggcggaguucgcaguaagcugagaucgcgccacuguacuacagccugggugacagagcaggacuccaucucaaaaaaaaaagagaaaaagaaaaagaaaugccauguaaauaguugugauccugaauuguuuagggaauaauaagaaagaacuaucuguagauguucaguauagaugcacccaucguaagccuaacuacauuguauaacucagcaacgauguaacauuuucagggguuuuuuuguuuuguuuuuugagacagaaucucagucucacucugucacccaggcuggaguauguuggcgugaucucugcucacugcaaccuccaccuccugggcucaagcgauucuccugccucagccucuugaguagcugggauugcaggugugcgcuaccacgcauggcuaauuuuuguauuuuuaauagagaugggguuuuaccacguuggucaggcuggucuugaacuccugaccuugggauccgcccaccugggccucccaaagugcugggauuacaggcguuagccaccgcgcccaauauauuuugaucccugguuggauauggagggcugacuguacuuaacaucucuaagcuucaguuuccuccuuuaaaauaaagguguggcuggguguggugguucaagccuguaaucccagcacuuagggaggcugagguggguggaucagcugaggucaggaguucaagaccagccugaccaauauggugaaacccccucucugcuaaaaauacaaaaauuagccaggcgugguggcgagcgccuguagucccagcuacuugcuugaacuugggaggcagagguugcagugagcugagaucgugccacugaacucgagcaugggcaacagagcaagacugucucaaaaaaaaaaaaaaaaagggggugagcagacgugguggcacgcucccacagucccagcuacuuaguaggaggccaagguuggaggauugcuugaucccaggagucugaguccagccugggcaacauggcaauaccucaucucuaaaaauaaaauaaaaguaaagguauuaauuacuacuuuggaugguuguugcaaagaaauauauauaaaauaauggagagucuuguaacuggcucccaagaggcucaacagacauuacuguuuuugcuucuucauuaugaguuaccucucuggccaccccacugaacuagcugggcuagcugagccugggagaagaguuguuuaggaagugagaggcugcucuccacagagacucaaggcucaguuccuccuggugacucagaugggcagcccagugggcacacguggucucucuccacauguggcugaguuucacuuccagaauagauggagaggcaagggcaggguuuagcaugcuugaggaaucucagagggcccugguggugugggggacccucagaacacaggugucucaagggcugacccagcuucuguguccuuuucucugggugaggaggggacauucaugggcagauggugaccucuggggaaggcagcccagacuccacuggccaccauauuuccuuuuucacaacuuucucaccccugugguuucccaugucaucauguggccgcuucccgcaaggccuuagcggggugcagguaugaacauagugucaggcaaggaggcaucuggaggggaacccuggcuuuuccuggggggacucccucccugcacccuagcccuguccucucccauggcuacugaugccuuccccucaccccagagguggcccacaucugcacagaucagacccacaaaaaucacgucuuccugacucucauaagccugcccagugaggcccaggcauuaggccaugugcuggggacucagacccacacauauacgcaugucagcauucaugcuuacagguccgcacaugcuggggcaagugucacacacggggcgcuguaggaagcugacucucagccccugcagauuucugccugccuggacagggagguguugagaaggcucaggcaguccugggccaggaccuuggccuggggcuaggguacugagugacccuagaaucaaggguggcgugggcuuaagcaguugccagacguuccuugguacuuugcaggcagaccauguggacccuggugagcuggguggccuuaacagcagggcugguggcuggaacgcggugcccagauggucaguucugcccuguggccugcugccuggaccccggaggagccagcuacagcugcugccguccccuucuggugagugccccucagccuaggcaagagcuggcagccuggguuuucccaaagggucaucuuggauuggccagaggaggacgccaggcacaagucugugguuuaucauuuucccugucuuucuaggacaaauggcccacaacacugagcaggcaucuggguggccccugccagguugaugcccacugcucugccggccacuccugcaucuuuaccgucucagggacuuccaguugcugccccuucccagaggugagcgugccaucagcccaguggaggggcuuaggucugcauuuaugcuuuuccugcacucuaccaccugcagauaaaagggcccugccaaugcagguuucucuguguuccacaggccguggcaugcggggauggccaucacugcugcccacggggcuuccacugcagugcagacgggcgauccugcuuccaaagaucaggugcagcuggggugugggugcagggcaggcagacgggcagcauguggagucuggaacccaggagcccagcuggcgggggcagcccugauuccugcccuugugcccucauucauguggcaucuguacuaagcaacagcccugcuguggacagaggggcagcacuggggauaggagggugcgggagaaagugcaagacuccagguccaggcguuguggggguggggagaggucgagcugggccggucuaauaccaacccauggucagugggugccccuuccccaugccaucuugcugagggagggacuggauugugaggagggugaguuaggccugccuaggagaucacugagccuuagugucacccucaaaccccaguagcugggcuugcaggcccuggugccaccagcuccuugugugaugggggagucaccuucccugagugggcugguaguauccugggucaucuuguccacagguaacaacuccgugggugccauccagugcccugauagucaguucgaaugcccggacuucuccacgugcuguguuauggucgauggcuccugggggugcugccccaugccccagguacaaaucugggggagauggggguauguggagggaagugggggcagaguugggggccaggggcagggggugaagacggagucaggaccauuuuuucucaggcuuccugcugugaagacagggugcacugcuguccgcacggugccuucugcgaccugguucacacccgcugcaucacacccacgggcacccacccccuggcaaagaagcucccugcccagaggacuaacagggcaggugaggaggugggagagcaucaggccaggggcuggggcggggccucauugacuccaaguguaggaaaaaguuuccuccauccuggcugccccucacguuugcuccucuuccaguggccuuguccagcucggucauguguccggacgcacggucccggugcccugaugguucuaccugcugugagcugcccagugggaaguauggcugcugcccaaugcccaacgugagugaggggcuggagccagcuuggcugugugcccccagccaccuggcccugacacgcaccuuacaggggcucuguggcauggggcuggcuggcugcuugcugggagccuggcugaugcaggguucaugcuacccccuagugggggauuggggcagugccagccaucagccuggcugcucccugugugcuacugagccuggaagugacaaagacccaccccuguccccacucaggccaccugcugcuccgaucaccugcacugcugcccccaagacacugugugugaccugauccagaguaagugccucuccaaggagaacgcuaccacggaccuccucacuaagcugccugcgcacacagguaccagaggcagggugcagauacagggguggggcccccuuuccucccuuuuaggccuggccuuaggaucacugcaaggugguguaagcgguacccuccaucuucaacaccugguuccagcuguggagccggcaaaggguugauaccccugaggguccccagugccacuucugaccuguccucucugcuucccucacagugggggaugugaaaugugacauggaggugagcugcccagauggcuauaccugcugccgucuacagucgggggccuggggcugcugcccuuuuacccagguacccagggguggcgggugggugggcugagcacaguguggcaggcagccgggccccagugcccaccugcccuucuucaucugcccuaggcugugugcugugaggaccacauacacugcugucccgcgggguuuacgugugacacgcagaaggguaccugugaacaggggccccaccaggugcccuggauggagaaggccccagcucaccucagccugccagacccacaagccuugaagagagauguccccugugauaaugucagcagcugucccuccuccgauaccugcugccaacucacgucuggggaguggggcugcuguccaaucccagagguauaugggaggggacagcaucuuggccugggcagguggguggccaagcuccuauugcuuucugcccuccgcauagcccauaggugauacccagcucugacagauucguccccagcuggaggugcuguaagcaggagaggcgggcuggaguagguaggggcucggcacugcgccccacauaguggcuaccuacaacgcccuuuccugcccaccccccaggcugucugcugcucggaccaccagcacugcugcccccagggcuacacguguguagcugaggggcagugucagcgaggaagcgagaucguggcuggacuggagaagaugccugcccgccgggcuuccuuaucccaccccagagacaucggcugugaccagcacaccagcugcccgguggggcagaccugcugcccgagccugggugggagcugggccugcugccaguugccccaugugagugccucccugccugccccuggauaggggagcuaagcccagugaggggacaggaacauaaugccauucugugcucccuuccccgccaggcugugugcugcgaggaucgccagcacugcugcccggcuggcuacaccugcaacgugaaggcucgauccugcgagaaggaaguggucucugcccagccugccaccuuccuggcccguagcccucacgugggugugaaggacguggaguguggggaaggacacuucugccaugauaaccagaccugcugccgagacaaccgacagggcugggccugcugucccuaccgccaggucagugccaacccccauccuggggcuggguauggccagggaccaggucccaccucguccaacccucucgccccccucugaccauccagggcgucuguugugcugaucggcgccacugcuguccugcuggcuuccgcugcgcagccagggguaccaaguguuugcgcagggaggccccgcgcugggacgccccuuugagggacccagccuugagacagcugcugugagggacaguacugaagacucugcagcccucgggaccccacucggagggugcccucugcucaggccucccuagcaccucccccuaaccaaauucucccuggaccccauucugagcuccccaucaccaugggagguggggccucaaucuaaggccuucccugucagaaggggguuguggcaaaagccacauuacaagcugccauccccuccccguuucaguggacccuguggccaggugcuuuucccuauccacagggguguuugugugugugcgcgugugcguuucaauaaaguuuguacacuuuc

SEQ ID NO: 192312 - RNA, 32364 nt, Homo sapiens
ugaaucuucaaaacuguauuuggaauugacaaaaucuuccuagagacaaggcccugagcacacagaguccgucuccaccaugaaaauauuacauaagcuguacagaacaaaauuagcaaugagugaucuuuggcacuagaacaggugauuccuuagcuguucaugcaauauccaaacugcacaccacaugacauuagauugcugguuaaccauuuaauuuuacauuuaaauuaucuuaaaaggcuggaaguccuagcuaaguuuucaauaucaauaugcuacccaugucauaacacuuagugccugagguagagauuucuguaagagauuuuuuuaaaacacaauugagaguauaauacagaaaaacauuuaaaucuuggaagcauauagccugguucaacaagccaacucugaaaugcagaacuaguaccuuuuuuauuugagucucacuccaucacccaagcuggagugcaguggugcaaucucagcucacugcaaccuccgccuccuggguucaagagauugucaucucaugccucagccucccaaguagcuguaaguacaggcacgugccaccauaccuaauuuuuauauuuuuaguagagacaguuuugccauguuggccaggcuggucucgaacuccugaccucaugugauccaccugccuuggccucccaaaguguugggauuacaggcauaagccaccacacccagccagaacuauuacuucuuuuaucucuguagaaacugcacuggauaacuuuuuuccucuuuuuuggcgacagucuuacucugucacccaggcuggagugcaguggcgcgaucucggcucacagcaaccucugccuuccagguucaaggaaaucucaugccucaacaucccgaguagcugggauuacaggugugcaccaccaugcccggcuaauuuuuguauuuuuaguagagaggggguuuuaccauguuggccaggcuuguuucaaacuccugaccucuagugauccacccaccucagccucccaaagugcugggauuacagguguuagccaccaugcacagccgagaacuuucuuuuauuuggacuccugauuuuagaauaccaugguuucuuuuaaaaaaaaaaaaaaguacgauuauuaacacugauuaauaacacaugaaccaaacccacuuaauaucauuauuaaaaacaggcugggcacaguggcuuaugccuguaaucccagcaccuucggaggcugugaugggaggauugcuugggcccaggaguuugagaccagucuaggcaacauagugagagcucugucucuacaaaaaauacaaaaauuagccaggugugguggugagcacuugcagaccagcuacuugggaggcugaagugggaggacugcuugagccaaggagguccaggcuguagugaguugagauugugccauugcacucuagccugggcucaaaacaaaccccaaaaaacaaaaccaaacaucaauagaacuacauagggacaacagcaaauacaaaucuuuaaacacuucaugauguggccggaaugaguacaaguaugcaauucaaugauuccaacauuugauggugacugugaauuauuacauauuuauuacacauaaaugaguuuaaauuuuauuuccaaacugcaugcagggacuuuauuauuacuaugaauuuuuuuuugagaguuucacucguugcccaggcugaagugcaauggcgcaaucucggcucacugcaaccucuaccuccugggaucaagugauucucaucucagccuccugaguagcugggauuacagguacccaccaccacgcccggcuaauuuuugguauuuuuaguagagacgggguuucaccauguuggccaggcuggucucaaacuccugaccuugugauucgcccaccuuggccucccaaagugcugggauuacaggcgugagccaccaugccuggccaaaaccuuugauuuuuaaaaaggcguuucuugaaguaccuuauuaaacauuugauuugaaggaaacugugcaugucuaacauacuugccuuuuacagaaagcuggcuagccaaaaauguaucaucaacuaucgauuuuauuuucagaaguggacugucucuuaaaugagacagcauaaaguauggacuuguagaagcugaacgaguaaaucaugaguguaacugauaacauguaaguccauucuucguauaaacugcuagagaguguuucagaccaucacugaugucugugauaaagagcaccaaagcaucacaguccaacuuuuuuuuuaagcgccaaguucaaacaagugaccaauaauaaugguugguccuugaaggucuuuuaccagaggccuuuucuaaucacuucguaacacuucugagauguacauggcuccugaaacuugaaaacaaagccacaaaaugaacauuaacauuucuuuaggggaaaaugcuaucuaauuuuccccucguuugaauuaaccaaaaaaaaaaaaaaagccuauuucuuuuacaaaucuucugaauaacggguuuuaagagcaggccaggcgcgguggcucacgccuguaaucacagcacuuugggaagcugaggugggcggaucacgaggugaggaguucgagaccagccugccagccuggccaacaugaugaagcccugucuauauuaaaaauacaaaaaaaaucagccugguauggugguggugccuguaaucccagcuacucgggaggcugaggcaggagaaucgcuugaacccaggaggcggagguugcagugagccgaaaucacaccacugcacuccagccugagcgacaagagcaagacucugucuuaagaaaaaaaagagcaaaggacacaccacaucugcauaaauccaaguguguuaaggaacauaaucauguugauuguauccugauucuagcaggugaaggacuaagcacucaacuuguauuuggaggagaagcaagugucaugauggagcaugucuuauauggcaauucaaaacaguaugauucugaugcgagugagaacuaaauguuggacaggcuuuuuauacaaaucccaccugcaugauccagaacaauauucuuacagauucaaugcagacuccaccaauggguuagcuagacaucaacaggcucacuuucuuuuuuucuuuuuuuuuuuuugagacaagaguuucacucugucuugcaggcuggagugcaaugguaugaucucagcucacugcaaccucugccuccuggguucaagcaauucuccugccucaaccucccaaguagcugggauugcaggcguccacccagcacuccuggcuaauuucuguauuuuuaguagagauggaguuucaccauguugaccagucuggucuugaacuccugaccucagguaauccacccgccugggccuccuaaagugcugggauuacaggugugagccaccgcgccuggcccauuuucuuaauguaaguccacaauaugucauuaggggagaaugacuuuggcaaacucauaugcuucaaaggcagaaagacauguacuaagaaggcaguuagagcuggaaaauucuugacauaauuacaacuuuagcaagagaauaaaaauagauuuuaaaagugugugcauguggggaggugacagaauaucuuuauauguacuuuaagaagcugacgcguuauccagacacaaaagauaacauucucaucaaaacaggccaagaugaaacaccaggggcacucuucacagaaauuaaguggaugcuucuggcgccaaaugucuuugccugguucuuccuggcauuucugcuugacuccuucccccuguaucauucucaaauccccagccuuuccacugggcaaagccacucucuucucccucaggcucugaagagauaacacaaauguauggacacuuuuuguccuucaauuaaaaaaccugcuggaagcuccagugauguuaagaauuaacugguaguucuuuaucuuagcuaggcuuauguauuccaaauuuugccuguuuucuuggaauuauaugaauuuccuuauuaaacauuugauuugaaggaaacugugcaugucuauuaauuacccaugagguacauguguauuucugaaauuucuccuucagucucaccugaguuuaauuuuugccuaagauguuuagaguuccugaggugcuucucuaggcuaaaauuuaaagauuuuuuuuuaaaaaagcaaauaaaaguaaaugaauggcuaaaagauaagguuaaauuuucuaggcugggcaugguggcucacaccuauaauacuaacacuuugagaggcugaggcgggaggaucacuugaacccaaaaguucgagaccagccuggguaacauagugagaccucaucucuacaaaaaaaauuuuuaaaacagaauuagccgaguaugguggcacaugccuguagucccagcuaaucaagaggcugagguggaaugauugcuugagccugggaggcagaggcugcagugagcugagaucaugcugcugcacuccagccugggugaaagagggagacccugucucaaaaaaaaauuuccuuaaguuucuuuuuuuugguggggguaggaaugcaguagagaaacaaaaacacugcacaaagggugcaguguucuacuauucaucuaaauaauggagaacuggcauuuuacaauuaagauauaaaaaauauucauacuuucagaauuuccaagucagagguggcuuacaacagcuuucauuagaaaagggugagacgcccaaauaaaaugcucccugguggaacaaaguccccuuuaaaccuuuaccaagcucuuucucagaagcucacaaaacuuaagacaaugugaacaugaugagaaagcaaagcucuccaacauaaggcugaaaaugacaauaaaagacugcaauaaaagacuagugggaugaacaugaaugcuugucagugacaaacacauuaugccuacaaagaauaaauacugcacuucucuuuaggucuauuuacagacaggaccccaugaccuuucaggcauaaaccuccacuggcagaaguaagaauuuaaucacaaaacuucuaugguaaauuauaaaaaauaagaaauuuggauuuaggccuucugccauuuccaauacaaguagcuuugaguauucuugguugacaagggaauguuugcauuucuaauguuaacaaagaaaauauccaccacuggcuucuuaaccagacggaagcgggcagguuucuggauagaggcuuaaggcaaaucaaacagguucacaacuaagcagccuauuagggauuccaggcauggcuuugcuuucugagggacagcuccauaucaucucuagccagguuuuccacauugcuaccaaacuggggacacguuucuguaucaggcuuuugaaagaacuuuaaguuauauacauauaccaucaaagcauauacuggugaugcuugauauuuaaaggaauccuacagugaaucauuuauuuccuuugaaaauaagguuuucaaaaauuggcuacaacucugaucgcaugaaugagauucaaagauuucucacauaaaagaaagaucucaaccuccuucuacugugaacuugcuuuccaagacuaaaaacugguaucuccucuucagucuccuuacacaucugaaaucguuccugcaauaugagaggcacuuuuauuagguguagcaucuauuaaaaacucuaaagccaggguagaauuugcugaacaaaguaauagcacuagccuaauaggcauuauuuauaaggacuuuuuccccuuuaauauaaaaguauaacuacagcaguucaauguacaaauacaaaaaaaguucucauacuaaaaaaaaaaaaguaccauaauacuguacauacaaaaacuguucaacaagaaugauuuaaauaugucuguucuucuccagaucuggaagacacaaauguaaaguucugcaacuguauuauugcuaagaacaugugccugggaacacuguguuucccuuucucucccucagcccagccccgccuccagaguccccugagcuuggaucaugagccaacagcaucccugaagauaaccagagccaaauguuuacucaauggaagucauuauucagugagcugcugcuuaccauaaacuaugaaaagcacagguuuuaagcccgccaggauuaaauccagacggaggucuucccauccccugauuugcuacuggcagugcuuuuguuggacccagcuuuggaccccacuuuggccuucuucucccggggaccaugaggguuguuuuggugacuguaggccugaacugccagauccaagcguuccugagccauccugaucucccgcugcagagccuccaggucagcugggagguucuccucauggcugccauacugcuguuccugggcuguguuggccuuguuuugcuuguaggcgaucuuagcauuggacaguucgguguacuggauuugaucugguuugacagcaauguuauagccagggggagcagaugguguauuccaagugaaaggauaauuauaagcacccggauccucaaguucccuccuuuuacuguuuagugagucucgaauggucccaaacccuaaaugaagcaucucccaaauguuaagcaagaggcaaaggccuguaacaccauacauuaucagaaggaagauggucuuuucagugggucuagaaauaaagcagucuaucuuaugaggacaaggaagucugcugcacacauaaaacggguggacuuggaagccauacagaaaauacugcccuaucagaaaacccaccucaaacacgguccuugccagcaacugcagcacauagauuuucaugagcccaucuucccgaauccgucgucggccaucaugcuuagguuuggguuggcucugcucuuuauuuuccuuaucacuuucuaacuccaucucuggauacaucauaggauccucuucguuguccuccuccguuucuuccagagcccgguguuguuuccagcgcauugcauagggcuugcuccgagcugccuucuugucugcuucaccgugcuccauuuuggcaaucuuguggauagcauagcccagguacaucacagagggaguugccaccaggaugaucuggaacacccagaagcguacaugggagagaggugcaaacgcaucauaacagacauucucacagcccggcuguucuguguugcacacaaauuugcuuugcucaucguaauagauggauucuccuccuacagcuguaaggacgauccggaagacaaucagaacagugagccagaucuuccccacaaauguggaaugguugugaaucuccucuagcaggcgagucaggaagcuccaacucauggugauugaauugguaugcccugauaaaaguggaaaaauaccaaaauaaaaucaacaaauauuaaaucuuaauuuaauuacuaauuaugauaucucuaggaacuacugcuuugaauacuugaaaucuaaccucaagguucacaguggaacaaauguuagaauaaacagcaucucaguuggguaggguggcucacgccuguaaucccagcacuuugggaggccaaggcgggcagauuaguugaggucaggaguuaaagaccagccuggucaacauggugaaacuccgucucuacaaaaauacaaaaauuacccgggcacgguggugugcaccuguaaucccagcagcucaggaggcugagacaggagaauugcuugaacagagcaagacuccaucucaaaaaaaaagaauaaacagcaucucacucucuacuaucuucaagaaggucaauucaccucagucaacaccuguuggccccacaaggucccagaaaguauggauugcuuucauaucuccucugguuuaaaagguaaacuuguagcuacuauuuacugagauauuucucagaccuugguucuucuguuuguuuuuuuuuuuuuuuuuugagacaguuucccucuuucgcucaggcugcagugcaguggcgugaucuuggcucacugcaaccuccgccucccagguucaagugauucuugugccucagccucccgaguaucugggauuacagucaugcaccaucauuuuuguauuuuuaguagagaugggguuucaccauguuggccaggcuggucucgaacuccugaccucaggugauccgccugccuuggccucucaaagugcugggauuacaggcgugaaccaccaugccuggccagaccuagguucuuuacacauacuauuauuucaugagaccuucagaauuuugugagauagaaauuuaaaaaacacacagguauaguuauucgguccaaucacagaaaaaccaccacugagaacauaaaggggacaccucgguuggacuccacugugaaggggugauuuauuaggaaacuuaaauuuuagacaagugcuaaaagggauuaagaagaugguacagcuacaaacugcuggcaaucauuaagaacuaaaacaaaagacagaagggaacuaggaagaucuucccuagcuaggcugcaucgcauaccagauuuugguuuuacuuagaagcccaguaaauggucuugcaauaaauauuguaccccuuuacuauauaacagaaucuacaaauuauacuucuguaccuuauuuaugguagacauuaaaaaaugauugcuaaacugaacugugaggacauuaaauccaaucaacagcaaauccauuuaaaacagcauuuuaaaggacagauucuuucugagauucccagaucuacauccaggauccagguaaaaaccaccuaaaugagguaauauaugggaaauccccaauaaagccccgacacaaaguagacuuaauuuuuaacuuguccuccucccucucccaguuuacuucugcagauuacagaugauuugucagcaccaccaaaguuuaaacacacuuuaccuguuguccagaacuucgguuacccaaaauuuucuuagagaaaugauguuuugauugcaauuuuuccagauucccucuggaagggaaaaagaaaagagcaggucauaagcuuucucccacagaaaacaaugaaucacuaaaaugccauuuucagaaagaaacaaaguuuucuauguaucauaaaaaucaaugagaauaagauagaaacaggcuugaguuugaauaccagucuucuccuccccauacagguggcaggagaaaccauguaacaggugacccaaagauucuuaagucaccacagucuaagaauauacgacaggaagaugcgucaguaguaaaaauaugaagcagaugaacucuggcaccuauaggaaaaagccaaagcagaagaauugcagcaaauugaaagcaggucacuaaaggccuugcaaaaaccuucaccccaucugcucuauucccugaagcagccgauacaccucucagggggauuugagcagcuaacuaggagcaagcuguuuagcuaaaacacccaacagcuggcucucagucacaggaacacccgucuccaugggaggugauuuacagauacaacuacucacaaaaagucacagaaagaaaacaccugcaucuguacuggauuaaacagcaaaacagaaaaguuuccaagaugaauuauugcucauuauuaagcucuggcaacucugcauagcucuggccaaaugucauccauaaggcgcccacauuuagcaaauaaauuuaaaacaauuccugaauguuauguguuuauaguaacuuaauuaaaagggugcuuuguguuguuguuuaaagauacaggaaaaaaaaaacuggaacaauuuccaaaggaacaauggaaaaaaaaaaagugaaggcaugaagccgcauaaagauuugcacauaagccugggcaauauagugagacccuaucuuuccaaauuuuaaaaaaauuagccaggugugguggcagugguggccacugcaguccaaccugguagauagaacaacacccugucucuuacacacacacacacacacacacacacacacacacggcccagcacaguggcucuggcucacgccuguaaucccagcacuucgggaggccaagguggggggaucacaugaguucaggaguuugagaccagccugggcaacaugugaaaccuagucuucaccaaacaacaacaacaacacacacccccaaaauuagcauggugacgcacaccuguggucccagcuacuugggaggcucaggugaaagaaucacuugagcccgggagguagagguugcagugaguugugaucgugccacugcacuccagccuaggugacagcgaaaccucaaaaaauaaagaagcaaaaagauuuacauaugaagaaucccggccaagcacgguggcucaugccuguaauuccagcacuuugggaagccgagguggguggaucaccagcagucgggaguuugagaccagccagaccaacauggacugaccaacuaacuaaaaauacaaaauuagccaggugugguggugcaugccuguaaucccagcuauuugggaggcugaggcaggagaauugcuugaaccugggagggggagguggagguugcggugagcugagauugugccauugcacucuagccugggcaacaagagcaaaacuccaucucaaaacaaaacaaaacaaacaaacaaaagaauccagcugggcaugguggcucacaccuguaaucucagcacuuuggaaggcugaaggaggaggaucacuugaacuugggagcuugagacugcaaugagcuaugaucauaccacugcacuccugccugggcgagagagggagacucuaacacaauaaaauuuccaguacagcucccauuucuagcccuguuuuccaacugagcucaccaccucuuuucucauugaauauacaaguuauaaaaccucaaaacaagaaguaaauaauauaaaaucuuuaaauggugauguaagccagguuuccaacauagaacuccaugauucucauccacaaauucucugcaggcucagauuuuccccaaagccugaaauuucuauuuguuccaauaagccaaaauuaugaaaauacaauuaguuagaacuaacucaucuguuauaucuccauccacaaagauaaauguguaucuuuuuuuuuuuuuuuugagacggaguuucacucuuguuguccaggcuggagugcaauggcgcgaucuuggcucgccacaaccuccaccucccagguucaagcaauucuccugccucagccucccgaguagcugggauuacagguaugcaccaccacgccuggguaauuuuguauuuuuaguagagacgggguuucuccauguugaggcuggucuugaacuccugaccucaggugauccgccugccucggccucccgaagugcugggauuacaggcgugagccaccacgcccagccuuuuuuuuuuuccagacagucucgcuuuuuuggccaagcuggagugcaguggcaugaucucggcucacugcaagcuccgccucccagguucacaccauucuccugccucagccucccgagcagcugggacaacaggcaccugccaccacgcuuggcuauuuuuuuuuuguauuuuuuuguagagacuggguuucaccauguuagccaagauggucucgaucuccugaccucgugauccacccgccucggccucccaaaauccugggauuacaagcgugagccaccacgcccagcuaauuuuguauuuuuaguagagacgagguuaucaccauguuggccaggcuggucuugaacuccugaccucagguaauccgccugccucagccucccaaagugcugggauuacaggcaugagccaucgcgcccggccaaauguguaucuuuuaaguaauuauuguuaugaaagaauuucucaacaguugagcuuuucaauaaaauuuucuuggggggaagaauuggugauaaauccuucagagcuuauguaaguucuaaagcagccauuuuaacacauccauuaguaaguauuguguacugauuaagcugcagacguggaaaaugcugaacccuuacagucugguuuuccauagacaauccuaagagccacagaguauggguacucuauacccacacucugaagucuucggaaugaguaucgcuacggucuaugcucuugaccacaaaauguugagaagauccacaacaaccagggguuuucuccacaaaacucgcuggagaucugcagacggacuccccuccauaccccaggucuucagcucugaucagugcauguguggggaggagcggggaucuggauaccugauccucucuauacuggauggacaucaauuaauucauuuuuuuuuuuuaaacagggucucgcucuguugcccacacuggagugcaguggugcagaccuaagucacugcagccucaaccucuugugucaagcaaucuucccaccuuagcccccugcaguagcugggacuacaggugaaggaacacuaccaugccuggcuaauuucuguauagaugagguuucgucauauugcccaggcuggucuuguaccccagagcucaagugaucugcccaccucagccucccaaaguguugggauuacaggugugagccaccacacgcagccaauauaauuucuuucuuuuuuuuuuugagauggaguuucgcuuuuguugcccaagcuggagggagugcaauggcacgaucucagcucacugcaaccuccgccuccuggguucaagcgauucuccugccucagccccccaaguagcugggauuacagacaugugccaccacacccagcuaauuuuguauuuuuaguagagacaggguuucaccauguuggucaggcuggucuccaacuccugacccucaggugauccacccaccucggccucccaaagugcugggauuacaggcgugagccacugcaccuggccuuuuuucuuuuuuuuuuuuuuuuuugagacaaagucucucuuuguuauccaggcuggagugcagcggcaccugggcucacuguagccucagccuccccagguucaggugauccucucaccucagccucccaaauaccugagacuacaguugcacgccaccaugccuggcuaauuuuuguauuuuuugcagagaagagguuuugccauguugcccaggcugguccugaacuccugggcucaagugaucugccugccucggccuuccaaaguacuaggauuacaagcaugagccacuaugccuggccucuuucucuuaauauaauucugugggaaaaaaaauaggccggcgcgguggcucacgccuguaaucccagcacuuugggaggcugagacaaguggaucaccugaggucgggaguucgagacuggccuagcuaacauggugaaaccccgucucuacuaaaaauacaaaauuagccgggcaugguggcacgugcccauaaucccagcuacuugggaggcugaggcaggagaauggcuuaaaucugggaggcagagguugcagugagccgagaucgucccauugcacuccggccugggcaagaacaaaacucuaaaaaaaaaaaacaaaaaacaaaaaacaaaaaaacccagcugggagcaguggcucaugccuguaaugccagcacuuugggagcccaaggcggauggaucacgaggucaggagauugagaccauccuggccaacaugaugaaacccgccccuacuaaaaacacaaaaaaauuagccggguguggugguacacgcuuguagucccagcuacucaggacuacaagcugaggcugaggcaggagaauggcuugaaccagggaggcagaggcugcagugagucgagauugcgccacuguacuccagccuggcaacagagcaagacucugucucaaaaaucaaaucaaaacaaaacaaaacaaaaaacccauaacauuaaaacccauuuaugccuauuguuccauuacuggaacgcuacgcaugugggaguuauuuauauccuacuguucaagaucauugccaaggucugauuuuuucaaauucaaaaaauugcaaucucaggcauaaauggguuaaaacaaacaaacacacacaaaaaaacccauaaucacagcuacuuacaaauguuuugguuuuccuuauguccuucuagucuuuaucuaaaugaauacucuuuccaaauaacacuaauuuacuaagggaucuaguaguaaaaaugaacuuuuuuuuuuuuaauugagacagagucucacugucgcccaggcuggagugcaguggcacaaucucggcucucugcaaccuccaccucccggguucaagcgauucuccugccucagccucccgaauagcugggacuacaggcccgugccaccaugcccggcuaauuuuuuguauuuuuaguagagacaggguuucaccacauuaaccgggauggucuccaucuccugaccucauguucugcccaccucggccucccaaagugcugggauuacagacgugagccaccacgcccggccaaacuucucuuauacuuguuuacuauuugcauuucuuuuuguguaaauguguuuaucaacuuaacuccaacaucucacaaaaugggugacgagcaacuaaccuuccuuccuucuccuuuccucccuuucucuuuuuuuucuuugagacaagagucucugucacccaggcuggagcacaguaccgcaaucucagcugacuguagccuccgucuccuggguccaagcaauucuccugccuuagccucccgaguagcuggacuacaggcgcacaccaccacguccaacuaauuuuuaguagagaugggguuucgccccguuggccagucuggucucgaacuccugaccucaggagauucacccuucggcuucccaaaugcugggauuacaggugugagccaccgcacccagcugcaaucuucuuucuaaaauaaagaaccaugaguuuccuaaaaugaauggcaguaucaccaauguuuuuaccuauugagucaguaaguuuuucuuggauacucuucccuuuccucuccuuccaaguuacuuuuuuuuuuuuuuuuuuuuuuuuugagacaagagucucucucugucgcccaggcuggagugcaguaccacgaucucaacuuacugcagccuccaucucccggguucaagcaauucuccugccuuagcauccugaguagcugggacuacaggcacacaccaccacgcccaacuaauuuuuguauuuuuaggagagacagcguuucaccauguuggccaggcuggucuccaacaccugaccucaggugaucugcucaccucggccucccaaagugcuaagauuacaggcgugagucaccacgcccggccacaaguuacccauucuuacucucagugaaaugucaaauaauuccugggagaugagugcagucuggggaacauuuugaaaacauuaguccucauuucuguaaugggucacucauucucuaggcaagcccccucccuggcagcuauguauuaacaaagcauuaaggauuggcuuacaauguuacagaguacaauacuccuccagagaaauuaagaucauuucaagaaguagaaugaguagaaggcagguucuggaauuaacauuucuaagcagaauaugucacugccaauuguggucucacuguggagaaaaguggguucuugcuccacugaaguuuccuuuccccugaaccauuauuauuauuuuuugagacagagucuugcuccgucgcccaggcuggagugcaguggccugaucuuggcucacuacaagcuccaccucccagguucaugccauucucccgccucagccucccgagaagcugggacuacaggugcccgccaccacgcccggcuaauuuuuuucauuuuuaguagagaugggguuucaccauguuagccaggauggucuugaucuccugaccucgugauccacccaccucagccucccaaagugcugggauuacaggcgugagccaccacacccagcccugaacauuuuaucuauuuuuucuugaauggcuucuuaaauuuuuuuuuaaagaaugcugcaauucacggaagcacauaauucaaaaggauucacucacucacacacaaaaaacccuggagaucugcagaggggccccucagucuucagaacugaucagugcacaugugaggaaauggucuacauaagggaccugaaaaggugccuaaaauucaggacauagggccggagcgauggcucacgccuguaauccuagcacuuugggaggccaaggcagguggaucaccuaaggucaggaguucaagaccagccuggccaacauggcgaaaccccaucucuacuaaaaauacaaaaauuagcugggcgugguggcaugcgccuguaaucccagcuacuuggaggcugaggcaggagaaccacuugaacccggggggcggagguugcagugagacgagaaggcaccacuucacucaagcaugggugaaagagcaagacucagucuuaggaaaaaaaaaaaaaauuucaggacauaagucuucucuggcuucccugcuucugaaaacaaacuugguuauaguguaggggcugaaagucugagauucagcugugaauggcucucaugaauaaaaaaucaugucuauacuccaucuacaaauagaaaaugacauggaagcacaugucaagugguggagauggguggaggccaaauaccucaaugucuuuugcuaauuaguaaagcaccaauuuuuuauuauuuuuuugaggcugggucuugcugucacccaggcuggagugcaguggcaugaucucagcucacugcaaccuccaucucuuggguucaagugauucucccaccucagccuccugaauagcugggguccaacugauuuauauguacuuuuauacuuaauaucuucgugaauauauccuaaaugccuugaguuuauaucuauaaauucuaggaggugguauuauuagaucacaggcaauguaaaucugcaugguuuuugcuuuguacugucauuugguuuucaaaaaaggcacuaguaauuuacagugccuggcaaugaauguauacuuaaaacaacuucaccuccaccucuucagcacugucauuaugcuccuuuacuagaugcaaaauggcauuucaaaaucaugucaauuuucauguuucuaagacaguaggauacguucccccucauauauccaaccccuuuguggguuauuuccauccuuuuaccuauuugucuauaaaagguaaucuugauauaguauagacauugauuaauugacauuuaauauaaacaucucaguuuauuuuacugacuuccuucaaauuuuauuauuuuuauagaaucguaucaauucuuuaaaaaauuaaaagguugaaaaacuuggggcgcgguggcucacgacuguaaucccagcauuuugggaggccgaggugggcggaucaugaggucaggagaucgagaccauccuggcuaacaaggugaaaccccaucucuacuaaaaauacaaaaaauuagccagacgugguggcgggugccuguaaucccagcuacucgggaggcugaggcaggagaauggugugaacccgggaggcggagcuugcagugagccgagaucgugccacugcacuccagccugggugacagagcgacacuccgucucaaaaaaaaaaaaaaaaaaaaaaaaaaguugcuuuuuucuagaacggcuucuauuuuaaaagauacugcaauucaugguagcccauaauucaaaaggauucacucacacaaagaaaacccaaauacugaagaaaaucaaguuugcuuauauaacauuuauuagacagaaaccaaaugugcuauuuuuagucuauuuuccaaauaacuuagacacaaaucuaccuugucuuacacuagaaaacagaauuuaaaaaaauuagcuggcaucaacaugguaauaaauuauguaauucucucucaaauucuuaucucaagaguuuucuauagguuauauccaaacagacucaaauuaacacuguuuuucuguaaaacauaauucaguuuguuuuguuuuguuuuugguuuucugagacagagugucgcucugucgcccaggcuggagugcaauggcgaagucucagcucacugcaaccucugccuccgggguucaagcaauucuccugccucagucagcuucucgaguagcugggauuacaggcacucgccaccaggccuggcuaauuuuucuauuuuuaguagagaugagguuucaccuuguuauccaggcuggucucgaacuccugacuuaacugaucccucugccucggccucccaacgugcugggauuacaggugugagcuaccgcgcccagccgaauuaauaggauuuuugaagaucaaauguaaugaacauuauuugaauuauuucagcagguagauucuaauauuaaacucauuuuaaagaugaggaaaucagguuuaaaaauuuauaauuugccugccaggcgcagugguucacgucuguaaucccagcacuuugggaggccaaggcgggcggaucaccugaagucaggaguucgagaccagccugaccaagauggagaaaccugccucuacuaaaaauacaaaauuagccaggcgugguggugcaugccuguaaucccagcuacucaggaggcugagacagaauugcuugaacccaggaggcggugguugcagugagcugagaucgugccauugcacuccagccugggcaacaagagcaaaagucugucucaaaaaaaacccacaaaaaacaaauaacuuuauuauuugccuaaaaucaucuacuuauuaaguagugaagccagaauuugaagucaggcagucuugcacuagaguuuggacucuuucuugaccacucgcuaguaaagaauuacauuacagauggaauuauguacagguucuaugugacccuaaucccagucuuuaggaucagaacugcaaaagaaaagcacaaggccaggcacgguggcucaugccuguaaucccagcacuuugggaggcugaggcgggcggaucaccugaagucaggaguucgagaccagccugaccaagauggagaaacccugucucuacuaaaaauacaauauuagccaggcgugauggugcaugccuguaauccuaguuacucaggaggcugaggcaggagaaucgcuugaacucaggagggggagguuguggugagcugagauugugccauugcacuccagccugggcaacaagagugaaacuccaucucaaaaaaacccaaaaaccaaaaaacuuuauuauuugccuaaaaucaucuacuuauuaaguagcaaagccagaauuugaagucaggcagucuugcacuggaguuugggcucuuucuugaccacucgcuaguaaagaauuacauuaccaauggaauuauguacagguucuaugugacccuaaucccaaucuucaggaucagaacaacaaaagaaaaagcacaaggccaggcgcgguggcucaugccuguaaucccagcacuuugggaggccgaggugggcggaucagcuaaaaucaggaguuugagaccagccuggccaccauggugaaaccccaucucuacuaaaaauagaaaaauuagccaggcgugguggugggcaccuguaaucccagcuacucgggaggcugagacuggagaaucacuugaacccaggaggcagagguugcagugagcugagauugcgccauugcacuccagccugggcgacaagagcgaaacucugucucaaaaaaacaaacaaacaaacaaaaaaaugcacaaacaccagaaagaaaauacauuucagaguuuaagaucuuaaaauguaaaauggaaugaaaguuuaaaaguaaaauaaaacagaacaagcuuucuugguagcuggggaggaaggaauaaacgguaucuuugacaaaaaugauuuauuuauuuaaggaggacaauuuauuugggcauugagaauagggagaccacaaaacaacuauuaacccaagaaaucacuuccacauauaucuuuggaaaagucucuaauagucucauguuaaaaaaaaaaaaaaaggccaggcaugguggcucacaucuguaauccuagcacuuugggaggcugaggcgggcggaucccaaggucaguucaagaccagccuggccaacauggugaaacccagucucuacuaaaaauacaaaaauuagccaggccugggcuacuguaaucccagcuacucaggaggcugaggcaggagaauugcuucaacccggaaggcagagguugcagugagccgagauuguaccacugcacuccagccugggcaagagagcaaaagagcaaaacuccaucuggggguguggggcgggaagaagcuggcugggcgugguggcugacuccuguaauaccagcacuuugggaggcugagaugggcagaacacuucagcucaggaguucaagaccauccuagacaacauggcgagaccccgucucuauuuaaaaaaagaaaacaaaaaacaaaaccucucaaguuuuucaaaucaagcacuaaaaaccccccucauuaacuuguguccuguuaaauuauuuuuauuauuuuacugugguagaauagacauaaaauguacuaucuuaaguguacaguucaaguauuaaacacauucauagcauuaucaaccaucaccacuaccuccagaauuuuuuucaucuuguaaaacugaaacucuagacccagaaacaguaacuccccauuuccccuucucccagccccuggcaaucaccauucuacuuucucuaugguugugacuaccuaauuaucucauauaaauggaauuauauauuugucuuuuugugucuggcuuauuucacucagcauaauguguucaagguuuauccacguuauaccaugugucagaauuuccuuccuuuggccaggcgcgguggcucacgccuguaaucccagcacuuugggaggccgaggcggguagaucaugaggucaggagaucgagaccauccuggcuaacacugugaaacccccucucuacuaaaaauacaaaaaauuagucgggugugguggcaggcgccuguagucccagcuacucaggaggcugaggcaggagaacagcgugaacccaggaggcagagcuugcagugagccgagaucacgccacugcacuccagccugggcgacagagcgagacuccgucucaaaaauaaauaaauaaauaaauaaauaaauaaauaaauaaauaaauaaaaagaauuuccuuccuuuuuaaggcugaauaauauauuccauaguauguacauaccacguuuuuuuuauccauucaucuguugacagacaccuggguugucuacaacuuuggccacugugaauaaugcuguuaugaacguggguguacaaaucauucaauucuuuuuuuugaggcagaaucuugccucgucacccaggcuguagugcaguggcaugaucucggcucaaugcaaccucugccucccagguucaagugauucuccugccucagccucccaaguagccaggauuacaggcgugugccaccacaccuggcuaaucauucaguucuuuuguuuuaauauccagaaguggaauugcucuaucauaugguaauuuuuaauugguugaggaacauuaucuuguuuuccacaguggcuaauuuuuuuacauuuuuaguagaaacaggguuucacuuuguuggccaggcuggucucaaacuccugaccucagguuauccgucugccucagccucccaaagugcugggauuacaggcgugagccacggcuccugggcgaaaagugauucuuaaccuugaauuuugugaaacuaagcaagcaauggacuagaaggcaagagauucuaaucccagaauauaauccaugcacuucaggaauaaguucuuuccauauccuaauuucugaaauaaaugaagaauaucaaguuagaugauuucuaaaaucucuuccauuuaacauuugaugaaaacuaucucagaguaaaauucaccaaacugacaaauuauguggaacucaaaagucuagggauaggagaaaaguaaaguaauagcaguaaaauuaaacaauauaacaagaugucaaaauuuuaaaaaggcacuucccaaacgaucauuucagaaaauuugcgguuggacuaaauuuaaaaauuucaauauugacucacuguaauuccaaaguagguauuaacaaucuaggcaucccagcucaugagcugagcaauccacuaagaaucgugcuagugacucauaccccugaacgcgacugcuuuaugugcagagaccaggaaucaauuaaaggguuuacaaugaaguguuguuuaacuggaacguuuuaaguggaaguuaauuccacaugagugauaauagauguuuaauaacuagcucgugacaauuucuaagcaaaagcauuacagcagcuaaguagcacauaguaaucuaugugcuacaaacaugaaaacaacuuguuuucaaaagagcucuuggcuaugaauauuugaaaaaccuaaaauauaauuuguggcgaaucaaauuauaaaaucucauggagagugaguaguuugagaucuuggcuguaucaaccaaugaggaaacaaaaagcaccauuguggguugaagugccaauuuucgcuggcaaaaagccauucuauuugaauguaagaaccuucaggaaccagcuggagaaguaugaggaaccugggauagggauaauauauucauucacaacauauccuaaguggaacugucuucaugcaaacaggacaauauuggaacauuuguccaaaacagccuaagauuaggucaaaccaacuguucugaacaaugcucagucuagaaaaacgaacaugucuaagacaaaaauaaauguaugauuuuccaauaugacuacguuuaugauacaaaauuucuuuaaaaaaacccaacccauaccaucggcugggugcgguggcucaugccuguaaucccagcacuuugggaggcugaggcaggcggaucaccugaggucaggaguucgagaccagccugaccaauauuggcgaaauccugucucuacuaaaaauacaaaauuagcgggcgugguggcacacgccuguaaucucagcuacuugggaggcugaugcaggagaaucacuugaacuugggagguggaggcugcagugagccaagaucgcgccauugcacuccagccugggcaacaagagggaaacuccgucucaaaaaaaaaaaaaaaaaaaaaaaaaaaacaacaaaaaaacaccaacacccauaccaucauacaccaauggugucaucugguacaacuuuucuggaaggcaucuuggcaacaguuaucaagaacuuuaaagugcuuauauccuuugaucaauaauuccacauuuaguaauuuacccuaaacaaauacagggcauuuauuauaagaaacacauauaauuagguugggugcgguggcuaacaccuguaauccuagcacuuugggaggccgaggcagguggaucacaaggucaggagaucaagaccauccuggcuaacacugugaaauccugucucugcuaaaaauacaaaaaauuagccgggcaugguggcgggcgccuguagucccagcuacuugggaggcugaggcaggagaauggugugaaccugggaggcggagcuugcagugagccaagaucgugccacugcacuccagccugggagacagaucgagacuccgucucaaaaaaaaaaaaaaaaaaaaaaaaaagaaacauauauaauuuaugguauaaccuccauaauggaauauuguacaaccauuauggggggaauaaggagggaguaacugcuaacggguaucagguuucuuuuugacggaauaaaaacaaucuaaaauauucuaaaauuaggguguguuggcucaugccuauaaucccagcacuuugggaggccgaggcggguggaucaccugaggucaggaguucgagaccaaccuggccaacauggugaaacccuaucucuacuaaaaauauaaaaaauuagcugggcgugguggcaggcgccuguaaucucagcuacucgggaggcugaggcaggagaaucgccugaaaccgggaggcagagguugcagugaaccaagaucaugccauugcacucccgccugagcaacaagagcgaaacuccaucucaaaaaaaaaaaaaaaaaaaaagaguccagccucaguaaauugugugauagagccacuuaauaaaauagaguacacugaagaaagucuagguguggggccaagaugaagagcucacuuuggacaacacaauucaaauuaccuccucugaguaucucuguggagauguugaacaggcagccaggauaaaaaaagaggucuggcuacagauaaaaauguggcaguauucaaaauauauaugguaaccgaagccacagaauggauaauuucaggaaggaaaauuuugaauccaaauaaacaucuacucuggaugggcaauuaggaauuccaaguccaagaaugacucaaggggaauuccuaaaauagaguccagcucuaauuugaacguucccaaaaggaauguuauaacucauuaguuaaguaauaauaaauuaagccaaaacugauaaauacuacaaacaugugaaugaaaauaaucucuauaacuauugggaguugaauauaguuuagagauuagaggauaagaauaggggugugugaaguuuauccgauuuauauagaggaaaaacaucaaaacuuacucugaaacccuaugcauuucuuuccuguuuuuuuuuuuuuuuuuuuuuuaagacggaguguugcucugucaccaggcuucagugcaguggugugaucucagcucacugcaaacuccgccucccggguucaagugauucuccugucucagucucgcaaguagcugggacuacaggugugugccaccaggcccagcuaauuuuuguauuuuuaguagagacgggguuucaccauguuggccaggauggucuugaucucuugaccucaugauccccccgccucggccucccaaagugcugagauuacaggcgugagccaccguaccuagccucuuuccuccuuuuuuuuaaaauuucuuauuuuuguagagacagggucucaucauauugcccagguuggucuugaacuccuggacucaagcaauccuccugccaugaccuccagaagagcugugauuacuggugugaggcaccaugccuggccuuucuuuccuuuccuuuuuuuuuuuuugagauggagucuuguucugucgccuagccuggagugcaguggcacaaucuuagcucacugcaaccucugccucccagguucaagcgauucuccugccgcagccuccuaaguagcugggacuacuggcgugugccaccacaccuggcuaauuuuuuguauuuuuaguagagacgggguuucacgguguuagccaggauggucucgaucuccugaucucaugaccugcccaccucggccucccaaagugaugggauuacaaggcgugagucacugugccuggcccucuuuucguuuuuugagauggagucuugcucuguugccaggcuggagugcagcggcacaaucucagcucacugcaaccuccaccucccggguucaagcgauuccccugccucagccuccagaguaguugggauuacaggcgcgcgccaccaugcccggcuaauuuuuuguauuuuaguagagauaggguuucaccauguuggccaggauggucucgaacuccugaccuugugaccugccugccucggccuaccaaagugcugggauuacaggugugagccaccgcacccggccucuuuuuucaaauagagacugucccacucuguugaccaggguggagugcauggugugaucacaacucacuguagccuucaacuucugggcucaaaaaauccuccugccucauccuccugaguagcugaaaccacagguguaugccaccacauccagcuaauuuucaaauuacuuuuugcagagacagggcccucacuauguugcccaggguggucucaaacuccugggcucaagguauccucuagccucagccuccgaaagugcugggaguacaugugugccacugcacuccagacugggugacacagugaggcucugucucaaaaauaaaauaaauaaaauaaaaucagucaaauuagccaggcguggcagcaugcgccaguagucccaauuacuugggaggcugaggcaggagaauugcuugaaccugggaggcagagguugcagcgagccgagaucgcaccacugcaacuccagccuggaugacagaacaagacugucuuaaaaaaaaaaaaaaaaaaauuagucaagugcaauagugagaagggggggaaagaaagaguccaacuauuuuuuuuuuuuaaucaagugcuuauauguuuuggggaagaaaaaaaaaaaaaaaacguugggauccaggugccuuggccuguaauccccauauuugagaggccaagaggacugcuugagcccaggaguucaagaccagccugggcaacaaaacaagacccugucucuuccaaaaaaaauuuuaaaauuaacugggcgugguggcggugugggccuguggucccagcuacuagggaugcugugguggaaggaucgcuugagagcaccacuacacuuuagccugggcuacagaacaagacucugucucaauuacaaaaaaaaaaaaaaaaaaaaaaaaaaaaaggcugggcgcaguggcucaugccuguaaucccagcacuuugggagaccgaggcagguggaucaccugaggucaggagaccagccugaccaacauggagaaacccugucucuaccaauacaaaauuagcugggcaugguggugcaugccuguaaucccagcuacuugggaggcugaggcaagagaaucuugcccagggggcagagguugcggugagccgagauugcgcgacugcacuccagccuaggcaacaagagcaaaacuccgucucaaaaaaauaaaaagggccagacacagugguucgcgucuguaaucccagcacuuugagaggcugaggcaaccugaggucaggaguucgagaccagccuagccaacauggugaaacccuuucucuacuaaaaauacaaaaauuagcugggcguggugguggacaccuauaaucccagcuucucgcaaggcugaggcaagagaauuccuugaaccugggagacggagguugcagugagccaagaucgugccacugcacuccacccugggugaaagagugagacucagucucaaaagaaaaaaaaaaaaaaaguugaaugacuuaaugggcaccagaaugcuuuuguccaaauugugcuuguauuacaagcauuauagccucaaagaacaaagcuucaacugagagcuggagaagaauucauuuaccagaauacuucauuucuuucuuuuuauuuugagacagagucucgcucugucgcccaggcuggagagcagugaugcgaucucggcuaacugcaaccuccaccucccagguucaagccauuugccugccucagccucccgaguagcugggauuacagaugacugccaccacgcccagguaauuuuuuguacuuuuaguagaaaugggauuucaccauguuggcuaggcuggucuugaacuccugaccucaggugauccacccgccuuggccucccaaagugcugggauuauaagcaucagccaccacuccuggccccauuucauuucuuuagaaguaaaaugcuggccgggcacgguggcucacgacuguaaccccagcauuuugggaggccgagguggccggaucaugagaucaggagaucgagaccauccugguuaacacgaugaaacagucucuacuaaaaauacaaaaaauuagccgggcauggugguggacgccuguagucccagcuacacaggaggcugaggcaggagaauggcaugaacucgggagguggagcuuguggugagcagagaucacgccacugcacuccagccugggcaauggagcgagacuccgucuaaaaaaaaaaaaaaaaaguaaaaugcuaucugcaaagagaucaucauauccuuguuuuaggaaaacucuuugggcaauauauuccacaggucugaaagauaaaccuuuauugccaaggacugcucucagccaacuacaguacuuguaaaauucaagaauguauaacuguaugccagccaguacugacuaacaggucauucacucuuuagaguugcaguaaauagcaaugcucaaacgcccagcuaguuuuuuguauuuaaaauuauuuguauuuaaaucuuaaaaaauauuuuuaaaaauacauuuuacuagguucuuauuucaacacaaacugaacucaucagcuguagcaguauguugaaaaacaacuguugccauucagcugauauuaacagcucagaacuguuuucuaugucuaaauuucagguuaacgauaucagccaaaaucuaucuucucauaccuauucucaaaggaacggucuuacaaaacuaauaaucuggucgagugcgguggcucacaccuguaaucccagcacucuggaaggcagaggcaggcggaucaccuaaugucaagaguuggagaccagccugaccaacauggugaaaccccgucucuacuaaaaaauacaaaauuagcugggcaugguggggcauuccuguaaucccagcuacuugggaggcugaggcaugagaaucacuugaacucgggaggcggagguugcagugagacaagauagcaccguugcagugagacaagauagcaccauugcacuccagccugggcaauaagagcuaaacuccgucucaaaaacaaacaaacaaaaaaaaaaaauuccugcuuuuucuuugccuaaauuuuuaucaaauauuuugaacagaagccacauguauuucuacacuacaagaaaagcauaaguucagaaauaaguaaucauacccccuagucaaacuuaacuauaggaaggaaggacaggacaggacaggaaaggaggagaaaaaagaaauuagcuggguauacucaggaggcugaggcaggaggauggcuugagcccaggaauuugaggcugcaguguacuaugacagccugggcaucauagcaaugucuuugaaaaaaaaaaggauggccgggcacgguggcucacgccuguaaucccagcacucugggaggccgaggcgggaggaucacaaggucaggagaucgggaccaucauggcuaacauggugaaaccccaucucugcuaaaacuacaaaaaaaaauuagccaggcgugguggcggguaccuguagucccagccacugcacucuagccugggcgacagagcaagacuccaucucaaaaaaaaaaggaaaaggaaaaagaaaaaagaacacaccucaccaauuuugaaaugugaacauacaacaaauaaagcaauauuuuuuggaacucaucacuuugcauugaauuaggcauggaacaaacacuaagcauuuguuaagagaacgaugcucuggauuuaaauuauauauccuguauucuaagauccucauuacucaauugauaggcaagccuggaccuggggggaaguggacuaaucagaaacacaacccugcauuccuucccuuuggcugacuuauacaaauauaagaauaaaauuuaauugacaaaggauaacagcauuuauaaguaagauuguuaugcuggagauauguuaauuaaguccucuggauuaaaggcuaaaacucaauuuuaccugcaugaauugauuacagagaaaauuaccagguccuuugcuccuuuuuaagagaacugugguagaacuuuuuaagagaacuguuucugguagaaaacaauucuuaagucacacaaccucaaaaguuaaaagugcuggcuuuugaagagguuguuugaaaugcuuuggaaaaaugcacaacaguuuaaguaguaaauaauauuaagccauuacaaaucaggacaaauauuaacagaccuuccauacaacuucuauguaucucuucaauaugcccuuugccuacagcacucugggcacaaaaaucuggggaaaacuaagaucuguuuauuggagcuuuuuaccuucuacccagaaaaguuaguucguguuuaauucugacauuacacaguacuuaagacauucaaagcaacugcagugauacaacucuaugcuaaguuuuuuuuaaaucaguaaacuuaacccacaacucacaauauuuuaaucaggagcucuggaaguaaggguauuuuucuguuuuuuuccauacccucugagguugaaauuuuuuugcucuuuuacucugaauaauaccuaaacccucucuagggagagaaauauuuuauuccuaaaugacauuauuaacgcauuuuucuacagauauuaaaguacuggagauaugcuguuuccugcuuaucaggaaauuaaaaucccuuucauuuauguaguuugauuuuuuauagcgcuuucacauauauucacuugaacguauacacgacacaaacauauaacaaauuuagacuuaucaggcauacaagaugacccucagccugaacuuauucaaacuuaacuuacucgauuucacaucgucuugaugcuaacaaaauuaagcaugagcauaaugaaaucgguaucacugccaguucucaaugaacaaaaagaaaaccaaauucgcccauuucgcaaaggaaaaguacucccaaucagacaaucgcaaaaaaaagaacaaaaucuaaaccauacauucacguacaucuuuucaacucagagcuccaaacgcagccgccaaccacacaacugcccacaaucacagcgguagcgccuacucuuaauuuugaagcuagagacuuaaggaaacacacacacacacaaaacaguucucaaguuugacaaagugggggaaaagucauuuuaaguaaagacaacgaguuaaucaggaggcgaugagcccaguccuuccgccccgcuuucccgcuuccagcccucgaacgaacccuccucuaacccccgggaggcaggaguuccagcggggagaugcgggaagccucagacgagcccgcacgccgccggagacgcagggaucgaggucggggagacaaagagcagcccgcgaagagcccgggcggcgaggggcggcccggcuccgcccugcgccccuaaccgcccggguaguugucggcaccgccggggcgccgccgagugcgcgccgcuucuguccgggcuccccgaccgucgcccgacaccuccgcggcccaggacacccccgagccguuucccucccgauuugggagccgcgcgccuggggacaaagagggagggugcgccggggacaguggcaggacgcgggccggcgacgccccuccggacucggcgggaaccccucggcggcgccccccuccuucucccgcucuggccgcgcuccuccccggaccuccggagguucuccucggccccuccccgggcuccccaagaguucucccgccucccccugggaccccgccccuggcccgcuucuccucagccggcccugcggccgccccucacccggcggcggguucccccggagccgccuccuccgccgggccucggcccgucccgccggucgcggccucaugugccccgcgucgccaucgccuucacccucgccucuccuccaccuccuccgccgcugccgccuucgccucagucuccagccgaggcagaagccgcucccgccgcugccgccgccgccgccgccucccgcucccgccgccgcgacccgcgggaaggcgccugcgcacugcgcgcugcggugggggcgggggcgucccgccgcggcccgggagcggggggcgcgcggcacguggcgcucgagugggaggggggcgccccagaacgcgcgggaagcgacgcgagcgccaacuuuccgcggucgaguccucgccgcucucucggauaguccgggacgcggcggaggcgcggcgcgcgugggagucacccgcguggagucuggaccccgggugggcgcagacuucgcuccggacaguucauucuuccaagcugauuuucgggcgagagucccccgccagccgcgccucaguuugagcgggccgcuaacggcgccguggguucucgccuuaccuggguauccuggguugguuuagcgggcccagaguugucuucugcgcgcuccgccgaggccuugguccauuguagcacgggaugcuaaugucuccucccagguucugcucuacaauuccucgaggaucuggcgggcccugcguggaucuagcuagagucggggcucuuagcagu

SEQ ID NO: 192313 - RNA, 71355 nt, Homo sapiens
aaucgcucggccucccccaucccccgguaacggucgcuggugaguuuaaaugagcaggggcuggccgggccggagccgcuacagggggggccugaggcacugcagaaagugggccugagccucgaggaugacggugcugcaggaacccguccagguaaugauaaccuucuucucuggggcuuggcuggcagccucggucgggaagcagcagcguagggccacuccgcggccuggugcggccuaggcccggcugcuucucccgccuccccugcugccguguccugccuaucuuuagucaguucggaggccuugcccacagccuaagccguguuaccucuggcccuacauuacuucacccuuagcgugagcggcuucggcgaaaauaaccgccuuucccguccgagccaacguccggccagccuuuccugucaguccaggggccuggcuugacugggggugggagaugaggggccgaaaaugcaccccaagcgcucucuugccuaaaagaugaucgagaagcacauuugaucggagcuugugugaucuucgugacgguagggcaaguuuacggagguuuuuuuuauuuugucuuguaugagaggguggagggagcguaggaucggucuuuuuaauacuaauuucuauuuugguaacagacuuccuaucccacguuuccuuucucggugaauuucccaccggacaaugaugguuugagaagacaacuccaagccucagugcugaggcgcaagcaccaauaccaggggaggagguggaaagggcacauuuggguuguuuucauccucucugauggggaucaggagcauuuuguugugcauguuuauaaggcauucaggaaaugaaacacaaauaaugguguuucuguccauuucacugccuuuacaccaggguaugcuuugacgcacagugcuguguugcauuaaaggaacccuauuggauuuuaagugugugaugcggugccaagucauuuuccccccugacaucuggagaaacuguaucuuuugugccuugguaauggaccaggucugggagacuucaucccacuauaugaucuuuaacuugaucagaauugaccucuaucaacugcugucauugagucauggacuuuauuuugaaguuauaaagcaaacugauuuuuagaaauuccuucauauugcccuuaaaaggcuugagguaucaaacaguaaauauuuuaauauaucacuacuuucauauuuauuucauuuuucuaaacagcaugaaauacucauuucuucuaguuugguuuuuuucuccagcuguuuacauauagcagcuauuaguguuugaauuaauaaaacguaagauuauaucuuaugaaauuuaccugucuguaaguuguauuaguuuuucuagagcuauuuccauccaaauucuuuuuaccaguauaguuucuuuuaagauuuuuuuuuauucuggcuguagaugagguaauuauauauauauaauuuuuuaaggccuaacaugaacuuaaauagauaagcagauuacucaaguuauuuaauuucuguugcauauucuuauaauuuuguuuuaauaguuaaugauuuuuuuuuuuuugccuucucuggccccagaagucuucuaaagugauaaacuaguugcauugauagacuauaaccaccauuuaauaauaauuucagacuuuauaaaagcauggaaggccgggcgugguggcuuacaccugaaaucccagcacuuugggaggcugaggcggguggaucaccugaggucaggaguucgagaccugccuggccaacacagugaaacccugucucuacuaaaaauauaaaaaauuagccaggcgugguggugggcgccuguaaucccagcuacuugggaggcugaggcaggagaauugccugaacccaggagauggaguuugcagugagccgacauggucccgcugcacuccagccugggcgacagagugagacuccaucucaaaauaaauaaauaaauaaaaaauaaaagcauggaaaagaaaaggaauauguagccuguuucuagauaguacccaucagguuuccuguuuguccuuaaaguacucugagcaguaauacacuuugauauuuuuaaggcuuaaaugucaaauuugcuucuuuuucauagcagcauuguccauuagauuuuugagauagugguagaaaguuuuaggauaugacuaggugaaaauuuugguuguauaguauaagaagccauucaagaauggauuuggaacagugagaagaacaagcaacuuuggcuacaaugauaaagaucaaugaucagggauagugcugcaaaugggaaagaauuaggaagagaauaaaaauaggacagauauauaagauacugucuuuauuaaaaaaaaaacuaugaugacagauugcguguauuuggaaagcaaugagaguaaguuggaaaauuguucuuucuuggaaugccucagaguugaugguauuacuaggcauaggaaaaaguucacagaaaauaugaagaacuguuuucugcauuuuuuuuucuuuaaaguuuuaauguagaauggccaguccgauauaccauauaugccuaaauuaaaacuccgucucaaauuacuaccucucagaagaguauuacuuuauauuugaguccuuacaaaagucucacauaugaggcagaauuucugucaguucuuuuauuuuuaaugguaacuauuuggaaagacacacuagccuaagugacuucagugagagcuuuuugaauauuuauaaaagucaccuggugaaauugguuuuuaaaaaagaagcaaagagauuuuauauagauuuagcaauuauuccuagggguaagacuucacagaaguguuggaugaaguuguaaauaagccuuucgaaaauuaauuuaauaagcaauauagcaauuggguacuauauacaugauacuguuuuagagaucauuagauggugaaggaguacucuuggcuggggauaaaauguucagggacagcaucuaacauggauucaaagaguaacauauuuuggcuacucaaugagaaauuuagauuuaaugugcauugguaaugaauaaccauuauaugagcagaagaguuuuugagcagaggaauuauguaauaaaagcaccacuuugggaauauuuaucuggugcuguuggaaagggaggaagagacaagaguuagacauacagacuaguagaauaauccaacugcaugaucauguagaccagggcugcuuaaucugagcacuauugacauuuggggcaagcuaauacuuuguuggaagcugugcauuguagaauguuuuguagcaucccuggcuucuaaccacuggaugaccccuccauuugugacaaccaaaaauacccucuagacauugcuaaauguuggggcauuaauugggaguaagaaggcaaaauugcccagaguaagaaccacugacgugcaucuaaacuaaaucaguauccuagaaauucaauuauaauguauaauaugaaauuucaacagugauuuuuuucuuuguaucuucuuacauugucugaagccuuuauuauccauuuauuuuaugguuuuuaaaaaagggcagcugacugggcacaguggcucacgcuuguaaucccagcacuuucagaggcugaggcagacagaucacuugagccaaggaguucaagaccaacaaauaaaauaaaauaaagacagcuuuuuugacaaaaacaagaacacaaaauguauaaaaaauuuaacaaaaacaaguaaacaaauuuuuuguaauaagcuuucucuaacaaaaaauuuauaaugauuacaggccgggcgcggugccucacgccuguaaucccagcacuuuggggggcugaggcaggcggaucacgaggucaggagaucgagaccauccuggccaacagggugaaaccauuccuucucuacuaaaaauacaaaaaaaauuagccgggcaugguggcaggcaccuguagucccagcuacucaggaggcugaggcaggagaauggcgugaacccaggagguggagcuugcagugagccgagaucgcgccacugcacuccagccugggugacagagugagacucugucucaaaaaaaaagagaaaaauuuauagugauuacauuuaagucuaaguacaacuuauagagguuuguuuauauuuuaaauaauauuuuauauuuaagaauagcuagcugguaaggaauuuugcaacuuuaagcuguugguuuauuuaucuuuuaaauuagugcaccuggggacuaacccauuaaucagucagauuucucuuaaacauuuuuuaggggagagggagaggagcguuguucuuuuuggcuucauaacuuucuuuuagcagcauuucguucaucuggcuuuaauuuguagaacucuagcgguaaugcacuggguguucuuuuaagggaaggcccacaccaucaguugggcagaggugcugauuuuagcccuguucaucaucagcuacuaaucuguagugccuuagagaauaaucuguucuuccccccaaucccggcacaagagacacuguuagucaggaacuuagaauugauugagcaaagcgggauggaagcaguaugugagauucucgagauggcaaguuuuuucugaugcucuuaagaacuggugauaagggaaugauguucugagcaaagcuugauuuuaagucagaaauggauacaacucuugaauaugauaccuuuuuuccuucuuuuuuccccccgcccuugccucuuauuucuuuaauuuuaaaaggacagaaaaaauuucaaagcucuaggacuuuuugacuuuaguauaugugugugaaauuuuccuagugguccauaguaguaaaauagcugguaaaucauuugagucuuuuguggcuuauauauugcaaaauaagcaguuguagcagguaugcuggggagauguuaugcaacagaaacuacauauuuauugaauuucuuuauauuaagagauuggcaaggaaaagguuuuccaagugcuuaauguaugauaguauacuaggagcauuauaaauggaucauuucauuuaauccacaaaacaacuccaauaaauaaacuccauuuaucagaugaagagauugaggcugagaaaaguugaguauuucccacaaagucccacuacuggaagugcuggcacacaaauuugagcacgucuccaaacaucaaaucuuugguaucuucauucuacucaccauuuucuuucacuuacagcaaaauuaaacauguagguucuuaggaaaucccagauuucauaaaggaguaauuuggugguaauuauuugcauaauaaaauaauucuucuauuuaucacagaguuucuuucaauagagacucccagagauucuuuauuauuagauauacaucuaggaauacaaagaaacuuaaugcuaagacuaacguacaagagugucaacaguggaagacugcuagaaauuaaagaucauuugcuuauucauucaacauauaagcaccugcuuuaaaagcacauaauggauacugggaguauaauaaugagcaaaaacagacguagccccuaccuuguggaguuuguaauauaguaaggaaaacaucacucaaauacucuccuaaauuaauacagaauuauagcagugggaaguauuacaaaggaaagguacuuggugcaauuagaguguauaauaauggugccuaaucucaucuuuuuccuuguaucuagauaggaaugguaaaauuagacaucuuugagacuuuauaaaauuuaagcuauauaaacaaagguuaaacaagaggcucuggagaucccaaacuaaguucauuacuguucuuucuugaggaaauagaaagggcuaagucauuuacuacuuuuauuuuuaaaauuauaauuaauauacucauugcagaauuauuaaacauuuacuuguuuguucaacaaaauuuguugagccuuuacuguaucuaaggcauauuaaucacuuaauauaauuuagauguacugguacaauguuagcuagugaucaguaaccagauuuuacugguuuccguuguaaccuuuuuaaaucauucaacaaauuauaagcugguguaugugcuaaaaauaaaaaauaacgcuuguaucaugaucaggugugagauaucucaaaaguaguuuauuacuaaaaaugauuugacauuaccuaguaaagaugaacauaugcauauucaacaacccaguaauuuuauuccuaaauauauauccuaauuuggagagauucuuuuuuguguuuuuuugaugggagucuugcuccuauugcacuccagcagcuauucacagguaugaucauagccuugaacuccuggacucaagcagucuucccagcucagccuucugagucgcugggacuaaaggcucacaccaccgugauaggcuggagagauucuuaaauauauaccccaggagaugaaucuaagacuguugcagcauuguuauaauuggaaaaacaaaacaaaacaaaaaaacacccuagaaauaacccaaauguccacaugcuguaaaauagauaaaauacauuuuggauuuugauauguuuauacaauggaaauauuauuuauucagcaaugaaaacaaaugaacucuagcuacacacaucaagaaugaauuuucaaaacauuggauuucaaaagcaaaucguagcagaauguauacaauaugauuguauuuauuuaaaguucaaaaacaggaaaaaguaaauguuauacugcuuagagaugauauguacaaauguauaaaauugugaagaaaaccaagagaaaggucaagaaaauucaguguggugguuuccucuuuggggcagggagagguuuugguaucaacaaggaacacacagggaguuucagagauauuuuauuucuuaagcuggguggugaguacaugggccuaaaugucuuugguuauuguuacuuaaaauguccuucuaucucauauauacuuuagguuauauguuuuguaauucuaaaagagaaaacauauauucaaaaaauuaaaaguuauuccuaugauaacuuuacucauuugcauuccaauaugcuuccuggaguggaugagaauugaguggcauuaaagguaauagauagggaaguuuuugugggaggaugacauacauuuuaauaucucugucauguauaucacauaaagugguugagaaccacugcugcuaaaagucuguaguuuaguaggguuggcaguccuguuaacaaauaaccauguuaugagugcucuacuagaagagguaucuuaaaaaagaaauggcuugacaucagccaggaaagcuuuauggggcagauguuauuuaagcuggaucuuuagggacgagcaguuuauaaggggagacuggugaggggagcccacauugcccaauggaggaaaaggguguacaaaggcacagaagccuaaaaguccauagagaguugagugaggaaauucagauauguuaggagccauacugugaagagccuugcccggcacacucuggaguuugcucugugggcauugggguuuuaucacuuaaauuagggauauuaauuucaguauuugauguaaggcugugugcuaguaguuaccuugaaagucuguauguauguauauuuauguucuuuuuccuccauuugcaggcugcuauauggcaagcacuaaaccacuaugcuuaccgagaugcgguuuuccucgcagaacgccuuuaugcagaagguuugaaaucuauucauugcuguagaaugauaaaugaauaacauauaugaaauuccauaacuuuuuaucacuguaacaagauucuagcuaucaucaucuuguuguuuuucugauugacacuaguucauaaaaucuuuacuuuuuuucuguguaguucccuuacauacuacuuuuaauaacuauguagaauugauucagguuuauaugcuaugauuuacuuaaucauuuuucaaucuuuagguuuuuuuuucccccaggguuuuuguuguuuuggguuuuuuuuuuuuuuuuuuuuuuuuuuuuuuuugaaacagggucucacucugucacccauguuggaguacagugggaccaucucagcucacugcaaccucuaccucccaggcucaagcgauccucccacaucagccucccaaguagcugggaccgcaggcacggaccaccacgccuggcuaauuuuuuuuuuuuuuuugguagagauaggguuuugcuauguugcccaggcuggucucaaauuccugagcuuaggugauccaccugccuuggccucccaaagugcugggauuauacucaugggccaccaugccauguauuuuuuuuuuuuuuuuuuuuuuuuaagaaaagagucuguauucuauggugaagaacauggauuuagacucuauagccuuggaacaaauccuaaccugucacuuaaauguacaguuuuauaaccuuggacgaguuacuuuaauaucugaaaauucagauauuucaucuauaaaauaaucauugccccuuagaauuaaaaauucaaugagaugguuuauuuaaagcccuuagcacagccaucuggcuugguaaucaaugcuuaauaaacaccacugauaauguauguuuuguuucugucauuauuauaauucccuuucuaagaugcugauauagaucauuguguacagcuuuuuuuuuuuuuugagucauuuccuuggguuauguacuuuuaaauggaauuuacaagucaaacaguauggguuuaguagcugagaguugugagaacaaggccuaaaccucaggggcaggaaauuucacaaaaggacaaagagcaaugcuuggaaguaguuuugagaaguuaaguggaaaccagccuuaccuugacucugagauagugggauguaaggugauuacuguccaugugagagagcugucuccucgguggagaaugggaauucagugagaaaagugaggaagaucugggcagcaggaguuuaaggucccaaugaaaagauuagaaaggugagaaggaauggaaggcuuagaaagaagauuauacaauagauuaaucuacuccauucacuuaugcaaaagugauguuuauugugaauaaucuauuuaaaaauauuuucauugauaccuaggcaggccccauauuuugcuguauuuuuaaaaauuuuuguugagucagaaucucacucugucgcccaggcuagaguacaguggcacaaucauagcucacugcagccuugaacuccuggacugaagugauccuccugccucagccucccaaagagcuggaguuacagaugugagccacuguacucggccacugucuucuauuucuaguauuuccuuuuuguuuuuguuuauuauuaaagaauaggcaguuucuaguuuauuauaguuaggcucuuaaaaauuguaaauucaugguuuagaauucaauuagauuuucccauagaauugguggcaagauucccagauuaguccacauaaagcuguuuaauccacguuauuuauguaccugauacaaugcuuggcacuuggaaaguugcucaguaaauguuaguuucuuucaauauagaaccucaccauucgguuuaaccauauuuauaugaggaaagauuuuagaauuaaguguaguaagagcagauacuauccuggcucaguaauaauaacaauaauucuaucacuuauugauuucuuacuguauacuagguacucuaaguauuuaauauuaguuacuaauuuaaucuucaauaauccuaucaaauagacauugcuauugccauuuucuggaugaagaacugagacuaauguccacaggcgguaacuaguaaucugucugauuccgcuuucccaagaguagcaauuaccacuucucugauuugcaaccauaguaggcaucacuaauccauuacaguacucauucccacugaaccaaccucagaauucuuggcaacaguuuucuugguggacaauaucaguugauaugcuagauguaaccuguuugcucaggggccuccuaugucacuaguagcaguuucuauauuuggagaaagacauccaacaaggcaugaggcuaaagcaguugaucaguaggaucuucuguaagucaaauucuugaaauaauuucucaguuucacuaguucuuugucgcccauuugucuuucucucgagauuuauagucggccugagacugugggaucagaaagaaggaacagcagaaugauauaagagagaaucugggaggcugaggugggcagaucaccugagguugggaauuugagaccagccugaccaacauggagaaaccccaucucuacuaaaaaauacaaaauuagccgguguaguggcacaugccuguaaucccagccacccaggaggcugaggcaggagaauugcuugaacccgggaggcggagguugcggugagccgagauuacaccacugcacuccagccugggcaacagagcgagacuccgucucaaaaaaaaaacggaaaaaggaaagagaaucugaauucagauacucauuugccauuugaucuuaagccaaaagucauucugagccuuauuuuccuuaucuuuaaaauagaagagaaauaucuguuuaacaagauaguuuuaaggacuaaauacaguaaaauauguaaagagucugcuguaguuucuggcacauagaaaguccuuuacagguucccucuccccuaacauauccuaauacagugacuuuucaggguuuuuuuuuuuuuuucuuauuuuuauuuauuuauuuauuuuugagauagccugucacccagguuggagugcagucaugugaucuuuucucacuucagccuugaccucccaggcccaaacaauccucccaccucaaccucccuacuagaugagacuacaggcacaugcuaccaugcccagcuaauuuuuguauuuuugagaacacgagaucucacaauguugcccaggccagucuuaaacuccuggucucaagcaguccucccaccuccgucucccaaagugcugggauuacagacgugagccacuguggccuggccagauuuuuuuuacccuuauuagauaugauacacucuaauauuuuccauugagugguuuuguuguuguuguuuuaacguaggcugauaaccacuaaauugacaucacaguccacuagugaguugagauuugcuguuuuggaaaaacuguccuaauuuuaccaucucccuccaauaaauucccuucccccauuguaagcauguauuuuucuuucccaccaccaauaccugauccccuugaccaagguuuuucucuuuuguuaauuaacuguuaagaaugaauagaaauaagugcuauacaacaaauagaaauaguguuagacuaugaggaaaaaaauacauuaaugcaacuacuaugauagcucuuuggagauauguguguguguguguguguguguacacacacauauaaaauaagaguuauguucagaaaaucaaccagacauaaguuuugugugcauuuuuuucauaaguaauugcuaccuauggaacucuaugagacuaagaggauuguaacuagugaaaggaaaagaaagagaaacagcugaaaaccuugugucaacauguauuccuagguuauuuugaggguccuagcccagaguucaaaauugcuuaaggucuacuguuuuaucuuaaauuaauguggguuuuacaucccacacugcaaaauguuuuuguuuguuuguuucagauagggucucccucugucacccaggcugcagugcaguggcccaaucucggcugacugccucccagguucaggcaauucuccugcaucagccuccugaguagcugggauuauaagcgccugcggccacgcccaccuaauuuuuguauuuuuaguagagauggaguuucaccauguuggcuaagcuggacucaaacuccuagccucaagugaucuguccaccucggccucccaaagugcugggaauacaggcgggagccacuguauccggucuuuauuuuuuaauauuaguacuuuuuaaacauuuuuuuuuaagucaagaucucccuauguugcccaugcuggccucaaacacuugggcucaagcgauccucccagguagcuaggaauacaggcaugugcugcugcgcccuacuugaaugcauuuuaaaugaccguaaaaucguucaccaauuuucuaccugucuuagugauuaguggguaagauguauagauugcaucggguguaucaauuuuaguaaauuaggcucagugggagagaacugaaccagaguaaaacguucagcaucuguuucuuuucuauuaaccaggauacugagagcccaaacucacagaaauauaugcguacaaauggcaacauauaaaaaaaaacuuauuuaccagauuguguuaagaucaguauuaaagaauauccagaauucuacuaaagauguggaauaauguaucauuuugaggccuuuauugauccaagacucaccuauuuucauugaauuaacuuggauguuucacagacacaucaaacucaauauauucaaaucuaaccuaagauaccacuaacugaauuuuccuuaucucccguucccugccuguuccuuuuccccucccaaauuuauguuccuucuuaaaacccuucagaaguaucuaauuguuguaaggaucuguuccuaaaucuuuacacaguuuacaaagcccugcacaauuuggccaucuuuuuucuccucauauauugccauuuucugccucaaacacuaaggagccuuuuaaaacuucuuccagcccucuuuuauuuguggucuuuuuacucuaagcgugguuuuaaaauacuuaagagcacuauuaaccccaucauuaacaacagguauaaaaccaguugguauugaaaugcaggauguaaauaaauguagaaaagauaaacauugagaauaguauucauaugcuaaauuugcauauguagaugaaauguucaacaguagaaaugacucugaacaacagaaugaauaaugaaauauaagaaaaguauagccuccauacaauugaaaacagaaaaaaaaaaaguugaugaaauagaauuacuugagcauguggcucagggacacuuauguacccccugcauuaauaucaaauaucuauucagguauuguaaauuuaagagaaggccaauaauuaaaauaauagcacauacagccuucacuaugugucagauacuauccuaauugcugugcauguauuaagucauuuaauccuaacagcaaccuuuaaagguagguaucauaguccuuaccggaugaaaaaaaaaugagggucagagaaguuaaguaacucugcccuaagucauagcuaguagguugaagugccagaaucugaacccaagcagucuagcuucagagucgguacuuuaauccacaugucauacuacuuauaguugauuaaaaaacuuaacagauaaucgauuuguuuuauuuuuuuucuuuugagacagagucucgcucuguugcccaggcuggagugcaguggcgugaucucagcuuacugcaaccucugccucccagguucaagcgauucuuguaccucuaccucccaagaagcuggaauuacagacaugcaccacuaugccugauuaauuuuuguauuuuuaguagagaugggguuucgccauguuggccaggcuggucuccagcucguggacucaagugaucugcccaccuuggccucccagagugcugagauuacaggcaugagccacugugccuggcccagauaaucaauuugaaacaugugucacaaaucauaaaaaguuccauagguucuaugcccuuaaauucacacaacaucagaguucaugacaggguagccacagaguacucuaaccucugagggcuucucugauauuuguauaguuuaucaaggcuagguaaagaacagucaccucaacaaauuuuaaauuugucaaaauugguccauuuuagaaaggcugcuuauuuagauuauaaaucagcgugaagaagaggcgucuaucugguuuaaaagcuuugaaagacuaauuuaccuuucuguuugauguaaauguaucuggaggaugcaagguuaaaccccucuuaauuauuuuggacuuacacucaaaagaccuuuccaauuuugaagccaaaccuguuuguaagaagaggaacuucaguagugcugcuacaacuuacuuccuuccuuccuuccuuccuuccuuccuuccuuccuuccuuccuuccuuccuuccucucucucucuuucucucuuucuuucuuucucucucuccuuuccuuuccuguccuguccuguccuguccuguuucgauaguccuguuucgaccgaguuucgcuguugcccaggcuggagugcaguggcaugaucucggcucacugcaaccacugccucccggguuuaagugauuguucugccucagccucccgaguagcugggaucacaggugcacgccaccacacccggcugauuuuuguauuuuuaguagagaugggguuucaccauguuggccaggcuggccuugaacucuugaccucaggugauccaccugccucggccucccaaagugcugggauuacaggcuuaauuuguuuguuuuuucacuuuagcaguacauucuggaaaucuuucuaugucuguauuuuucaucacauggacauagcauaauuuaacuaguacacgauugauuucucaauauuacuuuaagagugacuuaauggagucaaugcuaacuucauucaugauuaugcaauauauuauggaccuuauaauucuaaucccauauuuuaauuaagucuguaaauaaaggaugguaaauaagugacaugcaaacaucuauaacuguuucuggauccuguuauuuugaucacuacucuugguagcuaggccaugaucagccucaagaaguuuucugaacauggcauuucagacagccauuauccguaaguuggaguuacuguucuagaugaaaucuuugucaauccuauccaguaaacauauucugugcuuuuuagauuuauggcugcuuaccacugcuucuuuaguuguguuugggguacuguuaucuuuuucugcugccaaguuacuugugaggagccuaagaaaccacccgugucacaacacuucagauugcucuggauuugcuuccuuaucugacaguuucauuauauuuauuuauuuauuuaaacagaaucucacucugucacccaggcuggaaugcgguggcacgaucucggcucacugcagucucugccuccuggguccaggcgauucuccugccucagccuccggaguagcugggauuacaggcuugcgccaccgcgccuggcuaauuuuuguauuuuuaguagaagacgggguuucgccauguuggccaggcugggcuugaauuccugaccucaggugaucugccugccucagccucccaaagugcuaggauuacaggcaugagccaccacgccuggccaguuucauuauuuuuaaguuuugccuaaaucaccaauccguauucccauuugaacauauaauuuuuaaguuacuaugcuucaaaaagcuaauugcaguauuacacuaaaauuacacacgcacauguacacacaaaaagaauaguuggugucuuuauuaggcaauuuuauugcagugaaaguggaccuacacauaaucaaauauuuguaaacaauugagacagcauuacugugacugggaguuaaauuaguuugugggagccauuguuuauugguauaaucaauaguuuuuaaaaacuuauaaggugaaaagaaaccagaccauuguaaaaucuagaggaaaucaaacuuucuaacuuauguaaauuagaaguuguagcucaguaaaauuaauaguuuauuccuacugcagugagcgccccauucuuuuuuuuuuuuuguagcugcagcacuaauacuacuauacaucucauuaaaacacaucugccaaaauuucuuaucauuuacuauuuauuauuuuuuacacugugguuucauaaaaaaccauaagauggaccagagaagaaggguucuguugguuuuugcuugcacauaucugugacaaaaaacuuagaaauaaaauuucaaauuacuuuuuuauccaaacucuuagaaugauguuaacuauuuaaaaagauguggcaaguuugucuuguacuuuacaacagugguucucaaacuugagaaugccacagaaucacuugcagaguuuguuaaccacguagauuacugguuccuacucccagaauuacuaauuuaguggguaugagaugggacacaaaaauuuucauuucuagcaaguuuccaaguuaugcugauacugguacaaggaccacacuuugagaaccacuggcuuagaagauccuucagcucacugguauuauugcauaacccauuuuuagaagcacaguuuugugguuuucccucucuuuccauccucuuuguuguugccucuguagacccuggauuguggggauagaagugaagugaugaucaguuuaguagagacauagacuaaauaagggugaaaaaugccacuugcauuaagaaggcagggggcauuuccuaauguaaaaaggagggacagauugauagauaacucagcucuugcuauuguaauguaauuuaauuauuguuacuauagucugucaacugaauguuaaaauggugugagcauucacaauuuauaauuuaucuuaaauauaauuuaauguauauuugauguuaaagcaaaacaaguggauuuuuuucaaucuggucuuuuuaaaauauagaaauuauuucauauugguaguuagauuuauuuacacucagguuucucuugcuaaugaaauuugacuucuauccucccgaaagauuuauuagaaaaauauuaccuaaaaacaagauccuuuacugguagucuguuuaaaggcagggguguuucuguguguguaugcuuuucuuaaauauuuacagagaauaccaugauugucuucauuguauuauuuccuugguuucuuguagagaaaaguaaucaagaucuaaggaacugacuuugcuauaagcaaaccguuucuccauaauucaaauuugaauuaauaagugauuguuuuguguuaaaauagcaagccuaauuuuuuuuuuugcuaaacuuguuuauugcaugauaaacugauuaucauucaauauacugaacaauagccuuuuuaaaaaaugucuguuuuuaguacacucagaagaagccuuguuuuuacuggcaaccuguuauuaccgcucaggaaaggcauauaaagcauauagacucuugaaaggacacaguuguacuacaccgcaaugcaaauaccugcuugcaaaauguuguguugaucucagcaaguaaguuuuaaaauauuuucuagcuauuuuguuuuacuuacacuguugaauuuuggauaaaauuccuuucagauuaaacucugauucccuuucuucccuguuuuccaucuauuucaguaacauucgaaauguuuacacuguugccuauggcauuauuuauauuauggagauuucauuguuaugguaauaaauaauagaguuuaacucuggagaaacuuaaguuauaaccgauucuuauugguuucuuaaaugaucacaaauauuucguuuucuuugcuuucaguguuagaccaauuugaguaagccugaaaacccaccagcucacuugagauuaaggcucccuuguguuuaggugauuguauaguuuccuuucaagaucauuuuauugaguacuucuuuugcacauuacaguuaaaccaagucagcugucccuauaccaaauuuggaggcauuuagagauacagauaguuagguucuauucaauucuuuucuguacuguaagagauggaauaaugguaaaagggacuaaacggucacauguguaaacgguguuagauauuuguaaaagccuguauguauaauuggcuuguagguuuacaaggggaagauacaaguaagucucaccauagacugaucaauaacuauauuaucuguccagugacuaauugauggcuuuuuaauuaaagcuagcuaaaauaucugaaauuucugagacauuuguuguugaauuacuuuuaaauuucaaagauccuaauguggaauucuuaaaaaucuuucuuauguaauuugccaguuccuuuuucuuuuuuccuuuuuuuagagaaaggguccugcuguguugcucaggcuggagugcaguggggugaugauggcucacugcaguccccaucugggccuaagcgauccucccaucucagccucccacguagcuggagcugcagacacgugucacuacaccuggcuaauuuucuuauuuuuuguauagauggggucucacuauguugcccaggcugguuuugaacucuuggguucaagcuguccucccaccuuggccucccacaaugcugggguuauaggcuugagccacugugccgggcauaaguaugcaauuuuuaauuaaacuauguuagucuuguuuaauuugcauauacauuucuauuuuaaggaaguaaaaaggaccaccauguuuguuaaugaagaaccauuuauauuuucucccccaguauaguaaucaucuucuguuccuucugacaugaguaaugaauauguugcucagacuggauuuguacauacagagacuaaauguaauugauucuguuuuuaaagguaaaagugaaauuuuaagaucauaaauuuccagccucucaaaugauucuaaauaaguguuugccacuauuguaauuaaaaaaaauuuuuuuuacaaaaaacaaauuggccaggugcagugucucaugcuugugaucccaugagaugagaggauugcaugagcccaggaguuugaaaccagccuggucaacauagugagacccugucucuacaaaaaaauuaaaaauuagcugggugugguggugugcaccuguagucccagcuacucacaaggcugaugcaagaggcucaccugaguccaggaauuugaggccaugugaacuaugauuguacuacugcacucuagccuggguaacaaagcaagacccuaucucuuuaaagaaaggaagacagagagagggagggaugaaggaaggaaggaaaaggaaagagagagagagaaaaaauuugugucuccauaguuagaugcacuuugguaaugaagaauauguuuacaugaacugcuuuuuauauugguuuuuaaaaaucuuuaaauuuguauuuuaaaggcuugcagaaggggaacaaaucuuaucugguggaguguuuaauaagcagaaaagccaugaugauauuguuacugaguuuggugauucagcuugcuuuacucuuucauuguugggacauguauauugguaaguaagaaugauucaaacugucagaaaagcauuuccauacaaguauguuuuauaguuuaaaaaaccuauguugaucaguguuuaucaaauauuacuuggcugaguaguacauagucugauucuaugaccuuauuaaaauagcagagaugcuaaucuaaguuugaacucuccacuuauccuuacugauaauagcuacagcugcccugccuaacaauugaucauacauguuagguuuuuuuguuuguuucuauuuuuuuuuuuuuuuuuugagauggaguuucacucuugucacccaggcuggagugcaauggugugaucucaguucacugcaaccuccaccuccaggguucaagcaauucuccugccucagccucccaaguagcugggauuucaggugcccgacaccacgcccagcuaauuuuuguauuuuugguagacaggguuuuaccauguuggccaggcuggucucaaacuccugaccucaaggugauucaccugccucagccucccaaagugcugggauuacaggugugagccaccguacccggccccauguuaguuuauuuuaccuugggugaaaagaguaucuuuaugugauccacugaggagauagaagaaaagauagccaggugcauugucucacgccuguaaucucaacacuucgggagguggaggugggaggaucacuugaggccaggaguugaagacuagccugggcagcauaccaagaccccaucucuacaaaaaaauaaaaaauuagcugggugugguggcacauaccuguaguuccagcuacucaggagacugagguggaggaucucuugagcccaggagguuggagcugcugugagcugugauugugccacugcacuccagccuggguaacagagcgagacccuguuuccaaaaaaaaaaaaagaaaaaaaaaaagaaaaagaacaaguaacucugcccaugggaaugcuucacauguguaaauguuaucuguugucacuucucccccgugggagaagugacuggggacugcuugucuaaagaacuaggauagcaucuguuuuaagauaaauugaggcuaguuugaauauugguuauuuuucaaaaccuugaaaauguauuucugaacagaauacauuauuugacuaaguuugggggcccguuuucagguguaacggugguauguuuauccauuaacaccacucuugcgaacaugaguaagcaaagacauaauaucaauauauucauuuaccuuaaggacugagaauaauaaauuuaguucaugaaacuaugauucuucuugucauuuagucaagaaacuuugagauucauuuccauuauagcuaaacacacuuggcuugaauauaaagauaaauaacucacagucauacuuggcuugaauauaaagauaaauaacucacaguccccacccucaaagguuuauaauagaguaggagaagagaaacaguaaacaaaaguuuguaagugugauauagugaaauauauauauuuggucuuugaccucauuuccucguauacacuuagaaacuccaaagugauaucuuuuuguaugcaaacgaauugacugguagcuggcauccccuagguagcuucaggauggggacuggcagcaaaagaccaaggcaggauuagaggauugggacuuuucauccccaccccgcaaccucccaggaggugagaggagcugaagauuaaguuucaccauuaaauuggugauaagauuaucaccaacagccaaugguuuaaucaguaaugccuauguagugaagccuccguaaaaacucaaaaggacaggguucagaaagcuuccagaaaacugaacacauggagguuccuggcagguggcuugccuggagaggccauggaagcuccgcaccucucuuuccccaugccucgcccuaugcacucuucaucuguauccuuugugauauccuuuauaagucaacugcucuagcaaauucaucaaaccugaauagagcauugugggaaucccaauuuauagcuaguugaucagaaguuccuuaggcccagacuugugacugguuucugaagguggggcagggcagucuugaagacugagcccuuaaccugugggaccugaggcugucuacagguagaugguaucagaauugaauuagcggacauucagcuggcguuugaugcuugguguguuuagggggaauuagaaaacccagacauuuggucacagaagucuucuguauugaugauuguuacuguuaagagagaauaggaaaaaacaaaauguugcuuuuuccacacucaaaguucguuuuuauuaucacauuaaacguucugucauaaaauuugagcauuauauuguucaaaugagagaauaauuaguccugccugguuaagaagagggguugugauaacuaggaaaaacuugauagaaaaaguaaaauuugacaacaucucauaucuauagagugacuuccagaggaaaauagauguucaaagacuacaaauuauuugagaggagugauguacaaacacuggaggguagacaauuuaugaaagaaguuggcaaaauuuuaauaaggaauguuggagaaauaauccuaaagagcaucauauucuuuuauuuuuagaaaauuaacuaaaaugaaguauuauaaauauuacucuguugaaaaaaguugcauuagauaauaaaaagucacacauggauaagaaaaucucaaaacauuuggaaaugaaaccacauacuucuaaauaauuaaugggucugggcacaguggcucacgccuguaaucccagcccuuugggaggccaagguggguggaucaccugagguggggaauuugagaccagccaggccaacauggugaaaccuugucucuacuaaaaauaaaaaaguuagccgggcaugguggugcacgucuguaaucucagcuacuugggagucugaggcacgagaauugcuugaaccugggaggcagagguuacagugagucgagaucacaccauugcacuccaaccugggugacagagugagacuccaucucaaaaaaauuaaauaaauaaauaauucauggguugaagaggaagucucacaggagauuuuaaaaauauauugaacugaaugaaagggauaauaaauaugacauauuaaaaacuaugauguugcuaaagucuuacagcgaaauuuauagcacuaaauguuuguuauaaaagaacaguuucaacucugcuaucuaagcuuucacuguaagaaacuagaaaaagaagagcacaguaaauccaagcaaacagaaagaaggaaauaauaaaaaguagaaaucagugaaauugcaaacagaaaaacaauagagaaaaucauagaaaccaaagcugguccuuggaaagauugguaaaacugccgaaagugaccccaaaaaagaaagagagagaacaccauuacuuauaucaggaaugaaagaaggaauaucacuaccuacccugaggacagugaaaggauguguaugcugaaaacuuaaaacaacucuaugcacaugaauuuaacaacuuagaugaaaugggccaauuucuuaauaagccacacuaccaaaacucaccuaagaaauagaaaucugaauaauccuaaaauuaugaaagaaacuuuaauuuguaguuaaaagucuucccuaaugcuacauaaucucuuccagaaaacagaacaagaagaaauacuccucuacucaugaggccacauuuccuugauuccaaaaugaaauacuguucuaaaaaggaaaacuauaggccacuauuccuuaagaauacauguauacacaaaaaucuucaaaaaaaauuaggaaaucagauguaucagugauauauaaaaauaauacuauuucucagaaaauugaaacuagaauuacuauuugagccaguaauuccacuugugggaacauacacaaaauaauuaaaaacaggaucuuggauggucaguugacuuuugaagaaggugaaaaacaauuuaauggaggaaugauauccuuuuuagcaaauaauggugccagugcaauuggauauccauaggcagagaaaugagcauugacuuaaaccccauaccuuauuaaaaauuuaacucaaaugaaucauggaucuaaauguaaaacauaaaacuauuaaacuuuuagaaaaaaaucuuuaugagcuaggguuaggcaaagacuucuuaaacauaacacccaaaugacaguacauaaaauaaaaaguugauaaauuuuaucaaaauuaaaacucuuugcuuggcaaaagacauuaaugaaaauacacacaagucacagccugggagaaaauauuugcaaaucccauaaacaacacagauuguaucuagacuauauaaagaacucucucaguaauaaaagaaaaaucaguucaauuagaaaauaaguaaaacaauugaauggacauuucaccaaagagaguauauggaugguaaauaagcaggugaaaagauguucuaaaucguuagccauuaaggaaagugauuaaaaaccaccauuagauacaauggcuaaaaauaaaaacuacugacaauaccaagugcuggugagaggaugcagugcagcaggauuccucguacacugcuggugggaauguaaggugauauuuuacacaggaguucauagcaacuuuauucauaaaagcccaaaacuggaaacaacccaaaauucaguaaguaaauagauaaacuaguccauaugauggacuacuuagcaauaaagagaaacaaacuacuauauugauauguauaguaacuuagauagauuacaagguuauuauggcaagugaaaaaagccaauuucagaaguuucuauaauuccauuuauauaacauuaaucugacagaauuauagugaaggagaacagaucagugguucucagguuggguuagggugaggauguaacuauuuagggguuucuuugggauauuaaaacaguuuuauauccugauuguaguagugguuauagaaauuuguaaaugugauaauauucucuauauaaacguguaaaaacugcuaaaauucaaauaagcucugugguuuaguuuacaguuguuguuguuguuguuguuugaaauggaaucuugcgcucugucgcucaggcuggaguacaguugcacaaucucagcucacugcagucuccaccucccagguucaagcaguucucgugccucagccuccggaguagcugggauuacaugugagcgccaccaugcccagcuaauuuuuguauuuuuaguagagacgggguuucaccauauuggccaggcuggucucaaauucccaaccucacaugauccaccugccucggccucccgaagugcugggauuacagucaugagccaccguguccagcguaguuuacaguuuuguacuaaugucaauuuccuaguuuugauaacuguacuaugguuaugucagauauuauugggggaagcuggguguaggguacaugggaacuguguacuguuuuugcaaguucuauguaagucuaaaauuauuccaaaguaaaguuuaaaaaaauuaaguuaaaaucacaaauauguuauacagucaugugucacuuuaugauggggauuuguucugagaaauguguccuuaggugauuuugucauuugugaacaucauaaagugcauaugcacaaaccuagaugguguagccuacuacacaccuaggcuauauuguauaaccuauugcuccugggccacaaaccuguacagcauguuaccuuacugaauacuguaggcaguuauaacaguaugguaaauauuuguguaucuaaacaaagaaaagauacaguagaaauauggcauuauaaucuuaugggggccaggcaggguggcucacaccuauaaucccagcauuuugggaggccgaggcgggcagaucaccugaggucaagaguucgagacuagccuggccaacacggugaaaccccaccucaacuaaaaauacaaaaaucagcugggcguggugacacgagccuguaauccagcuacuggggaggcugaaacaggagaaucacuugaauccaggaggcagagguugcagugagcugagaucgugccauuguacuccagccugggcagcaagagugaaacuccaucucaaaaaaagcaaaagaaacaaauaaucuuaugagacuauugucauacaugugaucuguuguaacagaaugucauguggcacugaacuauucagauaaaaucauuaaaguuuuuuuaaagaugcaguuaaaucaguuccucagaaagguauguguguguauguauacauauauguaaacaaggaaguucuuuuuucuccuucuucagaggaauauggauggguucuuuuauauuuuuuugguuuugguagauauggggucucccuauguugcccaggcuggucuuaagcuccugggcucaagcaguccuggcaccucagccucccaaagugcugggauuacaggcaugagccacagcacccagccaaggguuauuuuuauucaucaucaagauuaaaagauugaguauugaaaguggaacaacccuaccccaauccuggcuuuucauuuuagccauuauauaccagaauugcaccuaguaaucuagauacauacaugugguuuuguagcuaagguguguuagguuuucuuuucuaucuccaguauagacuuuuuuuugucuuuuugucuauuacagcacaugagacuucuauguuuaggacacaacugauacuaagucugauuccuaaauuauccuauuucuucccaauaccacuuaaauaauauuuuuuaugccaguucuuuaggaaacuucuggcuggguuuuguguguaucacucaauuuuaauaaaaacuucgaucuaaauuuagaguaccccagcacuuuacuuuucuuaaaucuuuguccccuuuuaucucucuauugaauaauuagagguuuuaucuuccaggcuagauuauuauaauuccacaccugacuucuucccuaguuagcucuuaugugauuuauacauauaucuauccauauguguaucuaaucucuuaacagacaugaauuuugauuuaaauuucuucuguuuuguggucuauucaugaaauaauuacucauuauaaaaaucagccuugccaacuuaaccaaguuugauuuuuucuuuuccuaauauaaaaauaauacaauuuuaauuuaaguaauacuggaaaugagacuuuucagcacaaaggaucaccccucuuacuuuuccagaauauuuuucccguaacagauuauuuugucuuugcuuaaucaauguuugucuacuuccuuucuggccauguaaauaauucauacaguucacuaaugcaacuuuuaaaauuauuaauaaaaaugucuguuuuauaucacauucugcuggcaaagcaaggggacggggcuacuugaaaacaggaaacagguaguauaaaaauggcaaagacuaauucuccauucucagagagcuuauaaucacuugcaagagagaaugcuugaaaagauaaauaggcagacuaugguuaguauuaugagacagaaggggccuagauagaugaauugaagggaugaagaggcaagacauuaauuaggaaucuauugaugguuuagaugagaagcaauaaggauccuaacagugaaaauaaagagggaacuuaagccagaaauaaaaugaaaguacaugaauuauggcuucguugcugauuggcugugaaggucagaggagaagaagaaggagucagugcuaucucuaaguaggauuuuugagucuguaaacuuguaaaaauagugguguccuuaaaacacacacagaaagaaagagaaagaacagauuuuggggagaaaagaugaacuugacuuugaauuuacuaagcuuuagauaaggaaguaaaaccuagaugaaauugcccaucaggcaaaggaaagguaagguugaaguuagaaguagauuuaguugucaucucuguagaagggauucucaccagacagagauuuucuaaagaagggacugaggccugagggaauggcuuuacuuaggaacuacaagaagaaaaaaaaaaaaaaugaagaaauggucauugaccuauuugaagcuuaggauaauccucaaacaaugagauuucacuguauuuuguuuuuauuuauuuauuugagacagagucucgcucugucacccaggcuggagugcaauggcaugaucucgacucacuguaaccuccaccuccaggaugcaagcaguucuccugccucagccucccagguagcugggauuacaggugcccaccaccacaccuggcuaauuuuauguuuuuaguagagacgaguuuucaccguguuggccaggcuggucucgaacuccugaccucaagugauccaccugccuuggccucccaaagugcugagauuacaggcaugagccaccgugccuggcuguguauuuucuuuugcuuagccuuauguuaaaagcucccaagcacugauuugccacguuccacccuauuacuuucagcaaauguuuuuuuguaugcccuuucuucauuuccuauuucuaaauuaccacucuaucccuggugggugauuaugucagucuuaugacaauuauauuuaagaaauuucaggccaguugugguggcucacaccuguaaucccagguuugagaccagccugggcaacauagcaaaacaccgcuaacuuuuuuuuuuuuuuuuaauuagccagccaugguagcaugcacuuguagucccagcuacuugggaggcugaggcaggagaaucacuuaaggccaggaguccagccugggcaacauagcaggauccuaucccuuuaaaaaaaaaaaaaagaaagaaauuuuugaucuaaaugaucuuagauacagacuuugauaaaacuuauuuauguuuuccaaaagucugcauccuacuucugcuuccuacuuuguccauuuguuuauuggcuuaaauuacacaagugugggaagcuagauauccuucaacugguaguacuuucuuugucauaucacuuauuucuaguuuuuacucacuugaaaauuuggcagugaggcaaacuaauaucugguuccccaaggguaccuucuucauaguucucugagguuauacugacauuccgcacauaaacagaugauguauacauuuuaccugauaguuucaguugaggaucucgguuagauuucuucugguccuuuauauauaaaaccuuagaauuuuggaagaauugcuguucugaauuuuuuuccauuugauauugaagcauuugaacuucagaccagguaaguuguauuuuuuaccugaaugcuuuaauuggucucacuagccacuaaccccuuccauccuccuauuuaaaagcuaaggaggaggcgaccaggugcuguggcucacgccuguaaucccaacacuuugggaggcugaagcggguggaucacuugaguccaggaguucaaaaacagccuggccaaccuggugaaacccuaucucuacuaaaauauaaaaauuagcuggcaugguggugugcaccuguaaucccagcuacucgggaggcugaggcaugagaaucacuugaauccagaagguggagguugcagugagccgagaucaugccacugcacuccagccugggcaacagggccagacucucaggaaaaaaaaaaaaaaaaaaagcuagagaggcagcaaugcuguucugauaauccccagauuuuuccaaguauauauguucccagggauauuguccagauuccauauguaagcguuuauacaccugauuuagaaagaaacauaaauuuuccuuuucauuaaggaagcagauccuccacaaacagaucuugaggggagaggggaggaaaaagaccuaccaccucuaguuuguuugaaaaaaaaaaaaaagaagcagagguuucagcaguggcauccagggcuggggucgcagccguggauggggccgggaccgaggccacggagcucguggaggcaaggccaaggauaaggaguagauucccaucaccaagcuggggcuccuggucaaggacaugaagaucaagucccuggaggagaucuaucucuucucccugcccaucagggaaucugagaucauugacuuuuuccugggggccucucucaagcacaagguuuugaagauuaugccggugcagaagcagacccgugccagccagggcaccagguucgaggcguuuguugccaucgaggacuacaauggccacgucggucuggguguuaaaugcuccaaggagguggccacugccaucugcagggccaucaacauccuggccaaacucucgauuguccccgugcgcagaggcuacugggggaacaagauuggcaagcccuacgccgucccuugcaaggugacaggccacugcggcucugugcuggugcgccucgucgcacccccaggagcacgggcaucgucuuggcacgugugcccaagaagcugcucaugaugacugguaucgaugacugcuacaccucagccaggggcugcacugccacccugggcaacuucaccaaggccaccuuugaugccaucucuaagaccuacaacuaccugaccccggaccucuggaaggagacuguauucaccaagucucccuaucgggaauucacugaccaccucgucaagacccacacuagagucuccguacagaggacccgggcuccagcuguggcuacaacauaggguuuuuacacaagaaaaauaaagugaauuaagccuggaaaaaaaacaacaacaaauaaaaaccuggucauuuaugcuauauuuaaagcauuuaaaucacuuucagaauuaccacugggaauguuguauuaaaaauuaaggccaagcgugguggaucacgccuguaauuccagcauuuugggaggcuguggugggcagaucacuugagcucaugaguucgagaccugccugggcaauauggcaaaaccccaucucgacgaaaauacaaaaaggccaggugcgguggcucacaccuguaaucccagcauuuuggaaggccaagacagguaaaucaccagagcucaugaguucaagacccgccugggcaucaauggugaagccuggucucuacaaaauaugcaaaaauuagccggauaugguggugcgcaccuauagucucagcuguucaggaggcugagguaggaggauggcuuuagcguaggaaguagggguugcagugagccaagaucaugccacugcacuucagccuguaugauagagccagaccuuguccaaaaaaaaaaaaaaaaauuaagaauaauacugaaggauuuggauguuuuucacaucucccucaauaacucuaguaucugacaggaaguuuaaaguaauaguaauauucaagaaggcaacgauaguuuguuuuguaagcauuucuuuugauucauguucugugcgcuuucacuugauuuggagauuagcagaugggagaaauugguaacuuagagaagcaucacaaagagugcucucugaacuucuguaacuuuuaccuaauuuuuuauacuaaaaguuuaugauacagguuuugggguuuguagcuuauuuaaucuacuuguuucucuccacagcaagacagaucggcuugccaaaggaucagaauguuaccaaaagagccuuaguuuaaauccuuuccucuggucucccuuugaaucauuaugugaaauagguaggugggugggguugagagguggguggguucccaucuccucuucuuuuuuuccugcuacuuaauuuuuggagagcaauacagaucaucuacccccaagaaaaauauuuuucaaaguuaaaauugagaauaaaaaauaaguuagaaucuucgguauguuucaagaaucauauaacugaaaauuacacaaagauuaaauccaguagauucuucuguugaaccaaucuauuuucaaguaucugguguccucuagaauggguuauauuguguguuuaacacuagcaaaauugcuuucugaauaagaaaauuaauaaaauuucuaaugcaauuaauaaaugccugaaacuuacaagaccugaacaguacagggagagaauuucucaguauauuuggccuaggauacauaaaggaccauuuuucagcauuguugcaucuauguauauauagaagggcuucaaccuuuacuguaaaauaugauggguuuuaacucuucaaccucaucuccuacuuugagaaaaaugagaucuaguuauuuucagcuuuaaaacaaacacagaaaucugcauuuuucugcgauuuguuauguuuaaaauuaguguucuuguaguuuauuuucauuuacagcuuuaucuuacugguaaacuuuuaugauauauugauagauggguuuuuuggggguaaauuugauuagcagaaguggacaggagauuuuuaaaguuuggauaaggccuauuuccuguuuccacugauuuaugcauacuugaaaaacauguauuccucacuuccucagagacaaacuuuuuuuuuuuuugucuucacaggugaaaagccagauccugaccaaacauuuaaauucacaucuuuacagaacuuuagcaacugucugcccaacucuugcacaacacaaguaccuaaucauaguuuaucucacagacagccugagacaguucuuacggaaacaccccaggacacaauuguaagugucuuauauucuaguguucaaaauauuaugaaaacuacaaagaaugaucugaacuaaauaauauauugugaaugacuugguagaaauuuucuguuucaggaauuaaacagauugaauuuagaaucuuccaauucaaaguacuccuugaauacagauuccucagugucuuauauugauucagcuguaauuucaccugauacugucccacugggaacaggaacuuccauauuaucuaaacagguucaaaauaaaccaaaaacuggucgaaguuuauuaggaggaccagcagcucuuaguccauuaaccccaagguaagucaaacaagauacuuucaaaugugcuauaauaccaaaugaucuuaugauaacucauauuguuaguaaugcagauuauuacaacagcaacuucuaaaucacuguggaaacaggggcauucuguuuucagaaaaugaaguaaaaacuggcaaauagugauguugccaggugcgguggcucaugccuguaaucccagcaccuugggaggccaaggcaggcagaucaccugaggucaggaguucaagaacagccuggccaacauggugaaacccugucucuacuaaaaauacaaaaauuagcugggcaugguggcgggcgccuguaaucccagcuacucaggaggcugagacaggagaauugcuugaacccgggaggcggagguuguagugagccgagauggagccacuacacuccauccugggcgacagaccaagacuccaacucaaaaaaaauugauauugaauauuggacuggccaggcgcaguggcucacgccuguaaucccagcacuuugggagaccaaggugggcagaucacgaggucaggagaucgagaccauccuggccaacauggcgaaaccccgucucuacuaaaaauacaaaaaacuagccgggugugguggcacgcgccuguagauccagcuacucgggaggcugaggcaagagaaucacuugaacccgggagacagagguugcagugagccgagauggugucacugcacuccagccugggagacagggcaagacuccaucucaaaaaaaaaauuggaggaaaauuuaaaacucugaaauauuccuuaauuagguaguaaacacauuaaaaaauacugucuuuauggcugugcauuaauggauagcggugagccucaugaaauguuauaaucagggcaccacugguuacuguuaaagugccuuuuuccaaaacauggaggaaauuugacaccuaccuuuuuuuguuugagacaggaucucacucugucacccagguuagagugcaguggcacaaucauagcucacugcagccucaaauucuugggcucaagcgauccucccaccucagacuccugaguagcugggacugcaggcacaugccaccacaccuggcuaauuuuuuaaguguuuuuguagagauggggucuugcuguguugcccaagcugaucuggaacuccuggccucuagugauccuccugcuguggccucccaaagugcuaggauuaccgugagccacugaaccuagcugucacaccuauuaauauaaaauauuuuaucaaaauuauuagaaguauauguauguauaaauacaggaacucagcccagaggauacauauccaaaaguaucaaaaugaaaaauuaugugcuagaauggguugggcaugggggcucaugccuguaaucccagcacuuugggaggcugaggugggcagaucacuugagaccaggagcucaagaccagucuggccaacauggugaaacccuaucucuacuaaaauuacaaaaauuagcccggcauggugacacauacguguaaucccagguacuuuggggguugaggcacaagaaucauuugaacccagcagguggagguugcagugagcugagaucaugccacugcacuccagccugggcaacagagcgagacucugucucaaaaaaauauauacauauaugcuagaagaaauucuaugaaucagguccugaggccggggaacuacuaaaauagcaugaccaugagauuacaacucuggagaguuauaguuaucuaauggucucuagagacauuuucucuguaguugugucuaaaucccauaaauuccaagaauuugaaguaaucucaucauuuggaucuuagauuuauaaagcuacucuucuuuauuucuaauaaaucuccugagaucaguaauuguugcucaguuuaguuccuuguuugauagcuuuuuaaaauuuuaguuaugguggguggaauagucuacauucacagcuuauuuuuaaucugccccucagauccucacugucccuaagacugauuugccauucucuuccuuuuagaccuucuaauuuaaguauacugcugcuuuauauaugccuugaugacuuuuugacaccuugauuucaaccucuucucaguuuugggauuuugccauuagaaaccccaaguccuggagauggauccuauuuacaaaacuacacuaauacaccuccuguaauugaugugccauccaccggagccccuucaaaaaagguauuuuccauguaaaaugcaguuugggaauugauuaaagcaacuuguuuauuucaaucuuuuaaagguaaucucagggaaaaucuuacuuuauguaauugcuuuugccuuauauuugaacccagcagguagagggugaucuaaauauaaaagaaugucauuauuguuguagccucuugguuacaguaggagacagacuucuuacucuuuuggccaaguaagauuguaucucacaaauuuaguuuauuucagcauauaguuaaauaaacauaaucauauuuuuacuuuuuaauuuccuuuuuaaaaaacaaaauuaauauuguuuauauuacuugacuauaaauaacagaaauuaugucugccauaguuuuuacuugucccuaccacuguguauauauguuuuuuuaauaacacuaauaauuauaugaaaaaaaauuugcucagguaaagccagauauuucugauaauaagauuuuugguagaucauggauguauaguuuuaacaugaaaaugaaaaauauuugguaguauacuuauaguaaauauugcggcaaguuucaugaggcuuuuuuuuuuuuuuuuugagacagggucucgcucuccugcccaggcuggagugcaguggugugaccaugacucacuguagccucuaccucccaggcucaagugauccuuccaccuuagccucccaaguaccuaggacuauagguguacaccaccacacccagcuaauuuuuuuaacuuuuauuuuuguagagacaggaucucacuguguugccagggauggucucaaacuccugggcucaagcaauccuccugccuuggccucucaaagugcuaggauuauaaacaugagucacugcccugcugaggcucuuguuuuauaauguucccuuuuauagguauauggaaauagaggccaaaauaccauuuuuaaaaagcauaucuguggcacaagguaacuucugugagaauuaaauuagguucuauauauaaaauaccuauugccaugcuucauaaauauucaagaaauggaagcuaaacaagucauacuaauaugugaauaacaguuauacucucuuuaccuuaauagaaacauguuucuucuuauaguuguuuuuuuacuauuuuacuccugaacauccuuagaaucugcaaaagauuuuucuauaauaacuccuuagugagugauaauaggaacuccaagaauacuuaaaagggacugcaaaauaguuuguguauggauuguuuuaaacauuacaguuaugaagaaggcaaaacaaaaugguaguuagcaugccaggugaaguaggccaaaacuagaagagccauaauaaccauaauaaccagagcaaguuaagacagugggcaggcacaugauuuuagugcccagauaagauugcucucucauccucuucugccucuguucuccucuuaccuuauuacaagacauucccagaaaagucacgcauguaggucugcaugcagugucaacugaaaauaucaaaccagguauugagugcaguguacauaguucuuugauaaauaaggaaaagccagaguugacuuuugucccuuggaugaauguagugaucccaauuuggaaaaggcggaggaaggcuuaugaaguuuuauuuugaaguggugguacauuagaugaaaauauucaguagaaaguuagucauagaggaaaaaaugugaccugcugauagaaauaauaauugaaacuauuaaaaugaccaggcucuccuagggaaagaaagaguagcuaaggagaacagaguaaaccuaauuuaaaaauaguagaaggauaaagggccagcaaaugaaguggcaggacaaauaauguaauguuuuggaaguaacacaaaguuucaaaaaguagggcaugaucagugauguugaaugcaggaaaggcuaaaauaagguuuuaauaucugaugagacagugauuauuagugauuauuuauaauaugcaguuugaggauuguguacaggacaucaggguaacaguaaguuuugaagaaaauucucugguagccaaaggggaaaaacagugcacugauacaauagucauagaucauuuaaagaagcuagaugguggaaaugaauagaaauaagggaauaaauuagagaagacugaagagccaagcaaagauuuuuuuuucuccaagggaacagaaaccaauuaaugaagauuagaaaaacuaagcaauauuaacucuaaagaacaauauccuuagguuuuggaaaguaaucagaugguuguuuuuuuaaaaucuacuccucugaacuccuuuagaacuguuaccaagugccaaaggaguauaaaaucuuaucguauuauuauuuuuuucuguguauaaugagauaaaucauaaaucuugagaauuuagcugucuuaaaauuuuuuaguacuuaaccccaaauagagaagguauguaauaaauggaggauggucacaaugagaugaaaagaauagcuucuggggauuuuuagucuuugaaacaaaaagcgaaagaugaaaagacauuauagagguaaaaauacugugagauuaaaacagggaaauagacugauguucauacuaauacaacaauaauuaacaauaugauauaaauaguuuaucuuuaaggugacaguauauuauggcugcuuguauugagaaaauguagaugggagcguuguguugucuuuuaucauuuacagugcagcccauaauucacaaaccuuagacuuuucguguuuuacagucuguugccagaaucggccaaacuggaacaaagucugucuucucacagaguggaaauagccgagagguaacuccaauucuugcacaaacacaaaguucugguccacaaacaagguauuuaucauuguaauuauucaacuuuucuuggcauaaaacuugauucuuuacauuucuuuaauuuaggcagauagugacucucguggauucuagaauaacuacuguaaauuuugaagauguaaaauuugaaaccucuaacuuacaacacuaauguaauuuugaguugaguuuuguaaugcacagaagacaauaguuaacuaaagcagcauuuuaguuuacucugauugccucauggauuuguaauuuucuucuuaugcacaugacccuuucuauaguuuagguacagauagguuucauacuccccuuccccacauuaugcaugucuauaaacagauuauaaaaauaacagacaaauaaacuucaaauaaugaaucuauuuccacacagaaaugguguuagauaggauuuucuuuuccucuucaaggacucaauagauuauagcuaacauuuuaaaaggaagauacaauuuucuuucuccuuucuaaaacugugaacauguaccuaaauuuuaaaacagacauacacacaggugugcauauaccuccuugacuaucuaaaagaccucuauguuccuguaaugcucccagaaugguaagucuaauccucuugagugccagcuugcagugauugccugaggcucuguugugagaaggaacuugagaccuccugcaaagcaacauuauauguaaaaauaauuuccgauuuguacauuucacuuuagagucaaacaaauagacuaacacuaauaaacaucagcucuuuuuuuuauggagauggaguuucacucuuguugcccaagcuggagugcaguggugugaucucggcccaccacaaccuccgccucccggguucaagugauucuccugccucagcuuccugaguagcugggauuauaggcaugugucaccacacccagcuaauuuuguauuuuuaguaaagacaggguuucuccauguuggucaggcuggucucgaacucccaaccucaggugauccgccugccucagccucccaaagugcugggauuacaggcaugagccaccgugccuggccaacauucacucuuaauaauuuuguguucuuuguauuguugauuccauuuuaucuccuuaauugccuauauuaguuuucuagggcugccauaacaaaguaccacaacuuagugucuuaaaacaacagauacuuauucucuuacaguuguaaagccauaaguccaaaaucaagguguuggcaggguuguuccccuuccaaaaucuuuagaggaggauuuuuccuugccuccuccagcuucugauaaccccagguguucuuuagcaugugacaguauaacucaguaucuuccucugucuucacauggucaucuuccauguguguuucuguaucuaaauuucccucuuguaaagacaacaguuauauuggauuagggucaacccagauauccucagcuuaacucaaugacaucugcaaaaaccaaauuucugaauaaaaucacauugacauguacuggggcuuagggcuucaacauaucuuuuggggagguacaauucaauauugccuuauuagcaauugcucuuuauuuugucuuuuuaaagguuguuuggaguuuguaguaaacauuuuaacuuaucaagguuugccuucaaguaauagacaauuucauguauagcacagaaccuuacaauaguauacuuucgugcuccucucuuagucuuuaugggagggauggcuguaauauauuuaauuucuauauauguuauaaaccccacagugcauuauugugguugugguuucugccuuaaacagucaguugucuuuuuauagaguuuuguuuuuguuuuuguuuuuguuuuagacggaguuucgcucuguuacccaggcuguagugcaauggugcaaucucggcucacugcaaccuccaccuccccaguucaagcaaugcuacugccucagccucccauguagcugggauuacaggcaugugccaccacgcccggcuaauuuuuguauuuuuaguagagacaggguuucacgauguuggccaggcuagcgucaaacuccugaccucaaaugauccacccgccucagccucccaaagugcugggauuacaggcaugagcuaccaugcccagcugaaauuuuuuuaaaugagaaaaagaagucuauuuuauauuuacacacauaacuacaauuucuggugcccuuuccuucuauagauccagauugcgaucugauaucauuuuccuccaccuugaaggacuucuuuuuaacauuucuuuuuuuuuuuuuuuuuuuuuaagacagagucucacucugucaccaggcugaagugcaguggcacgaucucggcucacugcaacuucugccaccuggguuaaagcgauucuccugccucagccucccgaguagcugggacuacaggugugcaccaccacacccagcuaauuuuuguauuuuuaguagaaacgggguuucaccauguuggccaggauggucccgaucucuugaccuugugauccuccugccuuggccucccgaagugcugggauuacagucaugagccccaccgcaccuggccuuuuuaucauuucuuauaguacgagucagcugguaaugaauuuuuucagcuuuuguggaucagaaaaaaaguucuuauuucaucuuuauuuuugaacaauauuuuuacuaggcaagaauuucuuucuuuuucuuuuuuuuuuuuuuuuuuugagacagagucuugcuuguugccugggcuggagugcaauggcacaaucuuggcucccugcaaccucugcuucccgaguucaagcaauucuccugccacggccucccgaguagcugggauuacaggcaugugcuaucaugcucagcuaauuuuugcauuuuuaguagagauuggcuuucaccauguuggccaggcuagucuugaauuccugaccucaggugaucgcccaucuuggccucccaaagugcugagauuacaggcaugagccacuacgccuggccaagaauuucuaauugacaauuuuuuuagggauguugcuuuacugguuuuuuggcuuauauuguuucugacaagaaaucugcugucaaucucauuuuuguuccucuauauguaguaauaugucuuuucucuguuucaagguuuuguuuuuaauugcugauuuuaagcaauucgauuaugaugugcucuaguguagcuuuguuguuucucggccuuuggauuuauugagcuucuuggaucuguggguuuauaguuuucauaauaguuggcuaaauugggggcauuauuucuucaaauauuauguccaugucuuacccucucccucugggacuccagguacuuguauauuagauugcuugaaguugccccacagcucacuaauucuucauuuuuguuuccaaucuuucuccucuccguguuucauuuuggauaguguuuauugcuaugucuucaaauuaauguuucuucagcagugucagaccuguuauuaaccacacccaguguuguuggguuuuuuguuuuguuuuguuuuuuuauugcagacauuugucuuucaucucuagauugauuugguuuucuuucuuucuuuuuuuuuuuuuuugagauagagucucgcucuguugcccaggcuggagugcaguggcacaaucuggcucacugcacccuccgccccuccuggguucaagcgauucuccugccucagccuccugaguagcugggauuacaggcaugugccacugcgcccugcuaauuuuuguauuuuuaguagagaugggguuucaccauguuggucaggcugaucucaaacuccugacucgugauccgcccaccuuggccuccgaaagugcugggauuacaggugugagccaccgcgcccagccuuuuuuuuuuuuuuuuuuuugagacagggucucacugucacccaggcuggagugcagugaugcuacuauggcucacuguagccucaaacuccuuggcucaagcgauucucuugcguuagccuccugaguagcugggacuacaggcacaugccaccacauguggcugauuauuuuuauuuuuuauuuuuuuguagagacaaggacaaggucucuaugagacaaggucuugcuauguuguccaggcagaucuugaccuccgggccugaagcaguccuggcuuggccucccaaagugcugggccgacaggcaugagccaccucauccagucucuucuauguuuuugaacguauaggauguauuuguauuuuuuuaauguuuuugccuacuaagucuguuacuuuguuauuucuaaguguuucuuauauuacuuuuccucuucauuguagauuauauuuuccugcuguuuucuaugccuaguguuuuuuuuuuuguuuguuuguuuguuuguuuguuuguuuuugagacggaguuucgcucugucgcccaggcuggagugcaguggcgcgaucucgacucacugcaagcuccgccucccggguucacgccauucuccugccucagccucccguguagcugggacuacaggcgcgcgccaccaugcccagcuaauuuuuguauuuuuaguagagacgggguuucaccguguuagccaggauggucucgaucuccugaccucgugauccgcccgucucggccucccaaagugcugggauuacaggcgugagccaccgcgcccggcugccuaguguuuuuuaauuggaugucaguuauuauaaauuuuacuuuuuuucuuugagacagggucuuuuacucugaugcccaggcuagaguacaguggugugauuauagcucagugcagccucaaacuccugggcucaagaaguccucccacuucaggcuccuggguagcuggaacuauaggcacgugccacauauggcuaauuuuuuuuuaguuuugcagagauggggucuugcuguguugcucaggcuguucucaaacuccuggccucaagcaauccucccaccucacccacccgaguuguugggauuacaggugugagccacugugccuggcuauaaauuuuacauuguugauuacuggauauuuuugcauuccuuuagguauuuuaaaguuuuauucugagaugcaguaaaguugcuuggaaacagcuugaucccuucaggucuuaccuuuuaaauuuuguccagacaaaaguagccuuagucuggacuaaucuugucccaccauugaggaaguacccuuugaguacucuccucaaaaaccuguuuaguaugagguuucuucacucugccuauugaaaguaugagcuauucccagcuuggagugagauccaguaauuauucugucugcuucuuuucaguaauacuuuccccagcuuuggguaguuucuucacuauaguacuauaauguaauucugaugcuaacuacccaaacuuagcacagacaccacagguuaagaucacaguccccaacaagaacugucugaacugcccaguuguagguucuggguuccccaggccacccacauuucugaccaacuggcuacaaauuuaaggauuccuacuacccucuuacauucaguaauuugcuagagcaccucacagaguccaggaaagugcuauacuuaaugauuacaguuuuauuguagaugacauaauuaggagauccauaggauuagauaugggaggguccugauacagagcuuucaugucuucuuucugggcucacccucccaaugcaucaguauguuuacaaaccaggaauuugagccaaguuuugguguucaaaauuuuuauuaggguuuuuaaauuauguaggugugauugauggaaucauuggccacaugauugaacucaauuuccuucccagaggagcucaggcugguguugcuggcucaaagccccagcccucuaaucacaugguugacuuuuuuuuuuuugagacagaguuucgcuguugucgcccaggcugcaaugcaauggcacgaucuuggcucacugcaaccuccaccucccggguucaagugauuacacuugaacccgcgaguggcugggauuacaggcacccgccaucaugcccagcuaauuuuuguauuuuuaguagagaugggguuccaccauguuggccaggaugaucucgaucucuugaccucgugauccgccugccuuggccugccaaagugcugggauuacaugugugagccaccaugcccggccacaugguugaccuuuacagcacagccagcacccauccagaaaguaucuaggaguuacuucauuagcauaaauucaggcacggucccaggagcucauaaugaauaacaaagacaucccugucacuugaggaauuccaaggacuuaguagaucucaggagccugggacguggaccagacaaauucuuuauuauauaacacucaaacaccuacacugaucaauuuucaacugaagacucuagggaagcccucugcagaucuuuguaggucuccucuuuguagcucucuucucucuggugcucugccuugcaaauucuggcugcuuuggcuuucucaaauucucaacauuuucuuuucaacacagugggaccacugagcucuauuuugcauucuuuuuuccugcaagguggcccuagaacuguccucggaaauguuuugccuauuguccagugucugaaaaccauuguuccauauauuugguucaguuuguaguuaucugaaaugggagaauaaauuuauuccauuuuacucugucaugacuagcggaagucuguucuuucuauuuagaaaguuuuuuuagagaugauuagaauggcauaguacuuuuagcuaaaucauccaagaaagguugugugucauuugcuccauaugaagugaagucuaauucugaacuuuggaagccuuucguuaucaaacuccuaguuuaucagaugcagauuaaaaggauuuaugugugugugugugugugugugauauacacacacaugcauauacagagguaucuguacauauuacauauguacauaucguaaaagaugaaaauauauaucuuuuuauuuucugaaauucuuugacccagacucagguagcuaguaggauuucccauaaauuauaaaguuuagauaguuuaguccacaaguuuacccacugucaauucuagauuguuucagauuuuaaguuugcuugcuaagauugaaauucucauaucucaggguuugccuuuaaaguaaaaauguacagaggcuccuuucgcucuaaagagaauaagccuuugauauagcuguuugaauuuacagggaaauaacuucucaaauauuaguaguucuagugguauuuacuuguuaacaaauaccccacauuuagacuaucuuugcccaacugucuuuucuuuuuucucuaacuuguuguaguugcaaaugaaggguaaaaauaauugauuuauagaugugcuuaucauuugucgauccagaguuuuaugaggauuauuuuuaguucaaauuaagaauuucagagagagugaagaucuaugcuauaaucuuuacuauuuuguaguaacgagucauuuuauuuuuauuuuuuuauaugaaggaaaguuuauuaaggauuauugacuuaugaucacaaggugaagucccacaagaggccaucugcaagcugagaagcaggaaagccaguccgagucccucauuuuuaaauacuguguuuucauagagaaaccacgaaaagaacugaucaaauucaucaacuuuagaguacuuauauaauuaauguauauuuuuaaaauauacccaaauugaaacaaugguuaauggucauaaaucaaguaaaauauuaaugucuuccuuuauaauuuuuuuuuaguacaacaccucagguauugagccccacuauuacaucucccccaaacgcacugccucgaagaaguucacgacucuuuacuagugacagcuccacaaccaagguaauuuaaagauuucuguaugucacauuuacuuaaugcuucgccugcuaacauuucuguucauugaugacuccauuccuaauaaguuaacaaagagacuauuucgaauuuuaaaauguuuuaauuuagagggccaucuaugauuuuugugaaguuaauuaguccuuugguaaauauuauauaauauucuuuuuuaauuaaaaaauuuuuuuucucaaguuaaaaaugacauaggaauaaucuugaaauggcaaaauuauaggaauggacaacagaucagugauuauuaggaguuaggccucuagggaggauguuacuauuaaaucauggcacaaaagaauugcauuguggugguacaacaguccuguauccugauuguggugguugauuacacagauccauucacgugauaaaauuuuauagaacuaugcacacacauacacacacacggguuuauauaaaaacugaugaaauccauguaaggucuuuagcugauaauauuguacuaauuucaguuuccuggguaugaugauauacuaugguuaugucacauguuaucauuugcagaagagugagucuaaaauuauuugaaaauaaaaguuaaaaaaaacuggagacccggcggacgcaguggcucacgccuguaauccuagcacuuugggaggccaaggugggccgaucacuugagcuuaggaguuugagaccagccuggucaacauagcaagaccccaucucugaaaaaaaaaauuagcugggaugguaguacucuuugaucccagcugcuugggaggcuguggugggagaaucacuugagccuggggaggucaaggcuguggugagcucugauuacaucauuacacuccagcacgggcaacagaauaagauccugucccaaaaacaaaacaaaggccgggcacgguggcucaugccuguaaucccagcacuuugggaggccaaggcaggcagaucaccuaaggucaggaguucgagaccagccugaccaacguggagaaauccagucucuuccaaaauaaaaauuaaccgggcgugguggcucaugccuguaaucucaguuacgcgggaggcugaagcaggagaaucgcuugaacccgggaggcagagguuggguugcggugagcugagaauuacaucuacuuauuuucuuacuuuuaaauaauaaaugagaguuugauauacuuucacaagagggcuacacuuaaugcugacacaccuuagucacuauuaguuaauguaauuuauguucagaauuacuguguuuaaaauuaaaugacuuugaagaccuuuguuuuuauaaacucucuucugaaaaaaauauagaauuaaucaagauuguacauuuauuuuauaucuaauacuggagaaagggcugaggagaaaucuaaaauacaugaguauaacaggugugaaauuucuucccuuuuacaggagaauagcaaaaaauuaaaaaugaaguuuccaccuaaaaucccaaacagaaaaacaaaaaguaaaacuaauaaaggaggaauaacucaaccuaacauaaaugauagccuggaaauuacaaaauuggacucuuccaucauuucagaagggaaaauauccacaaucacaccucagauucaggccuuuaaucuacaaaaagcagcagcaggucuguuuuaaaugcuuaauauuaucuuuguauuuuauuauguacuuauuuuaaguaaauuucuuuauguucauuacaguaccuucauuguuuuuuauauagauguuggaauuuuuaauagauuaguuuguaauuaccuuuucuagagaagcagacuaguuuauugcguuuuuuccuuuguuuacuauguuguuuucuccuagaagguuugaugagccuucuucgugaaauggggaaagguuauuuagcuuuguguucauacaacugcaaagaagcuauaaauauuuugagccaucuaccuucucaccacuacaauacugguuggguacugugccaaauuggaagggccuauuuugaacuuucagaguacaugcaaguaaguauagaaaaugguuauauaugccuuucuagagauaauuucaauuucauuaaaauaaaugcccaugcuuaagaaggcuagaucuaaaagaucaguauuuauuauguaaugucuauauauuuauuuugucaguauuuauaauuuauagauauaguucuuucuuguguuaaggaguaauuuaaauucuuugcaacuucucggaauagguuuauagagacccaagucauccagacauucuuacguagaguguguccuauucaguugugucugaaaauacauauuuauauuuaccauguaauaggauuuauuuauuuuucugcaauauacagaguuaauuacuggggugaauuuuugacaucgaauauguuuuauaagcuugaagaaugcuauaaagaaaauugugcugaauugaggacacaaugucuuuaauacaaggcuuuuuacucuuuggauuuuaauuaaauuuguugcuuaaguuaucugucuauaccagaaaaggagagaaugauuaaccuaaagccaaagaaaauucuaauucccaauuuauauuaccccuuaguucuucccaaagcauuuucuccacccccaacuuaaaaaaagaaaccuuuuagaaaccuauauauuaauaaaauaucucuaauauggauuaaaguugauaugauucguuuuuugcuuaauuugcuuucaguucauuuauucaauauauaucucugugcauaugauauccuggacucucuucuagacucuguauuacagcuagucagacaauuucuugccucuguggagcuuacauucuagcaacagacagauuauaagccaauaaauguauaagaacagguagcaauaagucaugaagaaaaaugaagcauggugaggaaacugggagacaaugaaguaugguguuuuuguuuuuauguacucagagggaagguuacucuucccuucaugauccaugcaaagaucuaggggaaagguguucuuucccacagggaauacauacagaggauaccuauucauauaauuuaauuuugaauaguacagaacagagaguugaagacagaaagucuuauucauugcuacaaaacccauguuucgauuaugguccuuuacugguauguagcauauacacagacaggcaagagcuguguucggaaaagccauuuaaaaaauuauuucuaauuuauuguuucacagcuacuuuaacauaaaugaauuuuauuguuuccccuaguuauaguggugacccaaauauuuaauuaaagaaagccucuguuucaacuuaauuucugaguuuuuuucccauuuuucuuuuugucuaugccauaaucauuuuucagaggaagcaacagauucugaaaacuuugaaaccaaaagguaccuaccuauauuuggcugguaggucuuuuaucuuguuaccaugccugaaugaaaaacuuggccaggugugguggcucaugccuauaauaccagcacuuugggaggccaaggaagggggaucacuugagcucaggaguuggagaccaaccuggccaauguggugagacccugucucuacaaaaaaaugaaaaaauuagcugggugugguggcacucaccuguggucccagcuacuugggaggcugaaguggaaggaucacuugagcccugcaggucaaggcugcacacuuaccuuuauaacuuuuaagagauugcaaggaaguuacaaaucguuaagcuauuccuauauaucauaugaccacuucuuggaauuaagcacucaguuuuaaaaugcucuuauuuucugucauacucauuucauuaagaauaguccagauauuccuuauuauaaacuaaacugugaaaauuucuuuuccuuucuuuuuuuuuuuauuaccuagaccuuuucuggcagcugagaauuuugaacuugguaaauugauaaacuaggaaacugauuuuauauaaccuaaauccucaaacuuuagagggagagaaacacaguucugggagcugugaaugugaugaggaaaaaaauugaugaggcagcugaggagagacccugaagucaagagagugcugcaaaggaaaggauaauuaauagguagggccuaugauuccuagcagacacaauauugguguguauauucagggcucaauaggauuuauaaccauaggauugauagccagcuuaaccuguuucuucccucuaaauuuucuggcacaaccucucgguaaaaauuguucaaaaauagauuuuauguuacagaaaucauucuuccaucaucuuuccuaaaagaguuauucuggccaggugugguggcucaugccuguaaucccagcacuuugggaggccgaggcggguggaucacaaggucaggagaucgagaccauccuggcuaacauggugaaacccugucucuacuaaaaaauacaaaaaauuagccaggugugguggcaggcgccuguagucccagcugcuugggaggcugaggcaggagaagggcgugaacucgggaggcggagcuugcagugagccgagauugcgccacugcacuccagccugggcgacagagugagacuccaucucaaaaaaaaaaaaaaaaaagaguuauucuguaaugccauuauuaaaacuuggaaaugagguuuuugagaaggaaauauugacuuuucuuuugaauuguagcuuuguauagauuucucuucggucuuuuugguagaaacucaaauuuccuuuucagaguucauguucuuaccauggcuuguauauaaauacuagguugacugucaauaugguuacaucacuauuugaccugccauaguagauugcugaauuuguccuuguguuaauacucauucacauaaaaaccauaauacaaggcagcauuuagauccugugaagauaaugaccagggcuuucccuguguauauauauaaauuguaucaacuuguuuucucuuacuaguuuuuuuuauuucaggcugaaagaauauucucagagguuagaaggauugagaauuauagaguugaaggcauggagaucuacucuacaacacuuuggcaucuucaaaaagauguugcucuuucaguucugucaaaagacuuaacagacauggauaaaaauucgccagagguauguuaaccaaaauacuuugcuuauauaguuaccuuuuugaucacccucaacagauagagaugaaccaagcaauucaaacacuauuuagugucacccacgcuuauuucuuuuuuuuccucucucucuagucagggacucagagaggaagagaaaguccuagaauguguggugcagauucacaaauagaaaaaucacaaagcagcuauuucauucaggauuuaucgagauuugacuacguuaaauuugcuguugucaccaagauuaggguucguugagcagaaguuacauagauugaaaaaauuaauaauuuuaaauuaaaauaaauuaguauugucauuguaagacauaggugcaauuaauguacaugcucuaaucuuguaagauuguauuucauugcaucucaaaaauauuuaaugauacuuuuguaacauaucuaagcuuagaauuaaacacagucaacucccauuauuugcgguaauucuguagucaacaugaacacugaauuagugcuacugaaccaauguuccugggagugauggagaguuugaaacagagauagauuguggauuauaaucuugaauccuaaaaauaacucauccugguagauccuauuuucuuuacaaaagagagaaugcugcugggugugguggcucacaccuauaaucccagcacuucgggaggcugaggcaggcggauuccuugagcucaggaguuccaagaccagccucggcaacauggcaaaacccuucuccacaaaaaauacaaaaauuagccagguaugguggcuggcaucuguggucccagcugcucgggaggcugagacaggaggaucacuugagccuagguggcggagguugcauugagccaagaucacaccacugcccuccagcccggacaacagaacaagaccagaucucaaaaaaaaaaaaagagagagaaugagguucagaggugacuugccugaagccauccuacuuaaaagugccagcagugggauucaaauucuguccaacuguccccagagccaaagcuucuugcacuacacuaaacuagcccacagaguuucugucccuggucaucucugcaugagagcuaaaacaagaagguagagucacauuauucaaccucaaaugagaacauaccuuuugaugacuaugaaagcacugcaaguauugauuuugguuuuacaaauaaauuuuagcaaucagacaaauucacaaauauggaaucugugaauaauuagaauugaguaucuacugaagcuccuccauuuuugucuuucuguucuaaguugaggcuugauuuuagucauagauuugguuuuagaaaaaguaaaauuuuaauucuguuugguuuuuguucccauuuuuuuaaggccuggugugcugcagggaacuguuucagucugcaacgggaacaugauauugcaauuaaauucuuccagagagcuauccaaguugauccaaauuacgcuuaugccuauacucuauuagggcaugaguuugucuuaacugaagaauuggacaaagcauuagcuuguuuucgaaaugcuaucagagucaauccuagacauuauaaugcaugguaagugguaaugaaguacaaagacaaagucguauugauggugcugguacuuacuaauuuuucuuguuagauagcucuuuauuaucaugaauuugguuacuuauacuuagggaugguacauacuggucaauaacuucuaacuaaaauguuuucuuaugaaauguacgucuuuaacaaacucuuaaauuaacuaaugauaauagaauaccagauccuuauacucaacaguuucagccuucuaccaaacuuuugcagauacuguaguuguuuuuuguuuguuuaguuuuguuacuuuguugcuuuuucuucgaacaccgaaauggugauugggaugaaaagugcuugggaaauuggaaaggaauagcauaauucacuuauuggauaauaggaaaaaaaauugaaaaaauuuacuaguugcugcuuuuugacaguguucugguuuauugaguuacuauuaagaacuuaguguacccuuuuauuuagcaguaucucuauuuuacuuuuuuguacuuguguauaaguagacacauaggaaauuacuaccuaggucauauuguuaucaacugaauaagauaugaaaaaguuugguccuauuucugccucaacaccauacuuacuguugacauuuauuguauuuuucuggacugacuuaauaguuuaaauaucaagauaagguauaauucugaagccauaacucugugguaguuuuuuugucagauacgguuaucuuugggguuauuauagcaguugaguuguaucauucuauuugcuucuaaaucugaagcauuauauuacuaaaacauuuuuugauuugugaauauguuguuaauggauuaugucucauuuugcaguaguaguuacauugccugaaagauggccaaaaaaauagugcuagcuuuugcugaccaauguaacaaucaacuugccaaugcugcugucucuuccgauagcuauguucucuguaauauuuuaagaacucaguuuuuuuuuuguuuguuuguuuguuuuuugaggcagagucucgcucugucacccagguuggagugcaguggcgccaucuuggcucacuguaugcuccgccucccagguucacgccauucuccugccucagccucccgaguagcugggacuacaggugccugccaccaugcccggcuaauuuuuuuuguauuuuuaguagagacgggauuucaccauguuagccaggauggucucaaucuccugaccucaugauccacccacuuuggccucccagugcugggauuacaggcaugagccaccauacccggccaggaacucaguucuuaauaagacuuguguuguuuuugauuuuuucccaagucugguugauccuuguguuguuuuuuuuuuaaauguguauugucuguucagcuauuuugcaggaguugcauucuuaaaaaacuuaaccauaucaaaaauuguguuuaaaggaggauuauucagauuggcaagcuuuuacuaggaggaguuuaaaugcugacguauuuagguaacuaaauacugagcaacuuuauucuaaguacaaaauagauagccuuucuuuuguuuucacuuucacuaucauuagcauaguguuuaauaccuuuucuucaucuauaacacaaguauaaugauauauaaagccacucaaauaaagcagauauguugugcuuuuuucuuauucauuugaugcuuauuccccaucaucaucaucaucaucaucaucaucaucaucaucaucaucuaguuauggccaugagaagucuccguaauauaaaccauccacacuauauucauuugacauuuugaaaauucaggagaaauaccugcauauuaaccuaauacacuauuacauagccuuuagaaauuguaauuuugaggucuauaaguauaggagcaugcuuuugauaacaguaagugggggacaaggaagccaaacaugacacuauguaugcuauaauuauaauaauauaaaacagaaaugugggaauagcauuguuaggaguucagccuuuagaaucauuaaggaagaaccugguuagaaucuuuauuagcuguauaacuuuaagcaaguuauuuaacuucucuaaguuucaguuuccuuauucgaaauaaggaugauaaugguaccuaugauuccucuagggauuaaaugagauaauuuagcaauggucuuggcacacauguaauaacuacucaguaaaaauuagcuguuaaaucuagaauaugacagguaugguggcucauaccuauaagcccagcacuuuaggaagcugaagcuggaagauuacuugagaccaggaguuugagaccagccuggucaacauagcaagaccccuucccuaacaaaaaaaaaaaaaaaaaaagaaaacaauuaaggccgggcacgguggcucacgccuguaaucccagcacuuugggaggcugagaugggcgaaucaugaggucaagagaucaagaccauccuggccaacauggugaaaccccgccucuacuaaaaauacaaaaauuagcuggguguggugaugcgugccuguagucccagcugcuugggagacugaggcaggaaaaccacuugaaccugggagguggagguugugccacugcacuccagcauggcaacagagugagacuccaucucaaaaacaaaacaaaacaaaacaaaacaaaaaaaaaacaauuaggcauggugguguaugccuguaguccuaacuacucaggaggcugaggugggaggauugcgugagccuaagaguucaagguuaccugcagugagcuaugaucacgccauugcacuccagcccgggcgacagagcaagacguugaauuaaaaaaaaaaaaaaaaucuauauggguuuaggggugugguuucuuuuuuccuuauuaucauaguuugauuugauuugauuugauuguuuuugcuuguaaaagugacucuuuaaaauguuuuaauggucugggcaugguggcucaugccuguaauccuagcguuugggaggccaaggugggaggauuguuugaggcuaagaguuugaaaccagcuuggucaacauagugagaccucgucuccacaaaaaauuaaaaauauguuaauauaagaaggcugggggugguagcucacaccugcaaucccggcacuuugguaggcugggacaagcagaucacuuaaggccaggaguucaagaccagccuggccaacauggggaaaccucgucucuacuaaaaauacaagaaaauuagcugggcguggugacacaugccuguaaucccagcuacuugggaggcugaggcacgaaaaucgcuugaacccaggaggcagagguugcagugagcugagauugcaccacugcacuccaaccugggugacaaaaagcaagacugucucaaaaaagaaaaaaaauauauguaggccaggugugguggcucaugccuguaaucccaccacuuugggaggccgaggccgaggcgggcggaucaccugagucgggaguucgagaccagccugaccaacauggagaaacccugucuuuacuaaaaauacaaaauuagcugggugugguggcgcaugccuguaaucccagcuacucggaaggcugaggcaggagaaacgcuugaaccugggaggcggagguuguggugagcugugaucaugccauugcacuacagccugggcaacaagagcgaaacuccgucucaaaaaaaaaacaaaaaaacagcuuggcaccaugacucacaccuguagucccagcacuuugggaggccaaggcgggcggaucaccugaggucaggaguucaagaccagccugaccaacauggagaaaccccgucucugcuaaaaauacaaaauuagccgggcgugauggugcaugccuguaauccccagcuacucgggaggcugaggcaggagaauugcuugaaccuguggguggagguuguggugagccgagauugcaccauugcacuccagccugggcaacaagagcaaaacucugucucaaaaaaauacauauauauuauauauauauauauauauauauauauauauguauauuuguguguguguguuuguguguguguguguguguguguauauguauguguguguguguguguguguguguguauauauauauauauauauauauauauauauauauauauaugcgccugggcaacauggcaaaaccccaucucuacaaaaaauacaaaaauuagccaugccugguggcgugcaccuguaguugcagcuacucaggaugcugaggugggaggauugaucacuugagccugggaggucaaggcugcagugagccgugauugagccacugcacuccagccuaggcaacagagugaggugcuaucuuuaaaauauaauaauaauaauaauaauaauaauaauaauaauaauaaacugcuuuaauggcuaggcauugugguucaugccuguagucucagcuacucuggaggcugaggcuggaggauucuuugaacccggaaguucaaggaugcagugagcuaugauuggcccacugcacuccagccugggugacagagugagacccuaauucaaaaaaaaauuuuuuuauuuaaaaauaaguaaauaaaaugcuuuaaugauuuuuaucauaacugguauuuuuugccucuccucuaagaccaccaguauuccacuggauuauuaaaaugccagauucuauacuuguucuuuuacuaauugaacuaaauuagcaaccuaaacuuuauauuuuuaaaauuauacuuuguuuuauacuuucagguaugguuuaggaaugauuuauuacaagcaagaaaaauucagccuugcagaaaugcauuuccaaaaagcgcuugauaucaacccucaaaguucaguuuuacuuugccacauuggaguaguaaguagcuuucuaaacauuaauacucuauuaaucucccuuuugaaauauguuuguuauugauuuaauugcugugauaaaaauugguccuuuuuuguguugaaacaguauucuggagccuauuacacccaaaaauacuacccauuuggcuuagcauaaaaaaucacagaauugcccuuaucccuugcacaagucacuucauugcucugagcuuuuauuuuaugaaugucauguacuacuugcuuaccucauaggguuguucugugacucaaguaagauaucuccuggccaguugcaguggcucaugccuguaaugccagcgcuuuaggaggccgaggcaggugaaucacuuaaggucaggaguuggagaccagccugggcaacauagcgagaccccaucucuacaaaaaaaauuuaaaaauuagccuggcaugguggugcacaccugugguccuggcuacuugggaggcugaagcacaaggaucacuugagcccaggagugcaaggcugcugugagcuaagaaggugauacugcacuccagccugggcaacagaaugagacuccaucucuuaaaagaaaauaaauaaauuuuacuuuaacaggagaaaagauauguacauuauguuuguuugcuuuuuaaaaucgcauuuauuagcuucuguguaaguacgguaccuuaaguucuuguucucauccucucaucccuuuccccuucucccuccccucagcuucucucuuuuuuucccccuagcaaguuuagcuuuugugggaauggucauacaaugugaggaaauuguuaguuugaaaugucacuaucuuggggagaguagaauucuaauucucuauugacuauaaugacauugaccaugauaauuuucuuaaaaauggacauaguccagcaccguaagacagggcaagaaaaaaaaguugacaguaacuucuuuuauaguuagcuacuacggaaaaaauggagagauaaugugucuacuuaaaauuauuuuuuguugucaucaccuuauuuauucaauucaaaauuaaaucucuugacaccuuuuggugaaguugaacacuuuuuuaaaaauaggaauucuucugaacuuauuguagaacagguuguuuuaaauuuuugagugguuuauuugaagaaauugucagguaagagaguaagcuuuucucuuuucgggaacuaguauuuagggucucaguccugugggcagaauauuuggccaccauuagaucauugcguagaugaguuuagcaagcagacguuggcacuaccuauucucacauucuuaugaccaugauauuuguuaaaguucugcagccacauucauacauucauucaccccacuuuuuuaauuuaauuuuuuuuuuuuuugagauggaguuucgcucuuguugcccaggcuggagugcaguggcacaaucucagcuuaccacaaccuccaccucccagguucaagugauucuccugccucagccuccugaguagcugggauuacaggugcccgacaccacgccuggcuaauuuuuuguauuuuuaguagagacggggguuucaucauguuggccaggcuggucucgaacucuugaccucaggugauccacccacguuggccucccaaagugcugggauuacaggcgugagccaccgggcccagcccaccccacuuuauaacauauaauuuguccaaggaggagcauagcagaauauuaguauacacauaugaaugaauagugagguuugguacuuuuuaaaucuuuuaaauuuuaaguuauuuaaaauaucuuaaguuauuugcuucccaguauuagagaucagugauuuucaauuauguaaaacaguaaaaucauuuuucuuuuuuuucucuuuuuuuauuuuuauuuuuauuuuuugagacggagucucgcucugucgcccaggcuggagugcaguggcgcgaucuuggcucacugcaaccucugccuccagguucaagcaauucuccugccucagccucccaaguagcucggacuacaggcgugugacaccacgcccggcuaauuuuuuguauuuuuaguagagaugggguuucaccguguuagccaggauggucucgaucuccugaccucgugauccaccugccuuggccucccaacgugcucagauuacaggccugagucaccgcaccuggccaguaaaaucauuuuucaaauaaauuccuaaaauauugaaaauauaauuguucugagugaaacaagguuuguaaacaggaguguuaacacaguuuugagaagucuaauauuugaaagaccgcauaaaccugaugaaaugugaauauuaucuggcuaaauaguacagaucuuuuuuaugaauagaacaccaagguuuugcuugccuuuuagacuuaaagguaaccaaauaucugcucuaaagauagacuauugauuaucaucauagguauguaccagaggaccuagauuuuuaucacagagcaaauuauuuaagaucucuagacuucaguauucucaucuuuagugaagcaguugaacuagaauuagaagugauuuuagagauaaucuauuaaucauuugguaauuaauuacuaaauccacuuaaugcaguggacaauccaguuagacccuacaaccuuaucucuaauaauuugauuauguugguuuugagucacguugguucucaccuuucuucauaaauaucaagagggaguauuaacaugaucuuuauuucuuacagguucaacaugcacugaaaaaaucagagaaggcuuuggauacccuaaacaaagccauugucauugaucccaagaacccucuaugcaaauuucacagagccucaguuuuauuugcaaaugaaaaauauaagguaagauaaauaucuuaagggucuucaguguuguauugcuuaaaaacaacguuaucccuuguuuucaauaaacugaaaguuauuuauuuaauuuugaucugagacauuuuuccaagcuguuaauuucauuuuuugugauuuuuaugucuucaugaaauacucauaggaaggauagguguguggauauuuaggaauauauaguuaucccuuguaaagaugucuuauauagaaaggcaguuuuuucaucagguaguuaucuuaaaguuaucuuaaaccauccucuuaggaccaaaauaagugaacagaugaaaaugaauguaugggccaggcgcaguggcuuacgccuguaaucccagcacuuugggagaccaaggcgggcggaucaccugagucaggaguucaagaccagccgggccacauggugaaaccccaucucuacuaaaaauacaaaaaauuagcugggcaugguggcaggugccuguaagucucagcuacuggggaggcugaggcaggagaaucacuugaacccaggaggcagagguuucagugagccaagaucacaccacugcucuccagccugggcgacagagcgagacuucaucucaaaaaaaaaaaaaaaaauuaaaaauuaaaaaacagaaaaagaaaacgaaugugugugcauuauucagcuuuuauugauuacccaguaugugucaggcaccaggaauauaguggcaaguaaagcaaucaucuuuccugcuuuugaggggccuacuaucuaguacucucuaggaaaacagacauuaaccaaauaaucacaaaauauaauaaauguuuaauacauaaagggaaaguguauuaaguuaugagagcuuauaacacggagacuaguucuagucugaugugucuuucucuuuacuucucacucuuuuucaaauuauguaugcuuagccugaaacaaguauugaaaaaagaagauaaggaaacugagaaagagauaagaggcaaaaagacacgagauuuuuguuaucauuuauucaaucagaaaccaugaagcaaaaucuuuuaaaauaaauucagggcugggcgcaguggcucacaccuguaaucccagcucuucgggaggccaaggugggcaaaucacuugaggucagaaguucgagaccagccuggccaacagggugaaaccccaucucuaccaaaaauacaaaaauuagccaggcaugguggugugcaccuguagacccagcuacuugggaggcugaggcacgagaaucacuugaacccaggaggcagagguugcagugagccaagauuacgccacugcauuccagccugggcaacagcaacacucugucucacaaaagaaaaauagaaagaaauauaccaaaccagugauaacuuuuuuuuaauacuaauaaaaaucccuauaaucccgucacuuuggaggaagaggcaggcagaucacaugaguccacggaacuugagaccagccugggcaacauggcaaaaccccaucucuaccaaaaaaaauacaaaaauuagccagguguggugacgugugccuguacucucagcuacucaggaagcugaaaugagaggauggcuugagcucaggaggcggagguugcagugagcuguuuucgcgccacugcacuucagccugggccacaaagcuagacccugucuuaaaaaacaaaaaaaaaauagggccaggcacaguggcucacguauguaaucccagcccuuugggaggcuggggcgggcagaucacgaggucaggaguuugaggccagcccggccaacuuggugaaaccccgucucuacuaaaaauacaaaaauuagccgggcaugguggugggcaccuguaaucccagcuaccugggaggcugaggcaggagaaucgcuugaaacuggaaggcagagguugcagugaguugagaucacaccacugcgcuccagccugggcaacaagagugaaacuccaucucaaaaaaaaacguaaaaauaggcuaauaaagauauacaaagggauuaaauauauaauuuaucuaguaauuccuuuaguuuuauucuaucuucuuuaugaagacacggguuucuauuuuuacugguuuuguccuuuuaaaaagcuugucuuucuuuaguuuuuguuuuucuugcucuguugcccaagcuggagugcaguggugcaaucauagcucacugaagccucaaauuccuaggcugaauuccuuguacccaggacuacaggcauaagccaccaugcucagcuaauuuuuuuaucuaacuggagucuuuaaaaaccuucuuuuagggccaggugccguggcccaugcuuguaaucccagcacuuugacaggccaaggcagccagaucacuugaggccaggaguucaagaccagccuggccaacauggugaaacccugucucuacugaaaauacaaaaauuagcugggccugguggugcacuccuguaaucccagcuacucaaguggcugaggcaugagaaucgcuugaacccaugaggcggagguugcugugagcccagaucacaccucugcauuccagcuugggcaacagagggagacucugucucaaaaaaaaauuuuuuucauaaagcuuauuuuaaaucuaauaagcccguuucaacuuuuaacuacucuuugaaguacuauaauugcaaaucaguauuuguuuuuauguauuugcuuuauguaccucuuuagauaugaaggacuuuauucauuauucuuaaagccauuuuaauaccaacauaccuaccagauaggccacauaaaucagcguuuacuugcuucaagaaacccaaguucuaaucucaucaguugucuggacuaugauauauauagugauagccauuuuugugggguuuucuuugauuguuuaauuaggcagccuuccaauccaaaguaggaccagagagacucccucuuuuguuguuauuaucauuaucauuauuauaucaggcagcccccugagccacaguagacucagaaaaacucccaguuauagccauuuuuggguaugagcuuggggcuucgcugaauuaugaggccuaauuugcugcauggauuagauauagaaaugugacuguaugaaaagggcauaaggaaaaguuaaaagguacauguucucaggaucuccuggggcugugucauucccuggucacuugaaaaaaagaaagaaaaguuaaugauugcuucugagauuuucuggcuccaaaaugaaaaucaagggggccauuucaacaucucuaaaacauugcuagccaucaccuuauuuaaugugcuguacugauauuuaauuauuuaaaucuuaagucuuuaagguaaaaguaagagcucugaugcuaugugagacacuauuucucaaugaguccuuguaauuagaucgcuggggguggggauaggcaugcugguugcaugaaauguugauaacaauuauaauaugcaaucauagaaagaaaacauaucaauucugaauuguguguguuguagcagugaaggaggauuggagugugucaucuuagagauuaagauuucuuuaaaggccaggcgcagcagcucacgccuguaaucccagcacuuugggaggcugaggcggguggaucacgaggucaggaguucaagaccagccuggccaacauggugaaaccccaucucuacuaaaaauacaaaaauuagccaggcaugguggcgggcgccuguaaucacagcuacuugggaggcugaagcaggagaaucgcuucaaccugggaggugggaguugcagugagccacugcauuucaggcuggacgacagagcaaaacuccaucucagggaaaaaaaaaaagauuucuuuaaaggcuaggcaugauggcucacgccuguaaucccagcacuuugggaggccaaggugagaggaucacuugaggucagaaguucgagaccagcuggccaauauggugaaaccgcgugucuacuaaaaauacaaaaauuagccaggcaugguggcacacgccuguaauuccagcugcucaggaggcugaggcaggagaaucacuugacacugggagggagagguuguagcgagccaagaucacgacaccacacuccagccugggugauagagugaaacgccaucucaaaaaaaaaaaaaaaaaaaaaaaaaaaaagauuucuuuaaaguaaggccgggugcaguggcucacaacuguaauccuagcacuuugggaggccaaggcagguggaucaccugaggucaggaguucaagaccagccugggcaacuuuagugaaaccccaucucuacuaaaaauacaaaacaaaauuaggcauuacagguaagccccuguaaucccagcuacucgagaggcugaggcaggagaaucacuugaacccaggaggcagagguugcagugagcagagaucgcaccacugcacuccagccugggugacagaaugagaguccaucucaaaaaagaaaaaaagaugucuuuaaaguaauaauucucagaguggucugggaauuucugggggucccuaaaauccuuccaaggaguccuagaggucaaagcuauuuuuacaauaauaucuugacguuauuuaccuuuuucacucucauucuguccaaauggacaguagaauuuuccaaaagcuacauaauaugugauauugaaacagauuaaauggagaagcagauagaugugagaaucuagcugucuucuacuaacagagacuugcaaaaauguuaaugccacucuucucaauaacuuuuuguuguucugaaaaauuauauaguuauuuuucguuaaaaaauaaaucacugggccgggcaugguggcucacgccuguaaucccagcacuuugguaggcugaggcgggcagauuacuugaggucaggaguucaagaccagccuggcugacauggugaaaccccgucucuacuaaaaauacaaaaauuagcugggugugguggcgcaugccuguaaucccaguuacgcgggaggcugaggcaggagaauugcuugaaucugagaagcggagauugcagagagcagagauggcgccacugcacuccagccugggcgacagagcgagacuccaccucaauaaauaaaaaugaauagauagauagauagauagauagauagaugaccaaaagcaaggauuguuaccaccugcauauuucacgaagagggguguguguguguguguguguguguguguguguuuucaguguacuagagugccugccauuucuuaguaccuauugucauauaaguaugcauuuuauuuucacagcaauaagaacuaauacaauaaggaaguauauugauuaagauuuaguuagcuuuugugaagaugauuugggaaaucaaauaaguaaaaacgcuuggucaaaacuuuaaaaauuuuugcuacuuuaagguuuuucuuugccuuuuucagucugcuuuacaagaacuugaagaauugaaacaaauuguucccaaagaaucccucguuuacuucuuaauaggaaagguaaagacuggggucauggucccaaacagugacuuucauagcaaauaaugacauuuuauaagaauaaauguaauacuuccuguacauaucuauugagcaaauuaaacuaaagcuccgaacugagugcucugggaauaacagauuuaguucuaacacuuaagaaaaugauauccuagccaggcauggugccucacgccuguaaucccagcacuuugggaggccuaggcagguagauuacgugaggucaggaguuuaagaccagccugaccaacauggugaaaccugaccucuacuaaaaauacaaaaaauuagcugggcauggugacacaugccuguaaucccagcuacuccagaggcugaggcacgagaaucacuugaaccugggaggcagagguugccaugagccaagaucaccccacugcacuccagccugggcaagagaacaagauucugucucagaaagaaaaaaaaaaaaaaaaaaaaguagaaaaaaaaguagaagaacaugaauggcacuguguugucuugauuaagagaaauggcuucugagagucccaaggccagacuagucaguuuuuuacagacuagaccuccauaugccaauuaguuaaggugacuguggacaguuguaaagaguugauauaacucaauuuaaaaucacuguaaaugaaaguuaauuaagcaguuuauaauccauuuaaucccauuaucauugcuccagucagagugauauuuauuggaaacuuacuaccugaaagauagaagcaaggaauucugaaaauaaugucugauuauauuaaaaggaacucaaaagcugguaugaguucaucuguaggaagaaaauguccuacccuuagaaugaguuuagagcacauaaaucaggagccuaauuuaaauuauaaauauuuagaauuguagaggcugggcgcgguggcucacaccuguaaucccagcacuuugggaggcagguggaucaucugagucaggaguuugagaguagccuagcuaacauggcaaaacccugucucuacuaaaaauacaaaaauuagccaggggugguggugggcaccuguaguccgagcuacucaggagacugaagcaggagaaucgcuugaaccugggagguggagguugcagugagccaagaucgugccauugcacucuagccuggguaauagagugagacuccaucucaaaaauaaauaaauaaguauauauauaguuagaauuuuauaguugaagcucacaacuuaaugaaaaauguagugcugcuguuuauuuuuagguuuacaagaaguuaggucaaacgcaccucgcccugaugaauuucucuugggcuauggauuuagauccuaaaggagccaauaaccagauuaaagaggcaauugauaagcguuaucuuccagaugaugaggagccaauaacccaagaagaacagaucaguaaguaucauacauaugauuuugaguauuuagaaaguuaccuuuugcauaaggauuuguaggcuacucuuuuauuuuauuuuucuaaccaugguguuuucauuauaccaaauggacuuuuagggaaauugaacagggugauguaauaacaaaaugcauauaaagucagauaaugagucucuguucuggaucuaguuugcugugugacuuugacaaauucauugcuaaguuuuaccuggaccucaauuuauguuugaauauguaaccaguacuguuuuaucugcuucauaaaaauguaguuuuuuaaauaacagaauggagaaauuucugacaagauaaauucugauuagaugccuuuguuccagaaaacuuggugaaaggcuuuaauuaaaauuauaagccauggggccagucgcaguggcucaggccuguaauuccaacacuuugggagguggagguggguggaucaccugaggucaggagaugacaccagcugaccaacauggugaaaccucgucucuacuaaaaauacaaaaauuagcugggcgugguugcgggcgccuguaauccuagcuacucgggaggcugagacaggagaauugcuugaacccaggaggcugaaguugcagugagccgaaaucacgccauugcacuccaaccuggaugacaagaaugaaacucugucucaaaaaaaaaaaaaaaguauauauaugccaggcaugauggcuugcguauguaaucgcagcuacucaggaggcugaggugggaggauugcuugagccuaggauuucacgacuagccagugagacccugucucuaaacaaauuuuuaaaaguagcuggcuguggugguacgugucuauagucccagcuacuugggaggcugaggcaggagaaucauaccacuugagcccaggaguuugaggcugcagugagcuaugauugugccacugcacuccagccuaggugacagagcaagauagaugauugauugauugauugacugauagacugaccccauaaaccuuuugaaacugaagguuauagucuguguuucuguggacuagcagggaguauucuuaaaguggagucagugauuggagguugggggaaaugucaauuuuuuuuuuuuaaugucucagagaacuagcuaguuguaauuccuagggcaggaauaaggaacucauuaggaagaggcaguuuugguaguuaaaacuuaaagguaaaaugcaguaagcuaauaucagaccuauuauaaaguuaggaaacuugaguugcauuuuauuaaaggauaugaggauuuuuaagggccuuuauuuaggguuuuaucucucugaauauaauacaauuuuucuuacuuguuuucaugaaccaacaggacauauuugucagaaaacuuacuguggacuucuguuuuauuuuuaaagugggaacagaugaaucccaggagagcagcaugacagaugcggaugacacacaacuucaugcagcugaaagugaugaauuuuaacuucuggaaaucagacuuuuacaacuggaugugugacuagugcugacguguuucuugucccucuguauacugagucuuuacucuugagcuggcggugucaucguccgucacuuauaccaugagugugccacuuucauuggacccugacuguauacagaaugaaaggcagugcaauauuuagcugcuaacaagacuggcucuuuuaccaguaugaaugacaauuuaugggggguaggguggggaacuuucuuuucuguuuuucuuuaaucucccuuuguuggaaaguaucaugaaaggaagaguuaugcuuuaucuugaaggaaccauuagauauggaaaauagugaugaaccagaguuucuugguugcuuuuucaaaaauuuguuuuuauuugguucuguuccugauaaacagaguaacugaccuucauuucuagguucuucaagaaugguguuugcaagugccagauggaacaauaaaagacguugccuauaacagugacuugauugccaaggaauguaaauuaccuuaaacuugcaguaucucccauaaacaaauguaaugggcauauugggacucguauguaggaaucaaauaucccuccauacaguguacucuuauucuuggcaagaaugcuuuaaugucuaaccaagaauuuuaauuuauucaucuugcuucaaaguguugaucauuguugucuugguauugcaaacuuuaaaauuguuucuuaccauauugccucuucucuuugagcucugugggaucaccuuuaacauucagagaugauagagugguuccccacugagaagccaaaacaaggcccuuaauaaccccuuaaguucaccauaugaaucagaaggagaacacuaaaguggagagacuuuuaagagaucaugauagugaaagccuuaauauaaucagaauuguaccauaaccuugaaucuauauuuguucaaaacaucccuuugacuuuucuaaguguuugcuuaagcagaguguaagaaugugugguuaccuuugguugagauccuuuccauucuuuuugacucucugcuucagauuuuuucaguagugugagucaccaaaacauuuacuaagaguaauuggguuuaggauguuggaaauuuuuagcuugggggaaaaaacauucuuaugaaggagauagguucucuucugaguuugucauaauauagauuggugucuuuggaaaauggccacaauuuuaagaauucaauuaugcauauaaaaugauaauuauuggaauuccacaguaacagauuuaaacagucuuaaauuguuuaucuccuuuacuguaauguauugaaauuuuuagagaaauuuuaguuguuaacauuuuauuaagugccagugucagaauauaacaaauuauaguuucuuaugaaugacaggccuacaguuauuauucuggauuauuugauggaggacaaacuuaccuguauuuguuagucaagcugugaaaauaagguggauuacaaaagaugugaaaaaaauuuuagucuguagacucaguaauuuucuauaauuuacuguuaaucucauuugaacauggauuagguacaauuuauaaauuaauucaagucagggucuuuagguaucaggugccagagagauauuuaacagauuucccuaccuaaauuuauguauauguacugucuaaaacaauacuuuuuuaaaaaaaaggaacaguugggagaaaauaaauauaaugaaaaauucccagaggcuagcacuuggauucuaacacguaugcuauuguauuauccauuaguucuguaauauuuaauuuuagauucuuuuauuuuuuuaauuggcaaagcacaaggugcuguauaacagugucauuuagaguuuuauagaaagcuucaaccugaguucugcguuauaaagccuggagaaagcuaagcuuagaacauaacuugcugaaguauaauuaucuuuuuguagcaggaauuuaugugccagaggugagagucuuucugguacugauuuuuugagaccaaggauaaaaggaucguuuuguaagacaugccauggcaauggcugguugggggacaguuuccgcccaagcuuggccuauuuuauuuuuccucauaccuacuuucaaagucauuuagguauuugaagccuuauuucccacguaguaacacuuucuggcuuuugcaguuucuuuuuuuguuugguuuuguuuuuugcauggaauggggaucaaacaacccgaagaagaacacauuuugaucaagcaaaauguuugcuucaaauuucagaaguuuauuuuacagaaauuaaauuaaguaguuugacauccuuuucucuguuucacacauauauuagguuggugcauaaguaauugugguuuuugccaugacuuuuauggcaaaaccugcaauuacuuuugcaccaacuuaauacaucuauauacauauauauauacgcgcacacacuuguucagaaguuauguuguggccuuggauuuguuuuuccccuuggaaaugguucuuaacucugggauuuuagaagguuagaauauuuuuucaagagaacagugguacucaaaagaaugaaagguggucccuacauuuucuguauucaucacuuaaaauuuuuaauuuuuccgagaacuacaaguaacauuugaaccaugcugcuguuguaccuuaaacaaaaacucagugauaaccaguauuuagucuauuaaaaaugcucuuuuugaagaaaaaaguuuggaagucucugauuagccagaguauaguaugagucuucacugagaaauauggugacccauuuucuuugugaaaaccugggaaaaugcaaguguggguaugaaguguguguucuguuugcauugaaacaauguaauuuugugucuucuuuuugcuuuaacugacuuauuucagaaauuguacaguguugagggggaaagucuuuucuguuaauauauuugcaauucauuaaaggauauggaaaauccaa

SEQ ID NO: 192314 - RNA, 39139 nt, Homo sapiens
cggcgcggcggcggcugcuagggccugccgcagccgcggccacucggaaagggcgggacuuccccgcagggcgggguggggcggagcgcucuaucaguccucccggucgccccacugcgcauggcacguugcguacuccccucccagcaaccggucuggcggcggcgcggcaguaaaacugaggaggcggagccaagacggucggggcugcuugcuaacuccaggaacagguaccugccuggcggggugccugguacgcugccggggccagucccuccuggcucugccaccgauuccaucuccccaggcccgggccuucgucggagcggccauccugggcucaccucacccuccacgggcccccuuuuuaacccgcguccucgacucccgcaaugaggcgccgcagcccgagagcagaauaggcuugggccuggcggggagacgcugaagcggaguugccgggcgagagaggcgggcuccugcuuuccccuuccuccccacccccuaggacuuccagguggggaaccuagggcugggugccgguuuguccuguucaggcagaguggcggccgaccccgguccugggcuccccgcuguccccagccgccgcgcacuuugggcugacaggcagcgggucaaguccucguaaggacacaagauccagaugacucccagaaucggccuaaacgaagagcucauugucuuuuuguuuuccagaaauguuuuuugggugccugcaggggauuugggcgccggagauggggguuggggauaaggaagagagcucgagggaggggcaguggguagguaaaauuguucauaguucucaggaaauagggaacuaaccucucugcccagccuucuccuguauccuaacauacuuuaacuugacuuucccggagaaagagccguuggaauuugcccuuuucuuauuguaauaucuguucaaguagaagcauguuccaauacguauaugcgacguuaagacaauucuucauugacacucauaccuuccugaagacacccaggacuguuucuugucccugagaguuaaggaagaaaccaaauuugaucaccugccaaaagccugugaauucagccuuuaguuacagugcugaacuggucaaaucuguccccuacuuuuuaaucagauuucuuagagguguuuuggcuggaaugcaguguuuauaguuguggccccagaaauggaggaaguuuacucugguuuuuagagcgcaggcuuuggaacagauuuaauuaguccccuaccacuuaucugugugacuuugggcauuuaaccucccugcacaccugaauuuccugauccguaaaacagagaugauaauacuugugagcugcucaugaagcauuuagcacagugccugacacguaggaaguuugccauaaauguuugcuggguuuauuauuuucucucuuuauuuuuauuuuaauuuuuuugagauggaguuucgcccucgucccccaggcuggaaugcaauggcgcgaucuccgcucacugcaaccucggccuccuugguacaagcaguuauccugccucagccuuccgaguagcuggcauuacaggcaccccccaccacaccugguuaauuuuuguauuuucaguagagacgggguuucaccauguuggucaggccgaucucugagguccugaccucaggugauccaccagccucgaccucccaaagugcugggauuacaggcgugagccaccgcgcccggccaauaaagcuauuucuaugucuguccacuaguaauauugcuuuguuguguguguguguguguguguguguguguguguguguauauauauauauguauguguauauauauauguauguauguauauauauauauauauauauaguguuaaauguuucugauaggcuggguaccguggcccaccucuguaaucccagcacuuugagagacugaggcaguaggauugcuugagcuccggaguuugaaaccaggaacagguaccugccuggcggggugccuggugcacugccggagccagucacuccucgcucugccaccgauuccaucuccccaggcccgggccuucgucggagcagccgucccgggccauauaauuauguacauuauauguauauacauauaauuauguacauuauauguauauacauauaauuauguacauuauauguauauauguacauauauacauaaauauauaauguaucaauauguauacauaauauauacacauaaaauuauauauguauacauauuaauacacuauguacauauauaauauauacauauaugcauaauauauaauauacacauacauauguauuucuuaauuuuugauaaguguggauauaucuuucgaaugauauccaucugcccuccccuuccauuagaauuuacauuuuaaggacauuuacauuugcauuuuaaggaaauuugaagggagcagagugaugauguuaaugucauacagauaaccgggcaugguguaauccuagcacuuugggaggcugaugcaggaggauugcuugaguucaggaguuugagaccagccugggcaaguucaucuguacaugauucaaucugaaaauagaaaaguccuucauaauuuguauaccauuuacugcuaaucacuagguagagcuacucuaaaccagcucagaugaaauuuauuaguaagauuuuaucaaagaaaauaccugugugcaguuauuaaaauaauuguauagggggcuauaaagaaaaauaccagucucaucucuaucucucuccaucccugugucuauuucccuuuuuuuuuuuuuuuuuuuuuuuugagauggagucucgcucuguugcccaggcuggagugcaguggcacggucuugcuucgccucccagguucacgccauucuccugccucagccucccaaguagcugggacuacaggcgcccgccaccauacccggcuaauuuuuuuuguaauuuuaguagagaugagguuucaucauguuagccaggauggucucgaucuccugaccucgugaucugcccgccucugccucccaaagugcugggauuacaggcgugagccaccgcacccggccuguuccccauuauuauuauuauuauuauuauuauuuugagauggagugucacucugcagcccaagcuggagugcaguagcacaaucacagcucacugcaaccuccugccucagucucccgaguagcugagacuacaggugcaugccaucacacccugcuaauuuuuuguauuuuaggagagaugggguuucaccauauugccuggggcaguguggaacugcggagcucaggagaucugccugccuuggccucccaaagugcuggaauuacaggcagagccacugggccuggccucaauuaauuuaaucauuuuuuguuuuaguccuuuaaugauggacuucuguaauucuaaacaacauguuuagacuuuccacugacaggagagacagagaaaugacuagugaagcuucuccuuauuuuuccaagagaguaaaggucaugcugaaucucacaccacccccuccucacugccucccaacuuuuucuuuuuuucauuuucuuuuucuuuucucuuuuuuuuuuuuuuuuugagucggagucucgcucugucgcccaggcuggagugcagugguguacucucggcucacuacaaccuccgccucccgguuucaagcaauucuccuaccucagccucccaaguagcugggaguacaggugcccgccaccaugcccggcuaauuuuuguauuuuuaguagagacggcguuucacuauauuggccaggcuggucucgaacuccugaccuugugaucugcccgccucggccucccaaggugcugggauuauaagcgugagccaccgugcccagccccuucuuuucuuuuuucuuuucguuucuuuucguuuauuuucguuuuucuuuucucuucucuuuucuuuucuuuucgacggggucccucuguguugcccaagcuggagugcaguggcucaaucucagcucacugcagccuccaccucuggagcucaagugauccucccgucucagccuccugaguagcugggaccacaggcacaugccaccacaccuggccaguuuuuuuauuuuuuauagaguugggguuucaaacuccugggcucaagugauccacccaccucuguuucccaaagugcugggaacacaggcaugagccacuguacccaaccagcaccuccaaacuuuugauaguugaaucccucuauuuuuacacuuguugguuaccuuuguaaccuuaaauauuguacauaacuuucuauuuguuauccuaucaacuuucaguauuaacuuuaccuucuuaggaagauagggguauuagcuuccccagucauuccucuaucucuucccuguuccauuucccaucuucugucaggugaaacuuuacuuucauauuaucaaauuugaaggcauuuacauuguguucuauaacuguaauuaaguuuaucaugcuuugucuauagacuuaaaauuuauaagcugaugaugagcacuuaacaguauuguaaguauuauucacaaaacagccaaguguuauucugcacugcgguccacuguccuaacuuccuucucauucaaggucaaguggauuuucuuucucauuccuugcugaacuaucucaauuuuuuuuuuuuuuuuuuuuuuuuuuuuugagauagaguguugcucugucacccaggcuggagugcaguggcaugaucuugacucacugcaaccuccgccucccagguucaagcgauucuccugccucagccuccccaguagcugggacuacaagcaugugccaccaugcccagcuacuuuuuguauuuuuaguagagacaggguuucaccauguugacuagacuggucuugaacuccugaccucaggugaucugcccuccucagccucccaaagugcugggauuauaggcguggaccacugugcccagccaugcuaucuaaaaauuguaacacauuuaaguuuguuucaaauucggacuuugacuuuuaaaauauaguuuuaauuucuguuggaauuuuugguugccuuucugcuugauuuuuuuuugguggggggggcguggggggaagaaauaggccacuuuccacccuguccgugauauuuuucauccuuuauaaucuguauauuucaugauauuauuauauuuucuucaaccugccaacuucauguucuaguuuugacugauuccuuucuugaucagcuucguagcuaucaucuugagauaucucuucaguggacacaccacuuuauuauuauuuuuuuuuucuuggggcagagccucacucugucacccaggcuggagugcaauggcgugaucuuggcucacugcaaccucugccucccaaguucaagcaauucuccugccuuagccucccgaguagcuggcauuacaggcaccugccaacaugccuggcuaauuauuguauuuuuaguagagacaguguuuugcaauguugggcaggcuggucucaaacuccugaccucagaugauccacccgcuucagccucccaaagcucugggauuacaggagugagccaccgcgcccggcuggacacaccacuuuuuauaucucauagcuuccuuuuuaaauuuuagccucauuuuacuggaauauuauuuggaguacauuaaaauaauuucauuaaaaaccguguauggggcugggugcaguggcucaugccuguaaucccagcacuuugggaggcugaggcggguggaucaccuaagguguuugagaccagccuggccaacaugguuaagccccgucucuacuaaaaauacaaaaaucagccgggcguaguggcacaugccaguaaucccagcuacuccggaggcugaggcaggagaaucccuugaacccaagaggcagagguugcagugcgccaagaucgcaccauugcacuccagccuggccugggcgacagagccagacuccgucucaaaaaaaaaagaggaauagaaaagcugcugacugggagcucuguggauuuaagacucauggacaugagugggcaguuacgccaggggcuuguuuucagccccacuucuccuucccucauuccuuauugcgcaguuuuguuucagaaccccuuaggauugucugcugggcauaucugccgucuccucuacuauacucuccauucacauucuagccugcagcuuucucuccauuuccugagacagcacccuuauguccacuuuucaacuccuagaaauuuauugaaauuucaucuaauagcuccucucauucuguccucagauauaugguuauuauuuguauuccuuugccuuaauugggaccuugggagagaggugagauucuaaaaucuuaaaucagaaaccugaaaucuaaucuuucuaauucucugaaaaaguuaauuuuaaggucucuccuagaaacauaagccauuauuauaagcaucacuaucagagggagaaagauauuugucucaggugucagacggaugucauuaaccucauuuuagaguuauuaacguugagauucggcaagccaaaguaugcugaucaaguuaacacagaugcaagaacgcaauucauaccaugcucgucuuauuucagaguaugugcuuuuuuuacuacgccauauugucacccuuaaguauaaaucucugacuucagguuacucuuaaugagccuuuagccauguuuuaaccuuauugauuauucuuacgauuuguauaguaacauuaugggugaaauuagcucacucuuuuuuuugagacagagucucgcucugucacccaagcuggcgugugcaauggcacgaucucggcccacugcaaccucucccuccuggguucaaacgauucuccugucucagcuucacaaauagcugagcuuacaggugcccgccaccaugccuaauuuuuauauuuuuuauuagagacgggguuucucccuguuggucaggcuggucuugaacuccugaccucaggugauccaccugccuuggccucccaaaauguugggauuacaggugugagccaccgugcccagccaaauuugcucuuuucuagauguuaaccuuuccuaauagcuucuauuuuucuaaauuaaucuuuacuaucuuugaaacauuuccaaguucuuugugugucuuuaccauuuucuuacauaggacugaaauacacaugugguaaaugcuguuagggaaagauuaauuuggucaagguugaaguuaguuuggcaaaaauucagaaaaagcaaaaguaucccugauucuuuuuucuuuuuuuuugagacagggucucacucugucauccaggcuggagugcaguggcgcaaucucggcucacugcaaccucugccucccgaguucaagcgauucucagccucccaaguagcugcaauuacaggccagugccaccaugcccggcuaauuuuuguauuuuuuauagagaugggguuuucaccauguuggccaggcuggccucuaaccccugaccucuagugauccgccugccucagccuugcuaagugcugggauuacagguaugagccaccgugcccaaccuaucccugauucuuaauccagaaugacauuuccucugccucuucucauuuagugaacacaguaauaaaagcauuuuuagaacauucuuauugaaaacagugacaaguuucuuagagcuuuugauauaaaauaaaggcuauucaaguacaguucaguaaaaauaauuuuauuggaggcaaauagaguaagaccuaggccuguagccauccauuggccagccuuaauccaggaauagauuuagaacauuuaaaauaauuuccuucagguaucccuguauuggagguucccaagaacacccucagguucaguaauucacuaggaggacucacagcacucagcauauagucacauucauggcuaggauuuauuucaacagaagaauacaaagaaaaaccagcaaagggaaacagcacauggggugaagucugggggaaaccaggagcaaacuuccaaggauccuccccaguagagugacacaggacucaaagcaagaaguugugguagcaugugugaaauguuaucaaccaggaaagcucauuagaaacuccauacccaggauggucauguaggcagccugugccuggcauguaucaaaacuggacucccagaaggaaagcagguguucagcauaaaccauacuguuuguacaaauaguuuaggcauaauaagccacucuugucauuuuuaggaaaaugggaaaucucucaaaauccaaguuccccaaugccagccaguggcuaaccacguaagcagacuuuuuaaaggauaagaaguuaggccugcuauauuaacccuucuucugcagaaucccagucuguaaauacuauuucuuuaaauuggucuuuugagagauaugggaaugggaguggguugaagauuguauucuuugagccaguuccacuugagaugaaaaauaagauaaacaagaauagaaaagcaaagauaaaaggaagaagaaaaagcaagagaacugaauacaauuuuuaaaaggaaauaaaaaaaaaagauuguauucugacaaauaccaggauuacugcuguuuuauugucaguuauauaugacccauaugucuuaaacauuuaguagugaacauugaggagucugauaaagauucauaccugaacagaaggguauccuaucucuuugcaaaagugugucuagcuugugcccauuggcaggcccaaaaucuucuuaggaaaugguuuuuaguuggaaggccgaggugggcggaucaccugaggucaggaguuuaagauuagccuggccaacaugguaaaacccugucucuacuaaaaauacaaaaaaacuagcugggugugguggcgggugccuguaaucccagcuacuugggaggccgaggcaggagaaucgcaugaaccugggagguggagguugcagugagccgagaccacaccauugcauugcagccugggcaacagcacgagacucuguccuuccccaaaaagaaaaugguuuuuaggcugggugugguggcucauacuguuagucucaccacuuugggaggccaagguaggagaaucacuugagcccaggaguucaagaccagccuggacaacauagucuguuaccuaggcuggagugcaguggugcgaucguggcucacuucaaccucugccuccuagguucaagguauccucccaccucacccucccaaguaguugggacuacaggcacaugccaccaugccuggcuaauuuuuauauuuuuguagagaugggcuuucgccauguugcccacacuggucuugaacuccugagcuccagaaauccaucugccucagccucccaaagugcugggacuacagacaugaaccaccacgcccggccuacacaagcaauuuuuuuuuuuuuuuuaacuagccaggcagcuucucacaccuguggucccagcuauucagaaggcugagguaggaggauugcuugagcccaggagguugagguugcagugagccgugguuacaccacugcuuuccagccuaggugacagagcaagacccugucuccaaaaaaagaaugguuuuuaauaugccacuauuggccaggugcgguagcugacaccuguaauccuagcacuuugggaggccgaggcggguggacugccuuagcucaggaguuugagacuagccugggcaacauggcaaaaccccgucucuacuaaaaauacaaaaaauuaggccaggcgcgguggcucacgccuguaaucccggcacuuugggaggccgaggcggguggaucacaaggucaggagaucgagaccauccuggcuaacauggugaaacccugucucuacuaaaaauacaaaaaaaaaauuagccgggugugguggcgggcgccuguagucccagcuacucaggaggcugaggcaggagaauggcgugaaccugggaagcagagguugcugugaaccgagauugugccacugcacucuaaccugggcaauagaaugaaacccugucucauaaaaaacaaaagaaagaaagaaaauuugauuuuauuuuuaaauuccaaaauuuuuccagaccauagaaacuuuuuuugcagauaaaaacaucuaucugccucuuuacacuaauuuucucuuucuauuguagacuacaugaggauauggaccuuuuuuccucuuaaauuucuuuugcaugaugcuuuguguuuaauacuauuaaauaugcauucuaaucauguuuuuucaaaucuauauuuuuaaaauuuugugacaagauaaaugagugauucucagcugggguuggaaaaggagcuucuauaagaauaucagggccggccaggcgcgguggcucaugccuguaaucccagcacuuugggaggccaaggcggacggaucacgaggucaggagaucgagaucaucuuggccaacauggugaaaccccgccucuacuaaaaaaauacaaaaaauuagcugggugugguagcgcaugccuguaaucccagcuacugggguggcugaggcaggggaaucacuugaacccaggaggcggagguugcagugagcugagaucacgccacugcacuccagccuggugacauggcaagacuccgucucagaaaaaaaaaaaaaaaaaaaaaaaggaaagaauaucagggccaggugcagugagucacgccuguaaucccagcacuuuggaaggcccgaggcgggcagaucacgaggucaggagaucgagaccauccuggccaacaugguggaaccccgucucuauuaaaaauacaaaacuuagcagggugugguggcgcacgccuguagucccagcuacucaggaggcugaggcaggagaaucgcuggaaccugggagucggagguugcagugagccaagaucaccgcugcacuccagccuggcaacagagcgagacuccaucucaaaaaaaaagaauaucaggguagggccaggcgcaguggcucacaccuguaauccuagcacuuugggaggcugaggcagacaauugcuugagcucaagagcuugagaccaggcgcaguggcucgcaccuguaaucccaacacuuugggagccuaagguggguggaucaccugagaucaaggguucgagaccagccuggccaacauagugaaacccugucucuacuaaaaauacaaaaaaauuagccagguguaguggugcgcguaccuauagucccaguaacucgggaggcugaagccagagaaucacuugaaccugggaggcagagguugcagugagccaggaucgcgccaccacacuccagccugggcaacaaugcaaagcccgucucuacaaaaaauacaaaaauuaggcaugauggcauguaccuguaguuccagcuacucaggaggcugaggugggaggaugguuggagcccuggaggcagagguugcagugagcagagaucacaucacugcacuccagacuggaugacagagccagaccccgccucaaaaaaaaaaaaaaaagucaacuaagugcaacuggccuaaaaagcaguuaguccagauuguagcaggagaccggagggcccuaugaaggcaacuuccaggagaaaauucuaauugauggguuugaggguauggaaaaauacauugauaaggcaaauagcagagauguuggcguguuuguaaaaaguuaauaauagcuauaugggaaaccaagcaagugaacaaaugaggcaguuauuaacucuaggaaaaaauagguguauaaggaaagagagacauugucugggcacaguggcucaugccuauaaucccagcacuuugggaggccgaggcggguggaucaucugaagucaggaguucgagacuagccuggccaacauggugaaacgccaucucuacuaaauacaaaaauuagccaggcaugguggcaggcaccuguuaucccagcuacucuggaggcuggggcaggagaaucacuugaaccugggaggcggagguugcagugagucaagaucgugcaacugcacuucagccugggcaacaagagugaaacuccaucucaaaaaaaaaaaaaggaaaaggaaaagagacaugguuuuuuuuuuguuguuuuuuuugguuuguuuugagauggagucuagcucugucacccaggcuggagugcaguggcgcgaccuuggcucacugcaaccucugccuccuggguucaagcaauucuucuuucucagccuccugaguagcugggacuauaggugccugucaccaugccuggcuaauuuuuuuguguauuuuuaguagagacaggguuuuaccauguuggucaggcuagucucgaacuccugaccucaagugauccacccaccucagccucccaaagugcugggauuacaggcuugagccaccaggccuggcugagacauaguuauuucuauuugccucagcucugaaccauauuugcauagucauaauaauauaaauguggacuauugauuuaaccaaauuaugccagagcuauguugguagaaugagagcaggagauacaguggaagaugaugcuauaagaagcuucaucuucaucuaccauaguaggaaguuaaaacuggcugacucuggguacauugucuaugaguuagcccugcucugcaaggagcaguaaagaaaauuuuaaaagucuaaaauuaagucauacccauauaaacauuguuuaagaauaauuauuaaaaagcaggauaacacugugcaugguggcucacgugguaacccccacacuuugggaggccaagaugggaggaucgcuugaguccaggaguuccagaccagccugggccacauagagagacccugucucuauaagaaguaaauaaauaaaaagcaggauaaccauggaaaauaacugaagguaauugcuucugggaaaagguuagugggggauuaagucaagagaaauuuaggaauuaauuuaaaaccauauaaugacaaauuucucuuucuacagaaauuaauuaauuaaaauuuuuuuuuuuuuugagacagucucacucugucacccaggcuggaaugcaauggcgugaucuuggcucacugcaaucuccaucuccuggguucaaacgauucuuaaguaggugggauuacagccaucugccaccuugccuggcuuuuuuuuuuuuuuuuuuuuuuuuuauagagaugggguuucaccauguuggccaggcuggucucgaacuccugaccucaggugauccgcccgccucggccucccaaagugcugggauuacagacgugaaccaccacaucuggccagaaauuacagaauuuuauaauguacuuggccaaaguauauucagauuuaucaucacuuaaaguuucucuaaacaaaucuagcaauuuauaggugaaguccagugcuuugaaugguagaccuguaauaaguuuuuguuaaucagaagauauuucucuauaaggagauuuuugcuaacucaaccuguuucuauuuuccuuuuagguuuaaguuuuugaaacugaaguaggccuacacaguaggaacucaugucauuucuuguaaguaaaccagagcgaaucagggugaguguuuuucuauucuucuggcuuuacuauuuuuguuuucugaaaagcaguguauuuuggcagauguuguaggugguuuucuacgugagggucggaaugauacggaagugagggauguaggaaguaaggcagguagugcagccuccacuccugagaagaguuugcagacagaggcugaccagagacacaaaauuuaccaccagcuugucugauagagaagaaauaagaagaaaguggcuuauuucaugaauaucagucauacaacauuaaaugagucgaugauacuuuuaaguguagacguuuaacugcuuaugaccccccgugagguugugaguuuucaaaaucaaguuguaauuacuaggacacuuuuuucuaaguaauaucauuaguuuuaauugaagacauuuugaacaugaaagauuuuauuauacuucaaaacuucgucagauaaaaugauuucaaaaacaauacuagauuuagcuucuuuacaaauucccauuauuucaugaguuucuuauuuucuuuauuaucaaguaccuaauuucuaaaugcaguuguaauuauuuuagaauuuuguaacaguguauaagugcuaugagauauuaugaguauaccacuuucuuuacauauuaaagcauaauuuauguuuuuugaugcagugcauauaauuuuuaugaaguuuucaauuuaggauauuacuucuuuuuugauuuggaaaaaauaguuauagguaagggcagaagaugcuauaguuccaauucacagucuguaucaugcaacuuauuucugaauguuacuuaaucuuuuuucuaauguuuaugcauauaagaacaauuuauauuagaaagaguaaacuucacuguuaauuaagaggaaaaaaggaaucucuccauagccugaacucugcccaguggaaagaaugcccccaagccaaaguguaacaccaguccuuaagggaaauacaaucuugauuccauugcuuuuaaauaugagcuccuugucugcuucaacguagccuaauucaggugaaacgaaaccacugaucagaaugacagaaaucuaauacucguuugaaauaggccaguaaagugagccauagauugauccugcuaguuuggucuuacuaguuuggcccuugugaacuuggcagaaaauguaagcagccaugucuuuagaaccccuaguggauaaagaauaugcaacuuguugugugccauuuuacaaacuaacagggucuugugaauaacuacuguuucaucucuguuuucuguguuaugaauuccaguaauaguuuucaaauugacaucagugauccaaggcaucuguaauguagaacgaguaagauggaaccaauauagggaaggcaaaaacagucuucauuauuacagccaguacuaucuauuucucaucugucaaauuuaagaauuauucaucaaauaggcaaagaggaguggagaaaggaaucuuguuuuuaguucaagauucuguuaaaaacuuuuccauagaaaugauuccuaacuguacugcaugauucuguuuucauaguugggauuuuguuugucugucuaaaggcugauagcuaauuuguugcggcuuggaagaaauacuaauucucuuugggguuuuccucuuuagcggugggucucggaaaaguucauuguugagggcuuaagagauuuggaacuauuuggagguaaguacaguauggcauuuagccaucacuucaggauauaaaaaucacuacuuuuuuguugacuaaaucaaucuauagcaauuggcaauucuaagggcaaguguaaccuacaguuguuggauuucuuugguuccuuuuugaauuuaugguuucccaaagauuugaagacuaacauggcaauuuuccuuggccugucuugauuguuagaaagccaguauuuacuuaaaagcauauauguuuucuuuuguccaggugaaauacauauuuuuaaaggaagaaaacuauuuaaaagucuguagccuugauuuaaaaaauaauugucaagacaaaggaagcaaugauaugaaaguucugguuuuauugaugaaucuaguugacucauuuuuucaugguagaaauuaugagauuuaagagaacuaaggaaaaaucuuucagaacaaaaauaugaacuuccuauuguaaaaccugacuguugauuucagaaguaaacuuugacaggccuaggcauuacccuuuggccauuuucaaagugagccuuuuugggaacugucaucuuaauuuagggcaacaaaaauuauuuucaauaaaaauaauaguagagccccauucuuugugucugaauucuaagauacucuuuuaggauccuauaguuuaagaaacagauuaccggccggguaugguggcucacgccuguaaucccagcacauugggaggccgaggugggcagauuacgagaucaggagaucgagaccaucuuggcuaacauggugaaacuccgucucuacuaaaaauacaaaaaaauuagccgggcgugguggugggugccuguaaucccagcuacuccagaggcugagacaggagaauggcgugaacccaggaggcggagcuugcaaugagcggagaucgcgccacugcacuccagccugggaaacagagcuagacuccgucucaaagaaaaaaaaaaggaaagaaagaaacagauuaucggccgggcacgguggcucacgccuguaaucccagcacuuugggaggccgaggcaggcggaucaccugaggucaggaguucaagaccaggcuggccaacguggugaaaccacaucucuacuaaaaauacaaaaauuagccgggcauggugaugcacaccuguggucccagcugcuagggagacugaagcaggagaauggcuugaacucgcgagguggagguugcagugagccaagaucacgccauugcacuccagccugggcgacagagcaaggcugaguuuuugagacuccgucucaaaaaauaaaauaagaaggaaauuuaaaaaacagauuaucagauugaguacauugguuagcugauccaaaauacgcccagauagguuuuuuuggucuuguuuuauuuuguuguuguuuuguuuugagacagagucucgcucugucgcucaagcuggagugcaguggcacgaucucggcucacugcaaacuccgccucccggguucaagagauucuccugccucagcccuccugaguagcugggauuacaggaucacaccaccaugcccggcuaaauuuuuuuuguauuuuuaguagagacaggguuucacuuugggaggcccaggcgggcggaucacaaggucagggauagguuuaaguaauugaaaacucaaacuuguuaguuacuaggugguaccuauuauuuucccuaacacaucucaaagaauuucuggacuagugauaucugugaacuuugucaaaguauuauguuuuagauaaaugggaguuuagaauaaugaugaguucuuuauauuuuaguuggaaagaauuaguuagaugcacaguaaaggaaaggauaguggaacaaaaauaccacauucuguuccuauucucauuuucuucccaucauuaaugggaauaaaaugguuucaaaguaaacaaugaggcugggcacgguggcucaugcauggaaucccagcacuuugggaggccgaggugggcagaucacaaggucgggaguucaagaccagccuggcaauauggugaaaaccccaucucugcuaaaaagacaaaaaaaagauagucagcaugguggcgcacgccuguaaucccagcuacucaggaggcugaggcaggagaauugccaagaucgugccacugcacuccagccugggcgacagagggagacuccgucucaaaaaaaaaaaaagguaggccaggcgcaguggcucacaccuguaaucccagcauuuuggaagacugaggcaggcagaucaccugaggucaggaguuggagaccagccuggccaacauggcaaaaccccaucucuacuaaaaacauaaaaauuagccaggcgugguggcaggcaccuguaaucccagcuacuugggaggcugaggcaggagaaucgcuugaacccgggaggcggagguugcagugagccaggaucacaccacugcacuccagccuaggggauaaagcaagacucugccuccaaaaaauaaaaaauuaaaaaaaaaauuaaaaagaagaaagcauuuuccuugguaacuagacuuuucugauuuuguaguuuaagguauuuagaauuguauaauuuaagauaauuagaaauguauaaucaccccaauauuuuacaguuaaaaaucuucaguuuggugauuuuuaucacuuuuacagaauagagaaggucaaaagcacauacagaauuuggcuuaagaacagaaaguuauuucaguuguccuuuguuuuguucauuuucacuaggacaagcagagcgccaaaaugccuuugcuuuauuuacauuuagaaucaaauauaucugacuuuagagaaucagguuggguaaugguccuucauacacguguugcuauuuuaaaacuuuuugcccuuuuuugaaaaaacauguuuucuaguucccacacucacugggaaauggccaaccaucucuguaacuauauaaucaauuguuuauucacaaaauauaaggaacuggccuauucauaauaacauuguguguugaugccaaguaaauguaugaccagaaauguaagaguugaguucuauccaguaaagaauacccauagaguaguagccuugccaccuuuugaagaaccauagauccauguuuaaagcccuaucucucugcagcauuuuuacuguggaucuguguguguuuauauguagccccgcaggcacuuuuugcuguaaugacuuuuaagugguuucuauuaauaaauguaguccuaaguacaauaauugcuguucugaaugugggugugucuucugcuaaaacacaaaaugccaacaaucaauuucucuaccccagagcagccuccgggugacacucggagaaaaguaaguggcuuccuaggcccuagcacuauggcuguugcauggagaugacuucuuguggaaguuuguguguuuuguuggcuuaucauuuuauguuucugcuuaucugucacugagcuuuauuuguagugugauuuuuguacuuguggagauucagguuucacccuggaaaaauuuggauguguaguuugaaaacugaaaaaagucucagguaguuuuugucucuucuggggauuaaggucuccuccucuccccagcccugccaaucgacugccaccccuucccccaaaaaaguaaguuucaacagucagaaauacgguuauuguuuagugacuaauguuauuaaauuuuccguccuuaguuuauuaauaauagauuuuaguccacagagauaauacagaucucugccuagauaauaagacaggaccucaaaucucuuaccuuaaaaaacaaaagcaaaauuaaaaaguauaaaacagaacauuuacuuuuuucauuggugaaagcugcaagauucuuacccuguuuccuucucuucuaguuuauuuuacuuaaauaaauagcaccagaugugcacaguguaccaagcuauuuuggaauauaugaaucagugucuuauaaggagagaggauaagaaccuuuccuaccuagacuucugacucuguucagauugcagacauuugcagcuucugcagcagcccuaagguugagugaaggacagugauguugacugggaauuucugaguaaagcuuuggcugugcuuaugucaucugcuaaucaggagcaccucucuaucagauccaaaugcuuuccaaucugaagaccaaaaacguucccuauaggcucaguuagcuauuuuucuagaauacgaugccaauuacauaggauuuuuauauuuuuacagcugcugauguuauaucaaaaguuauccugugugaaaccugugggaaguugaauguguuuauuugguagcauuuugugaauauugucuuugugugcuuuacuguauuuuguuuuaaacucuuuaaacacaguuauuuuauggucauuucuggauaucagcugcuuauuuauuuuucagaugcuucaaaaugaauaaaaugcauuucauggugggggaaacuaagaaaacacuuugacagaauuaguuccuuucuaugagcaauuggagauuauuacauugcacuaauuaaacuaugccaugcugcauuuaaagagaaugggcuaaauaguucauucuuuuuaucugaguuuagaccuguucuaaaacugaaacagugugaugaacuaaccugcguuucuuguggcaaugucagaugaucuagacuucuuccuuucaaaauauugccuguuuccuuguuuguuuguuuguuuuccuaaaugaaguuuggucucucuuugaguucggaccuauacaauauccacaaaguagaaggccuccauuuuagaaucauuccuaguaagcuggggacagagcaguugcuaucacuggacuaguucauuuuaugcaauuccagauugccugugagcucauauugccaguuucauaaagaacuuuauuuucuuucuuucuuuuuuuuuuuuuugagaccgaaucucacucuguugcccaggcuggagugcaguggugcgaucucggcuuacugcaaccucugccuccuggguucaagcaauucuccugccucaaccucccgaguagcugggauuacaggccugugccaucacacccagcuaauuuuuauauuuuuaguagagacaggguuucacuauguuggcuggucucgaaccccugaccucaagugaucuacccuacucagccucccaaaguccugguauuacaggcgugagccaccgugcccagucaagaacuuuuuuuuuuuuuuuugagauggagcuucacuuuauuuuuuuuuauuuuauuuuuucuugagacggugucucacucugucacccaggcuggagugcaauggcaugaucucggcucacugcaaccuccaccucucggguucaagcgauucuccugccucagccucccgaguagcugggacuacaggcacccgccaccacgcccagcuaauuuuuauacuuuuaauagagacggaguuucaccauguuguccaggauggucucguucucuugaccuugugauccgccugccucggccuuccaaagugcugggauuacaggcgugagccaccacgcccagccggagcuucacuuuuguugcccaggcuggagugcaauggugcaaucucagcucacugcaacgucugccaccuggguucaagcgauucuccuuccucagccucccaaguagcugggauuacagacaugugccaccacacccagcuaauuuuuuguauucaguagagacaggguuucaccauguuggucaggcuggacucgaacuccugaccucagaugauccaccugucucagccucccaaagugcugggauuacaggcgugagccaccaugccuggccaagaacuuuauuuucuuuuuuuacuuuuuuuuuuuuuuuuuuuaaacagucucgcucugucgcccaggcuggagugcaguggcgcgaucucagcucacugcaagcucugccuccccggguucacggcauucuccugccucagccucccgaguagcugggacugcaggugcccgcugccaugcccagcuaauuuuuuguaguuuuaguagagacaggguuucacuguguuggccaggauggucucaaucuccugaccuugugauccgccugccucggccuuccaaagugcugggauuacaggugugagccaccucgcccagcccccagaacuuuauuuucuaaaggccaggugugguggcucacaccuguaaacccagcacuuugggaggcugaggcaggaggaugacuugaggccaggaauuugaagccagccugggcaacauagugagaccccaucucuaaaaacaaaaaaacuagccaggcaugguagcgcacacugguaguccuagcuacccaggaagaugaggcagaaaaaucccuuaagcccaggaguucaaggcugcagugagcuaggauagcgccauugcacuccagcuugggagacagagugagacucugucccuaauuaaaaaaaaaaaaaauuagcuuggcaugguggcauauaccugggaggcugaggugggaggauccgcuugagcccuggaguucgaggcuguagugaacuaugaucaugccacuguacuccagccugggugacagagugagacccugucucaaaaaaaaaaaagaaaaagaauuuuauuuucuaaaacuaauacuuuuggguuaguuuugguaguuuucuguaauacuggagaguagaaauaaauauugucaaguuacuaacuaagcacauugauaguuuaaugaaucauucccuaccuaggcuuagcaagaaugugucuuaguguauagccuaguagacaauaugucuuauaagcuuauaugcacgccugacaaggaagagggacauagguaaugaaguaucuaucugccgggcgccauggcucacgccuguaaccccagcacuuugggaggccgaggugcgcgcaucaccugaggucaggaguuugaaaccagccuggccaacacaaugaaaccccaucucuacuaaaaaugcaaaaauuagccgggcaugguagcacgcaccuguaaucccagcuacccaggaggcuggggcaggagaaucacuugaaccugggagguggagguugcagugagccgagaucgcgccauugcacuccagccugggcgauagagcgagacucugucucaaaaaaaaaaaaaaaguaguaucuaucugugguuucuccaaagggaguuauuuaaaguacauaaaaugaauauuugaaucucaggacucagcugucuuucauagucucuuuuucaagugagagaaauuuuaaggaguuugcuuagagagcagaugcacgaagaccuucagauacaaaguaguugccucucauugaggccauauuguuaccuacugaaaaaugcaguacuuucucacaugcaggaaucagauucuggucuauagaguguucugaguaacacaggaaucuaacgacugugucauuaugaggcuggcauuuccagcauaggucaucaugcugaacccguuaccaaaggaacuggcugcauugaccuauucucuucuuuagcccgugggaaugaaaagaucaugggcagaaagccucaguucaaacuuugcuuaaaucauuuucauuuuuuaagcauuugccagcgguguuccaggcacugggggaauacaucagugaacaugacagacaaggucccugccuuucuggugcuugcauuuuaauggaagaaacuuuaguggaagauuuuagagaaauaagcugcaaugguaacuucugugaagaaaggaaagcaaggcugucugauaacgugaccaggagccuaguuuacuuuggcugggcagucucucugaaaaggacauuuaaguugagacaucagugauguugaggagguagccaugagaaaaauagcagggucaagggaaggaggaggcuaggaggguuccaaagggacaguuagugcaaguuuccugagacuggaacacacuuguuuaugugggaauauuguucaagucaggcgagcgugguguggaaugagaucacagagguaggcaagggccaaaucauuuguauacucauaggcugggguggggaguuugggucugaaagcaacccacugagcuuucuauuaacuguuaacauugauuuuauuaaggaauagauuaauacuuaagaaaacagaaucugcagagcaagaauaugugcaggaguuaggcguauauaagguugagaaaaugagacacuucaagaccaaaugagcguugugaauucuaaaccgauggagaguugucauuucagaacucuugcuugaggcuuuuugcucaaauugcugcuccauuuuugccuccugguuguguaucucucucaccuuggugagguaccuggcaugugguaaccaguaucuuaacaucuuaagaugauucugaagaugagaucguuucaaaaagcuagagucagcagggugcaguggcucaagccuguaaucccaguacuuugggaggccgaggcaagagaaucgcuugagcccaggaguuugagaccagccugagcaacauagggagaccucaucucuacaaaaaauacaaaaauuagcuaggcgugguggcacaugccuguagucuuagccacuugagaggacugcuugagccugggagauugagguugcagugagccaucaucuugccacugcacuccagccugggugacauauugagagccuaucucaaauaauaauaauaauaauuuuuaaaaauuuagugauccuaggccaggcaugguggcucacgccuauaaucccagcacuuugagaggccaaggugggaggaucacuugagguccaggaguucaaggccagucuggccaacauggugaaacccugucucuacuaaaaauacaaaaauuagcugggcaugguggcucacaccuguaaucccagcacuuugagaggcugaggcggguagaucacuugaagucaggaguucgagaccaaucuggccaacauggugaaacccugucucuacuaaaaauacagaaauuaggggugguggcaggcaucuguaaucccagcuacuugggaggcugaggcaggagaaucacuugaacccaggaggcagagguugcaguaagcugagaucgcacuacugcacuccagccugggcaacagagugagagucugucuaaaauaaauaaauaaauaaauaaacuuagccgggcauggugguucgcaccuguagucccagcuacuuauaaggcugaggcaggagaaucguuuaaacccaaaaggcagaggcuauagugagcugagaucacgccauugcacuccagccugggugacaaagugagacuccgucucaaaaauaaauaaauaaaauaaaauaaaauuuaaugauccuagaauuuauuuugagagcauuagaaaacacagauaaguauaaaaaccaguaucaaaucaacuuuacugaucaagcucugcuuaggauucuguuuccuccauuuucucuuuuccauuuuauuuguucaacaggagagucaccaaaaaguagagagcaauagaaggaggaggagaauaggauucacauguauugaaugucuuuuauacaccagguagcacuaagcucuuaacauauuuuaucucaucuaauagauacaacacuaugagauggaaauuauucagcugcugauauaauggagaucccaagagaucagagugacuugcccagggucacagaaccaguaauagaccugaguucaaauucugccucuauguggcccauaagccuaugcucuuugcauuguagcauauguuuuauuuaaaacagccuuucccaauuaucuuucccaaaauuuaacagauguuaggcacaaaagguucccuagacagaucucuuugggaaaugcuggguuaaacacaguaaguuuucuuacuacagaauuucucagugccuuuaauauggacguacaccuugugauccuccaugagagagugugcugcauuuccuaacuucacuggacauggaaacuuuuuccauccaacuggcagaaucagaguuccguggggccuacuuuggggaaauccugcacugaaacaacaggaaaauggucaagagacaggaagaggcauuuucaccuuggagaacgcucacaugacugauaaauauaugaaaagauccucaucuucauuaguaaucagggaaauguaaaucaaauccaugagacuggcaaaaauuaagaaaucugaaaauaccaaguguuggggaaaagauaaauuaauaagaacacauguggccgggcacaguggcucaugccuguaauguuagcacuuugggaggccaagcugggugggucacuugaggucaggaguucaagaccagcugggcaacauggcaaaaccccaucucuacaaaaaaauacaaaacuuagccaggcaugguggcucacaccuauagucccagcuaccugggaggcugaggcaggagaauugcuuggacccaggaggcggagcuugcauugagccaagaucgugccacugcacuccagccuggugacagagugagacuccgucuaaaaaaaaaaaaaaaaaaaaccacguacguugcuggugggaguguaaauugguauaaccauuuuggaaaauaauuuggcauugucucaaacaguugauuguucauaugcucugucacuagcaauuccagccacuccuaauuacaagcuuuagucaggauacauauucaaacauguuuauaguagcacaguccauaauagcagaacugaaaaacaacccaaaugagccaucaaaguuggaauuggauaaacugagauauauucaugugcugaauauaugauacagcagugaaaaugggcgaacuacagugaaauacaacaauauggccaaaucuuagaaauuuaaaaauugauuaaauuagaaauggaauuuggugacagggcuuaauuuugcuugacuagguuccucuuauugccaggguaaguggugagggagacagagcccacuugaggguuucuuuccccaucagcagcaucaacuguuuugaaaccacauacagccaauaaucucagcuccugccaauaaucucagcuacuugggaggcugaggcaggaggaucaauugagcccaggaguucgaggccacggugagccaggaacucaccacugcacuuuagccugagcgacaaagagauaacccauaucuuaaaaacaacagcaacaaaacaacaaacaaaccagauacacgugaaacgucagccaacagggugguagauuaaucucacugguuugggccuggguccugugccauguacucacguuuugauuuuuggcaagucacauaaucuccuuggcccucguuuuuguuagugaaaaguggagauaagaucugucccggcuacuugacugagcuauggaggaaucaugugcaauuuggaagugcucuggaaaguauacucuggucaucuuacagguauagagcaccgucaucuuuaugguuuccucugcagagccgcuucccaaagaguuguucaagcaccgccuuuucagaacacucucagcucgugcucuucuggguagugcugggucaggagccucucauacuuucacaaaggacuuuuucugccuggaggucagguuuaugagugcagcacaugaaacaugagcuggcccagguuucuccauuucaguuagaugugcaucuaaagaaagagaaucuaaaagaaaagcagucacagucccuaaaucauacacauaaauuuagguguggaagaaggaaacaguccauuaagcugaaagaagagcuguuggucugccguguguuuugcacaaacucagacauggcuggacaccuuccucuaggaccuuagaggccagaguugugacacauccuaaguggcuggacuccagcuucacucacagcacacgugggcaggaacgagggagcaggccaugucagcugccuggacgaugccugagaccugacagcucugugccuugccugcagcucagggcaucaggguucucccacuucacuuggaaaugucaggcaaugacuggcccgggcucuugguuugcuaaagagggggcuacuccuggccacauuuucccuagagcaagauucagcguuugaccuuuugggaucuuguggugaggaccuuaaaaauaggauccuaaugcaucaggaaauucaugagaaccccuaccucuccaccugcuucucuuuuccaaacaugcuuucauucucuagacaucccuucuccaagugagaauuucauagcuuuuagcaaaugcauugauuguuggaaaggacaagcagauuaacauuugaugggaacagguccuugucuccucauuuguagacaacccuaacacuugcucugauauuagugcugauuacuacccugaauguaguguuuuguuucucuucaaauagugcuggcacugagucgggauuuguguguguguuuagaugccagucuccucgugggucugaauuaccaccuucaccccacucccaucccacccccaguuuucucuacuaaccuauuuuucuuuuucuuuuuuagaccaaugaugcgagcucagagucaauagcauccuucucuaaacaggaggucaugaguagcuuucugccagagggaggguguuacgagcugcucacugugauagguaugugcaggggccguccuuacucuccugcuuucugcuccaggggcugcugcagcuuucucagcagccccagauguguguacagcagaggccauccacuaguuaggaggauucaugggcacagacuugcuucugugggucuucucuguuuuuuuaugccaaguaugggaagagaucaaacuuccaggaaagaagcucuuuugccaucuuuccuuuguggcugccauguuuccgguguccuggccauagugagucagaaagguuggcugagaaggaacugaugagagaaaaaucaagaaaugugagccaugaacauaacaguuaaauucugcugggaaaaggaaaaaaaaaaaaguaacaguagugaaaaauuuaacauuaaguuucuuuugaaaucaagucccuuuuuuaaaggaaaauuuucuuaaaaccuuuuguuguucuuguccuugcguauggcauucccuuuuucuuuuaggcaaaggauuugaggaccugaugacugugaaucuagcaagguacaaaccaacaggagaguacgugacuguacggaggauuaaccuagaagcuuguuccaaugagaugguaacauucuugcagguaauaaaccaugagugugucacauggagggagggugggcucuuggcucugauaggaauuacaaggaauuacaaagaaaugaagggagacuaaacguucggaaguuauggaagcuuucaguggagaauccuggccauuuggcacuaaggauugggcugaaaugcugcucagccuaauuuauauuucccuuuucuucuccaaacacucccuucuggcuuuuuuauucauuuauuuauuauuuagaaagaagcuaaguaacuugcucauggcagaggcaggauucaaacccaggccaucuuguuccagacacaaggugccugcccugccaccaguggccaucuucuggcucucagccuccuguuugccugauguuccuuucuuuuucuuuucuuuuuuuuuuuuuuugagacggauucucacucugucacccaggcuggagugcaguggcacgaucucggcucacugcaacccccaccucccagguucaagcgauucuccugccuuagccucccgaguagcugggacuauaggcgcacaccaccaugcccggcuaacuuuuguauuuuuagaaaagacgggguuucuucauguuggccaggcuggucucaaacuccugacuucaggugaucugccugccuuggucucccaaagugcugugauuacaaaugugagccaccgcaucuggccucuuuuuuuucgagacagggucucauuuuauugcccuggcuggaguacaguggcaggaccacggcuuacugcagccuuaaccuccugggcucaaaugauucuccugccucagccccccaaguagcugggacuauaggcacaccacaccugacuaauuuuuguauuuuuuguagagacagaguuucaccaucuugcccaggcuggucucaaacuccugagcucgagcaaucaacucaccucagucucccaaaaugcuaggauuacaggugugagccacuaugcccaguccugacauuccuuucuauucgagaagcaaguagccacucucucguuaaacugagagagggggcaggcaugguagcucaugccuguaaucccaacacuuugggagggcaaggcagggagauugcuugagcccgggaguuugagauugcacuaccaaacuccagccugggugacagacugagucccuggcucaaaaaauaaaacaaaacaaaacggagagagacugugagucuaguaagugcuugggaguuagacucuccuuuccugaugccagcuuagagucagggccuggggcaguuuuccuucaguagaguuaguugcagccccuccccuccuucauuuacaacuuuuucugaauuggugguuaccugauggugcucuaggaccuguucaucuguucauaguaguuuggugggucugaggauggagcagaagccagucucagcuggccuucuccuccaucaacuguguuuucuuuuucuuuuuuuuuucuuuauuugagacaaggucuggcucuguugcucaggcuggagugcgguggugcaaucacagcucaccacagccucaacugcucaggcacaggugauucuaccacuuaagcuucccgaguagcugggacuaaaggcaugcaccaccaugcucaacuaauuuuuuguauguuucauauagaugggguuucgccauguugcccaggcuggucuccaacucuugggcucaagugaucugccugccucgccucccaaagugcugggauuacaggcgugagccaccaugcccggccauguuuucuuuuauaauagaaacauaguuuugggcugggcacaguggcucacgccugcaaucccagcacuuugggaggccaaagcaggccuaggcaacauggcaaaacccugucucuacaaaaaaauauaaaaaauuagcuagguauguugacguccaccuguggucgcagcuaccagcgaggcugaggugggaggaugacuugagccugggaaguucaggcugcagugagacgggaucacaccacugcacuccagccugggugacagagcaagacccugucucaaaaaaauaaaaaagaaaacauuuuuggccaggugcaguggcuugguggcucacgccuauaauccuagcacuuugggaggcugaggcagaaggacugcuugagcccaggaguuugagaccagccugggcaacacagugagaccuugucucuacaaauaacaacaacaaaauauuuuuuguuuucuuaucuuaaagaggaauucuauacguuggcccuugaaauugagauaagcuuauaacuucagaagucuucagucaacaguuugccuucaucaucucugagucggugugcuggcacccuuuguuguuggcaguuucccuaucuggcagaggcaaagcagugcugggucccugcagaggcagcagggccuuguuuuuccuauguuggcaggcaccugcuuaggcuguucccaugacucugagaacacccagaaagugccaggucccccuauuguccaugcugccaucuuuguguugagcggcauccuucagugccauuugguucugacuucagcuucaucauugcuuccagggcgagcugcaugucuccaaacucuucaaccaucccaauaucgugccauaucgagccacuuuuauugcagacaaugagcuguggguugucacaucauucauggcauacggugagugggaaaggguucuugguagaaagggguuauugggacucuguugucagauugccuguguuuuccuccuccauuaccuuucacugccuccaugcaauccuuuucugcagguucugcaaaagaucucaucuguacacacuucauggauggcaugaaugagcuggcgauugcuuacauccugcagggggugcugaaggcccucgacuacauccaccacaugggauauguacacaggugcguucuuaggcggccuuucccaugauuacaguggguagcuaugccccugagccuucagguaaagugaaguuugacugaaguuaaugaagccagaguuuaaaaucaaggaucuggauucuugcugaagaucucuuugcucugaaaagaaacagggcccagcgcgauggcucacgccuguaaucacagcgcuugggaggccaaggcagguggaucacaaggucaggaguuugagaccagccuggccaacauagugaaacccugucucuacuaaaaauacaaaaauuagccgggugugguggcacaugcuuguagucccaguagcugggacuacaagcugaggcaggagaaucgcuugaaccugggaggcggagguugcagugacuggagaucacaccacugcacuccagccuggguggcagagugagacucuugucugaaaaaaaaaaaaaaaaaaagagagaaggaucuggauucugaccuugccacugacuugggagauggucacuuagccuguuagugcugaagccacugacuuucucuuugcugagcagcuuggucuugaguguugugugagaggaacaucugauguggaccuuuguacuccacucucugccuccuucuuucugugccccagagucagucuuaugcugagagaccagggcgaagacagauagcuuaguagauagugucaggaaaucagcucauaguagggaaaaugguaaaacuggaccccuacauaacuccucauacagagaaggacugcagcuggauuaaaggcuucuauguaaaaugugaaacuguagacuuaaauagaaggaaaugugagaaaauguuuuugugaccugaggcauguaauaauuucucaacauuuuagaagcacaaaacauaagacaaaagauugaugaauuugauuagaucaagaagauuucuauccaauacaagauaccaugaaaaagguuaagaaacaagugacagagcagaugauauuagcuuugucaccacaggagauuaguaacagggaaaucuugcaaaucaacaagaaauggacagcaaagcaagaaaaaugggccaaagauaugaaguuuacaaaagaggaaaccccaagacaaacccaucauaggaagagccacucaaaucucgcaaucagagaaaagcaaaugaaaaacaagaugucaccuuauacacaugagacuggcagcgguugggaggcuggacgagucccaguguggcaaggacggggagccuccuguccaggugguggaagaugcccggugcugccagucagggucacagaaccagaaccaucaaugccacuucuggauguacacccuaaagaaacccucgugcagacccaucaggggacauguuuggaugucaccauucacacguguguugguuagggguagugugagugucuguccccagaaggauggaugaguaaaaguguuagaucucuucccagaaccaaggugacaauuagaagaaaagaugaaagguacacagcuagcaauacagaugugucuggaaacuacagcccugagugaaaaaggaagaaugggaugcggaacacaguaccccuagguacacuuuacaagaguccuacagauaagaaguacagauuaaaagcauucguaggagguagggcaagagguguucuagagcauacaagagcacugaacagucccagcacucugggaggccaagguggguggaucaccugaggucaggaguucgagaccagccuggccaacaucgcaaaacccugucucuacuaaacauacaaaaauuagccgggcaugguggcaggugccuguaaucccagcuacucaggaggcugaggcaagauaaucacuugaaccugggagguggaggcugcagugagcugagaucgugccauugcacuccagccuggaugacagagcuaaauaagcuuuuaaucuggugauauguaaauggagucaugcuauuuuauguagauuugaaguuuuucauuaaaacauaguuauagcuggaugcaguggcagcacuuugggaggccaagggguggaucucuugaggucaggaguucaagaccagccuggcuaacauggugaaacccugucucuacuaaaaauacaaaaacuggcuggaugugguggcaugagccuguagucccagcugcucaggagacugaggcaggagaauugcuugaaccugggaggcagagguugcagugaacugagauugcgccacugcacuccagccugggcgacagagugagacucugucucaacaacaacaacaacaagaacaaaaaaccugguuauaggccggucacggugauucacaccuguaaucccagcacuuugggaggccaaagcaggcggaucauuuaaagccaggaguucaagacuggcauggccaacauggcaaaaccccaucucuacuaaaaauauaaaaauuaguugggcgggcccagcgcagugguucacacugguaauccuagcacuuugggaggcugagacggguggaucacgaggucgggagaucgagaccauccuggcuaacacagugaaacccugucuccacuaaaaauacaaaaaaaaaaaaauuagccgggcgugguggcgggugccuguagucccagcuacucgggaggcugaggcaggagaauggugugaacccgggaggcggagcuugcagugagccgagauggcgccacuacacuccagucugugcgacagagcaagacuccgucucaaaaaaaaaagaaaaaaaaaaauuagcugggugugguggugcacaccuguaaucccagcuacuugguuggcugaggcacaggaauugcuugaacccaggaggcagagguugcagugagccuagauugagccacugcacucuagccgggugacagagugagacucuuaucucaaugaaaacaaaaacaugguuauguauauguaaaauacacauauacguguauaacacacgcacacaggagagagcuggccagguggagugugugaagaccaaaaauuuguagcaggaggggcuccugcucucgacaugacacccuccccgcuuccccaggagugucaaagccagccacauccugaucucuguggaugggaaggucuaccugucugguuugcgcagcaaccucagcaugauaagccaugggcagcggcagcgagugguccacgauuuucccaaguacagugucaagguucugccguggcucagccccgagguccuccagcaggucugugugugggcccagaggagcuccccuacccaacucaugauucccaagggagccuucaggcauugccuggagucgggggcucucaaccucccagugggguaaagggguuccuggagggagggagcccucagcgugggcagcgccuguccacugcagauggaugugguuccucccaggggguccuaaccucuauuggaugaaauuucagcucccuuuagggacccuuggcacccuaugagaagagugagcauuuuggaaauguuugcugcucucuggaucccugugcuaagcaggggcauggggcuggcacuuccugcuccuuacagagcaucgccaguuacaggugguaaaauaccaguuagucuucaguagcacaggcaaggagagucauuagcagcagguccugauguggggacagccauccuuuuccucucuuuaguucuacccuuuuucuaagaacaaagaccaaaugggguaaucuguggccuuuuuuuucuggcuuagaaucuccaggguuaugaugccaagucugacaucuacagugugggaaucacagccugugaacuggccaacggccauguccccuuuaaggauaugccugccacccagguaagccugccgcccaucgguuuccuucuugccugcuugccuuccacagauguucguugaguagcucucacacucaggacacagacuaggaauacuaagaugaaagacccugucuuuuccuucaagaagucccacccagugggggauagugaccucacucuuuguuuacuuccuguggcaaaccuggugguaagggaggccagcuuggggaggggagcccgggagcaggggugcaaauggaggcccacacgcuacaugucuauuuaaaacauauacauuaagcuaacuaguuuuuauaaaugcauaaaauauguucuguccuccuacuuggauaaauauaccuggaaggucaguuucuaauuuagaauucccacaguucuuaaccgcauuccagcugacaccuuuggaacccccauucuguaaguucagcuucuguucaugacccuccagaugccuguccuuuggccaccccuaggauccaagggugcacagucaguggcacagucuacccuugggaaaacagacccagggaagaggcuuaugcaagccucauuaaauccagaaaauggauuuggggucauuugggcaaggauuaccugggucccagcuacuuggaguguggucuggaacugggaggggcaggaugcaggcucuaauuaagccacuuccggaacccacaggcugcuugcccggugguaggggcagcuggaggguggccagagugcagccccccagagcaggggcccagggaaguccugggaggaggcagccuugaguuggaaggcagacagcagucaccuguguggaggaggaacuaggacacucuucucggcagacagcagcaugugcagagacccagagucuagaaaaaacagaucuggagaacagcaaggagguguaaaugguauaaauggccaaggugcagugcuucuuggggacugccaggugacaggcacagaaggaagcaaggguacauugugaagggcuuugaugccacuuuagagcacugguuccuguccuaaagccuguggagcagugcugaggauucuaagcacaggagugacagcauaagauggcucauuuacaaagaccaccccggcagauggauuagauccaguagcucaguuagguggguauggaagucuaugugaggaaucuaggagaucucaguaaaauaauucagugacagaggaugcucaggaaagaaaaggugacugaggaggaacaagaaguccaggccuagaagcagcaccauccacuagaauuugcugcagcgaaggagggcuucuguggcugcacugucuagcgugggagccaugagacuguguggcugucgagcauuuagaaggugaccagugagacugugggacugaauuuuaaaccucauuuaaaucgaaauagccacaaguggcuaguggcuaucacguuagugcagcucuagagcaauuuccagguuucuggcuuggacagcuuaugcggucaugaggacuuccacgaggacagcagucccagguggggcugguuuuauauguguugaguugggguacuuuggaacagccacccagccuggccuccccuugggcaucuugcucccguguggccugcugcagcgacagcccaggcuguggcacugcagggacugccucucagaccucaucggauccaccugagcauggcagacggcugggcuucaaagcagguucaucugacugcuccuucccucuagggugaagacucuacgguaaaaggaauuugaugccuuggaaagggagagcggaaacugugagcccugcuuuccagccauggcgaaagcggguacuuuugugcaaccccucuccuuucacguuggccuggcuagggcggagcugccacgccagugaccagcguuucuuugggaaaauuggacuuacuccacuuccaccuuuuccacucuucaaaugaucacauuugcauauugggaacaguguauuugugaagagacucucaggccuuccagggaccaccccccccccccacccgcuacagcccagguccugguucuguccuccccagaugcugcuagagaaacugaacggcacagugcccugccuguuggauaccagcaccauccccgcugaggagcugaccaugagcccuucgcgcucaguggccaacucuggccugagugacagccugaccaccagcaccccccggcccuccaacggugacucgcccucccaccccuaccaccgaaccuucuccccccacuuccaccacuuuguggagcagugccuucagcgcaacccggaugccagguaucccugcuggccugggccugggcuucgggagagcagagggugcucaggaggguaaggccagggugugaagggacuuaccucccaaagguucugcaggggaaucuggagcuacacacaggagggaucagcuccugggugugucagaggccagccuggggagcucuggccacugcuucccaugagcugagggagagggagaggggacccgaggcugaggcauaaguggcaggauuucgggaagcuggggacacggcagugaugcugcggucucuccuccccuuucccuccaggcccagugccagcacccuccugaaccacucuuucuucaagcagguaucguagccccuucguucugguucugguucuaguucugguucuaacaacucacaaucccuuuagcuuucucuccccucccuuugaaugagagaaacuaccccgcuuccgaagccccugaaagacacugcuccuuccucucauggaguuggcuccgacagcccgucugccaccaggccaugguuccuugccccaugguguccugggacccagagcaacaggaucugucacccaccucucucuucucccccagaucaagcgacgugccucagaggcuuugcccgaauugcuucguccugucacccccaucaccaauuuugagggcagccagucucaggaccacaguggaaucuuuggccugguaacaaaccuggaagagcuggagguggacgauugggaguucugagccucugcaaacugugcgcauucuccagccagggaugcagaggccacccagaggcccuuccugagggccggccacauucccgcccuccugggcagauuggguagaaaggacauucuuccaggaaaguugacugcugacugauugggaaagaaaauccuggagagacacuucacugcuccaaggcuuuugagacacaagggaaucucaacaaccagggaucaggaggguccaaagccgacauucccaguccugugagcucaggugaccuccuccgcagaagagagaugcugcucuggcccugggagcugaauuccaagcccaggguuuggcuccuuaaacccgaggaccgccaccucuucccagugcuugcgaccagccucauucuauuuaacuuugcucucagaugccucagaugcuauaggucagugaaagggcaaguaguaagcugccugccucccuucccucagaccucucccucauaauuccagagaagggcauuucugucuuuuuaagcacagacuaaggcuggaacaguccauccuuaucccucuucuggcuugggcccugacaccuaagucuuucccacgguuuaugugugugccucauuccuuucccaccaagaauccaucuuagcgccuccugccagcugcccuggugcuuucuccaagggccaucagugucuugccuagcuugagggcuuaaguccuuaugcuguguuaguuucguugucagaacaaauuaaaauuuucagagacgcugcuggagaa

SEQ ID NO: 192315 - RNA, 4344 nt, Homo sapiens
uccuagaggacuuggcccacagagcuuuauuggagagauacacacaaaggcuguccacucacuuccauaauuucuugauggacauguuuuucucacuguccuucugcaugaccuaggggugggagagagaaugaacauuaaguuacgaacacacacaugcccuagcccacugccccagagccaccacuggcaaaggcacaaagauggaggccuauaccuuggcuacugccaucucaaaguccuccugagugacauggacucgccguucucgcagggcauacaugccagcuucugugcacacgcccugaacaggaaaaggaaauugaggccccacugcugugccccucaucuguggcccuugagcccagagcuuccugccucugcccuguuuucaguggguacuccaauuaccuucacuucagccccugaugcuccuggcaugagcucagcaauuuuucucagguugaucccccgggucagguucaucuuccgagaaugaaucuucaaaauguccagccgggccuggagauggcaaggaaaagccugagccccacaccccacccccacagccagagccacuuugcacaguguccaucacaaaccuccucauuggggggugggaauucaauuuuucugucaaugcgcccugggcgaagcagugccgaguccaggauaucaauccuauuaguagccaugauaaccugagcagagaaagcaaguggggaucagcuaaaccucuuccucagccugcguggcacccaggccuucccugggcccaucccaaggaugcuaccaccuuaccuugauguucuugguggccucaaagccgucgagcugguugagcaacuccagcaucgugcgcugcacuucacuguccccuccagaaccccccuccagccgcgaggagccgauggagucgauuucguccaugaagaugauagauggagcauguucccgugccaugacaaacagcucccucaccauucuugccccuguguggaggccgagcugguguuagggagcuuauuagcuuauuagcucucuaacccccuaccccuaccucuugcuucucacauugcuagccaugguuaccuuccccuaugaauuucuguaccaguucagagccagagacacgaauaaagguacaguccguaugaugagccacagcccgggccaacagugucuucccagugccuggagguccauacagcagcacucccuacaggggaacagcaggacucagggcagaaagcuacaccccucauuucauucagugaacauuuaccgagugcugggucccuugcuagauguuagggauacaaaaaaaaaaaaggaacaucaaggucccuucuauccaaaccaccucaccgcccuaggaacacuuccccagccacucuuuucagggggagggccagcccaagcaagaugcagccuaucccggugccuccccaaccccugcaguagggcuggcuggggcaggaggaguaaguacagcuuggcccucucagagaagcccugcuccucaccuugggcugagcaaugcccagugcuucgaagagcucaggaugcuuaacaggcagcucgaucacuucuuugaucuccuugaucuguuuguccaguccaccaaucaucucauaaguugaaucugguacuuucuccaccaucaucagugacacuaaugggucuaccuuguugggcaggaucuugugcagaguguagcugucauuccuuagagccacccggcaauugggugucaccugggugaagggggcgaguuucagaagugguacaguaagagcugaccccaccaccaccaccaccucaccugcuacacucacaucauugaugucaauguuuuuguccacgucuacaacaaauuuaccuucaggauguaccuaaagaaacaagggcucaugaccuuccuugacagccaccaaaucacuaauccuacccaggaagaccuaugagaaucccacaauaccuugacagaacacagaacccugucucccgaggcuacacacaaaggggugggaaugcaguggagaccgagcuggucccuggggucaugcugcuuuuaccuugaccaacacuuucuucuuauccauggcccggacuacuucccccacauaggagcccugcuccugcagcagcuguagcuccucccgcaauaggcgaacuagauggcaaacagacacaguggucaccuagcuacuccuuuggagucuccaggacccaauucuacgugcaugagcuaagcaucacucuuauuaaaggaaggccaaaggucaaaauucauguauuuaaggaggcuacaauagggcucaggaaaaagagaugcaugugaaacuacuagaugaugacagggagaaaacaguaagcacugcugugaagacacagugcagggagauaaggacagaccucagacaaacugcccacaugcggcuucccaucuuucuccacucaccuuuagcauuuaguucguuccucugugccugcagccuccggagguuuuggcucuuaucauucacaaucagcuguggcagacaagagacaaauuccauuauucaagggcaggagacaggaggagguaggaucuuggccaagaccucacaggucugaaugagcugagggaagggcacagggcaccugcauguuguuucagauucuccaguaugauccuaaugacccugcccuguccuucaagagucccucuggaccuuacagcagccaucaaagaaggcugcuuguccaauacugguccaggaguaacagaaucuaauggagaaaaguuacagcuggcucauguaacaccaaauuucuugcaggaaggcaacaacaccugguggaaagauuguuaggugagaaaccugaguucuagcccagccgcugucaaucaaaagcaaaguaaagguaagacaaucuauuuuuaaaaaucuagaucuguuaccaaacggcacauggguauagcaucagcuacccugcuucaagacuacuaaggugaacgaauaaaaacacaugaaaaagcauucaaaaaugguaaacuaaacauaauaccugcaaaugcacuuggaauucagaauugucuuuuguggcuuucccccauccaauuuauauuacaguugacacuugaacaacgcaggggguuagggugaaauugaaaauccauggaccuguccaaaguuaaacuacuaacagccuaccguaacaguauaacguaacacuaacagacuacuguuuauguugucuguaaggcuuacuacuggaagccauaccuuacugcuggaagccuuacugguaacacaaacauuugauuaacaacauaaacgguccuuuuucuaugguuuagcgcuuuaggcuagggcucuggguugcccaauuucuuucauucagucucuauggaauuagcauuguccagaucccucaaugaugcccuuccucacauucucacuucacccucacccaaccucuuggugauaaauuucaacuccugagcuuauguuucccuuuuauaagaauccuuuucauucgggcuucuuccaaaaggguugaccuuuggcuagagguaccuuuacuauuaagauuugacucgaagauguguaacaaacugugaacacuaagacccucaaagagaugggacuggaggagaacaagagauugcuuacuucugauacauacacccuacuagcuaagaaacaaacaagaaaggagaagcagcagcuucuuccacugcacucccaaaggaauuagauggauuuguggaaguccguuuccaucccccaucaucacccuuccuagcucccucuggaguccguccucaccuggaguucuucaaucuuggacagauaauauuggcggaguccgcugccugccuuccccuccuccagcuccaucugaagacacagagugagucuuaaacgacagguuaaacauccgaggggguaaagccacuugcagggcacuuugaauaaggcuugacaccagguagcuuugcguaguagaaaaaguuuggacuucggaggcucaggaucuggguucuaaucccucccucccuuggaacccuccauuuucccaggacuaaaauaaaagaaugggaacgccgccuaccucauacgacuuuuaggaggaccgagaggcgauaugauauagacggggggcgcuuugcacugcgugaagugcucuacaagcccgaggugucaguacugacgaaggagccagcggaacggagccaaaggacuggcgucccgucuccugcgacccgugggccggccauucccgcgcccaucgcuucccucacucacuccgcuucuaccgcgucuuccucucccagccuugcccugacucacc

SEQ ID NO: 192316 - RNA, 10307 nt, Homo sapiens
gaugccguggaaagcagauacucuguaaguacacauuucauauacauuauauuuaaaaguacuccacugaacagugaaauauuuccagacucacccacguccugcauucacaugaauucuuccccgcucccuagucuguuucagaccagaagcccugggcuucucugacuagccuuggccaguucugauuucgaauauucucuccugcaauuuccaucauuacaucucagcccacacgugaagggauugggacucuggggugcuuagcgccaaacaagcaaagcacacauuucguuuaacgccaaagucuaggcucuggaagugaggcagaucuaggguguaugcuuggaggaguggagcagcugacagcucauugcaauuuagccgauucuaauuacccccuacacaccaggccaucagcugcaggagacacccaagcuucuugaccucaguucaccuucugaugagggaaucagacaugugaucacuuaucauaaagcaaagugagcuaugccagagccuaugggaacacagaacagagaccuagcuaguggccucuuccccaaggaaucauuuggaaugggccaugaagaaugaauggagugauggcagcauugagggagaaagaucagcaggagcacaagggugagggaugaccaguuucaagcagugugggaugggaaaagaagagugugacagugacaagugacgggagaaagauaagucagggcuuaaauccaaaggauuuacaugccuuguuaagaagcuucauucuguaggaaauggaguuaggaaucugcuauuuggcagaugggaggguuuaugaaagacacagaggcccacguucaacuuuugcaaagacgugucuuccaaucccaaccuuuuugugagcuacccagcaaugcaggaguuaacugggcagcuaauaucugaagaaaugaggcauuugccgcauaaacuucuuuuaggucugggaagaacuuucagcaagauuucugguagcucuuccagugggccccuggcuuccuuuguuuugcccaugucuggacucuuguaaaacagagcucauuaugccuuugacagacaggaagccacugacauucuuuuuauggaagaaagcuaugaauuuaaggaaaagaggaaugaaaugaaugguuguuuuuuuuccuagccaaaacccacucagacuccugaaaucagagacuaucgugucacugggacaaggagcccaauuuacagaugaggaaacugaggccugcacugguagaauagcgugucuggggucaccuggauggcuaauagagugaggaacagagcccaggccucuauacucugcggccaguccucugucacgacagagacucccuccaagaugugaaguugcugucccagcaauaauggcuuugagagaguggaaaaugaggucuuugcucccugggcagugcgggacacagauguguucuccugaagcgauaaacauggcuggguccacccaaaacacccuguaggaccaacuuauuuacuuugucuuggauccaaagggugucucuggacaaaggcuuggagcuccaggccagacagaacuuuacccagaagcuggcccuugggccucaaagucugcucccaggaugguucugagagcucacccaugacugguccuguccccccagaaaaaagaauagagucauuugaugggagcacaggguuuccagccguugggaaaggaauuuugaaccuuuaagcaaauggguuuuguuuauaaaagaagcagguauagcuucccuaauaaucagcuggugugggucaggagaaaauuaauugaauugcccaguggggaaaugggaggagauuuccuuccugaaaucaaaccuggcgaucauucccaguuguuuaauggccguugccucugaaaacauuggaggaaauaucuuaacaaugagauagccacguagccaaagacuaauuugguauuguuugacuugcuucaauggcacauucugacuucauuuuuccucugccauuuuuaccuuguuuauaaauuguguguguggccgacgcagacagauagcauggaagagaacacccuguacuuaaaugaaaggggugaaucuggacuugugagagucuugggaucuuggaaaggacccugccuucuuacagaaagaaaggcaauuggcagcuauagcucgccuccccccuuccuggaggccaggaggcagcugggcuacaguggaaacuguccaggugcuaggaucaggggaugggaggggagcuccagcuuuccagcugucuuuugggugagccugucuuccucaagcucaagcuuccuuaucuauaaaguggagauggugaugacaaugaugauaagagcaaccuauuaggauuuuaaggaugaaaugagcaacugcaaccaccauauaaaagcugcaagcugcaaaccaccauauaaaagcugguugaucucaagcucuuuucaucacuugggcaauaguagguguggaugggggacuuaacuugauuuggccaugaaaugacccugccacauauggagaauguagcaguugcuuacccaaggcauaggauucaaccaaggccaggcuuugacuuaggaaucagagacccacauuaacacuugacuucccacuucuuagccaugucaccaugggcaaauuucuuggccucucaagaccucuacuuccuaaucuguaaacugggaaucauaaacucccucacuugguuguugcaaggguugaaugagcaccuggcauagaccuggucuauugcaagugcccacaggagcacuuuguagaagcaggaacuagagaucccaggguguguugaaaucaaaaugaccuuugagggagaccacaccauauuccggguacaaggcagggcgauuucacaacugcacuuggguggcugauggcuggcuucugauuuaagcacagcaagcccagaccuuggaugugagcguguuaaccuuuacuucaaaaucccuaaggcccuguugauuguggcccagcccuuccugucuguggcuuugguucugcaauggugccccaggcauuggcugcccccacagagagagagcggaggugucuggggagggacuuggucuggggcccacagaaaggcuggacaccagagucaugucucccccauccaggcagagcagaggaaauagggcaggguggcugccggcgcuggcaggccuccagccucuggggccagcacggcuugcuuggcccacuugcauggggcucuccuggcagaggaggggccagagccuuggcuuucuaguuggggcaccucggcccugcauccuguuccccaaggguccuuggacccagcagggcugaaacaaaauggagacacuaucccagcucacccucaggaagccagccaggcuggcuguggaggucccaagacccugggucauccuccaucuccagcuucugccuugcugaguuccaccugcagcagaguguccugugcacauggaggguccagaauaguggacuuaggugcugccugcucuucagggcccacuguugcccagggccccccucuacucugguaucucccagcaggcccugcucuuuuucccuccaagggcuccuuccauuugucaaaauccaaucuuuaggcugacuccagaguugcuucugugaaucccccacugcccagcccagagcccucucagugccucugaaccccuucugcaguuuguugagaccucuuauaccuucuacuucauagugguguuguuuaucaauaauugauacaauauaaaauucuuggggacagcuucuugcauccccagcauagagaacagugugggucagauaaggguccaggcacugauagguggauaggugacacaaauaccauuugaagcuguuaaagagcacuacaggauggcagaaggaauccaggaauccuuuuguggguguuuuuuugcuuuuuuuguuuguuuguguguuuuuugagaugaagucucacucuaucacccaggcuggagugcaggggugcuauuucagcucacugcaaccuccaucucccagacucaagugauccucccaccucagccuccugaguagcugggacuacaggugcacaccaccauguaugccuaauucuuugcauuuuugauagagauggggcuucgccauguugcccaggcuguucuggaacuccuaaacucaggggauccacccaccuuggccucccaaagugcugggauuacagggaugagcuaccaugcccagccaggaauccuuuuuuuuaauugucauaaaauauacauaauauuaaauuuaccauuuucuuuuuuuuugagacggagucuugcucugucgcccagguuggagugcaguggcgcaaucuuggcucacugcaagcuccgccucccggguucacgccauucuccugccucagccucccgaguggcugggacuacaggcacacgccaccacgcccggcuaauuuuuguauuuuucaguagagacaagguuucacuauguuggccaggcuggucuugaacuccugaccucaugauccacccgccucggccucccaaaguguugggauuacaggcgugagccacugcgcccgcccggcaaauucaccauuuuccaguguauacuuaaccauuuuaaaguguauaauucaguugcauuagguccguucacauugcugugcaaccaccaccacuauccaucuccagagcuuuuucuuuuuaagugaaagcaaguuuauuagagaaguaaagaaacaaaagaauggcuacuccauaggcagagcagccacugaaacacuguacccauuaaacacuaacuccccauugccccuccagcaaccccuagcaaccacugucuacuuucugucucuaugaauuugacuauuugagguacaucacauaaguggaaucauauauuuguccuuucaugucugccuuauuucauuuagcauaacguuuucaagguuuuccuguguugaaaauauaucagaauuucauucucuuuuuaagguagaaucauaucauuuuaaaacauuucaguuggaccaucuaaguucaguccuucauuuucaaaauuaaaaaacaggccucaaacggguacaucucacguuagcuagagacagaacuggagcuagaagucagaucucuuacaaaguugccuuucuucuucuguggguaaguggggcacccuugggacgcugugcugggcguacaugggugcuugaugaaguuacuugguggacugaugugauugauguccaacauguaugcagggacagaggcuauggucccuacagagcaggcauggagagaaggagaaauacauacgggcaggagccaggagagggaggguguagugagcagagaccgcgccacugcacuccagccugagugacagagugagaauccaucuaaaaaaaauugcuugcuaaagaaguggucuccugaggucuuaagacguuccugacaaugucuugagugggugggagagaggcugcagucauugugcuguggaauuucagaggugagaaccacaccuaaccaaaauuacuuucccuguuugccucagugacacagcugcaggaacccugguggguguuguauuaaguaaauuugaccuuuauucuuugcagaucugugaaauguugucuucugaggggccacguguaucuguagugcugaggacuccuugggccucugaagucacagagagaacccugcagggugggggaccagugugugacagcccugcuuugcauuuucuuugagaagugcugucauuuugcauuucucuccaccagggcaaucuucaaucuugagaggugugaucauaacuugccuuguuucuugucgcuacagagaacggaaggcucccuugauggaacuuagacagcaaggccagaugcacaucccuggaaggacauccauguuccgagaagaacagauaaucccuguauuucaagaccucugugcacuuauuuaugaaccugcccugcucccacagaacacagcaauuccucaggcuaagcugccgguucuuaaauccauccugcuaaguuaauguuggguagaaagagauacagaggggcuguugaauuucccacauacccuccuuccaccaaguuggaacauccuuggaaauuggaagagcacaagaggagauccagggcaaggccauugggauauucugaaacuugaauauuuuguuuugugcagagauaaagaccuuuuccaugcacccucauacacagaaaccaauuuucuuuuuuauacucaaucauuucuagcgcauggccugguuagaggcugguuuuuucucuuuuccuuugguccuucaaaggcuuguaguuuuggcuaguccuuguucuuuggaaauacacagugcugaccagacagccucccccuguccccucuaugaccucgcccuccacaaaugggaaaaccagacuacuugggagcaccgccugugaaauaccaaccugaagacaccguucauucaggcaacgcacaaaacagaaaaugaagguggaacaagcacagauguucuucaacuguuuuugucuacacucuuucucuuuuccucuaccaugcugaaggcugaaagacaggaagauggugccaucagcaaauauuauucuuaauugaaaacuugaaauguguauguuucuuacuaauuuuuaaaaauguauuccuugccagggcaggcaagguggcucacgccuguaaucccagcacuucaggaggcugaggugggcggaucaccugaggucaggaguuugagaccagccugaugaaacccugucucuacuaaaaauacaagaauuagccgggcgugguggcgcaugccuguaguaucagcuacucaagaggcugaggugagauuaucgcuugaacccaggaaacggagguuguagugagcggagaucgcgccacugcacuccagccugagugacagagugagaauccaucucaaaaaaaacaaaaaacaaaauugcuugcuaaagaaguggucuccugaggucuuaagacauuccugacagugucuugagugggugggagagaggcugcugucauugcgcuguggaauuucacagaugagaaccacgccuagccaaaaucacuuuuccuguuugccucagugacacagcugcagggacccucguggauguuguauuaaauaaauuugaccuuugcucuuugcagaucugugaaauguugucuucugaggggccacaugcaucuauagugcugaggacuccuugggccucugaagucacagagagaaccgagcaggucuauguuuuuguuuuguuguuuugagacggagauucgcucuuguugcccgggcuggacugcagcggcgcaaccucugcucacugcaaccuccgccuccuggguucaagcaguucuccugucucagccucccgaguagcugggauuacaggcacaugucaccacgccuggcuaauuuuuguauuuuuaguagagaugggguuucaccacguuggccaggcugaucucgaaugccugaccuuuggugaucugcccgccuuguccucaugugugcuccacaggccuuuggguugggauugcaggcgugagccaccaugcccagccuagacucuuuugacaauaugaugaaagcuguugguuccuuuccccaacacacacacaccgaguuguaucacgaaaaugucauacaauuuccagguuuucugaguggugggcucagauugaggucaaaggaucagacgaccucuaacgaccuucaugucucuguugaugaucuggggacagccagauccccuguguccagggaguuccuuagucccuugccaccaccagagaagggcaauugccacgggagcugcaaagacccuauuccuacuccuggugccuuacuuaugcagcacgacugaauuuuuuguuuuguuuuguuuuguugagacaggggcuugcucuguugcccaggcuggagugcaguggcacaacaauggcucaccgcagccucgaaccccugggcucaagcgauccucccaucucagcuuccuggguagcugggaccagaggcgugagccgccauagcuggcuaauuuuuaauuuuuuuuuugcagagaugagguuucaccauggugcccaggcuggucucgaacuucugggcucaagugauccucccuccuuggccucgcaaagugcugggauugcaggcaugagccaccgcccccggccuguggagcacacaugaguuuaaaauuacuuucccuucugccuauauuuccgaggaggaaacuucaugcgcagggaucuuucuuaguggauuuaauggcuaaaaggucugucugaauccaggacgcuggcuuuagccuuccucggcagcugccguaaccccggugucuaaaccugaagcaucccaggagcacccacuccaggaguuuucucggccgcggaacucauuaguuagagcgcccucuuguguucucaugugguaaucggucacugaaggacuuaaaaugguccuuagccaacacacaguaaaacuuuucccucuucugaccccaagaggucagccacccauuucaugagcauauacuggucgccccaucagcguucucugauuggcuaacugaacccacuccccgaccuagacucaagacaggcgaagugacgcuuaggucaacauucacucacuaaagcaacgacugucgggcgauuuugucucccgcugguuuuggaauggugucuggagacauuuuugguugucacagcugggugggugugcucccggcaucugguggguagaaaccaagcaugcuccuaaacauccuacaggcacagaaccgucucccacgaccaagcaugaucaagucccaaaugccaauaauggccagguugagaaacucugcacagaagcauccaguuauuugucuguuugcucaacaagcuugugcucaucaugcucuguguuccugacgcugugcuggguguuggcggugggaagauuacaagagucacauggcagcuguccuccuggaagguacaacccaguagagaugcagacuaacagagagccaauuacaaagcagugugacaagcgucaugguggaaaauuaaaagcucaaacaagggcacaugggaggggcuuccaacacagacuuugggggauccaggaaggucuaagaggaaagugggucucaccaaagccuugaccauaggcagaggguaccaguggaaaagguggggugaagaacauugaggacaaaaggaagaagugcaggaaggcccugaggcaagggaguggggggugcccuggagggauggcagcagggcagucugucagacccaaguggccuccagcccuagaagccaauuaguccuccucaaaaagcugucacuguccccuaagaauugcugccaggcucccacuggccugacucagucuuugagagucuuaaggaggaggucucugaaagguacacaccaagaacucuccccagcacagcuguuuuuaagacucuccaccagcgucauuggcguguugggaagaaacccucugccacagaggccagcuucagccuuugccuaacaccgcaagggcaaauggaaagguaaacgggaaggagaugucuccccagcaggcuauuugaggacagucuucccugcagaagaucucaaccugggguccacagaguggaaauguuagaguagggagcuaggcaaacaugagcaggacaggugagggcccccacaggaaugucaggcuaccaucaggugauggucaggugguuguuaaacugucucuguaaaauaauaauugguugcagccagcuccaagcaaggacagucucucaauagauacaaaacacccugaucuggugaucagccgcuucccgauaagaucucaggagcugggcaagcagccuggagcaugcgcaccaagaggcaaaauggcggaauuuaaccaguauaugaccuaccuuccucugggaacgcacgacugguaaggggaaaaaugccucaagugagcaugcgcgcaacuucaguaaucacacugugcaugcgaccccuuccaagugcuggcaggucaccacauacgcggacagccugcugcaagggaagaaucaggggagaugagacguaaaucccagaacuaugccaaauacauaaaaccccaaguuaagggucaggcagggcacuuagaucucucaaguugccugccugacccaaguguaguguacuuccuuuuguuccugcucuaaaacuuuuuaauaaacucucacuccugcucuaa

SEQ ID NO: 192317 - RNA, 26206 nt, Homo sapiens
aaaauggcagcgcuggaggaagaauucacguugucuucgguaguccugagcgccgggccugaaggacuccuaggcguggagcagagcgacaaaacagaccaguuucuagugacagacagcggcaggacagucauccucuauaaggugaaggcaauagguuugggagcgccccgacugccuucucgccccuuucugagcgcggagcucgagcucaaguuucucacagcuucagaaagagaucguggagaaggcuuagcagagagccggcugggccuguuggggacgcugagugaggucuggaaucuggcuugcuugccuuccuguaaaggcauauuuccgacuugcaggggcagagcgucugagugcacguggguuagacucggaaaagaaagaaaaccugugcuuuugcuucggaacucgcggaauuggccuugcuaagauucccuccuagggucuuuauuaucuuagccgcccgcgggaggauggaacggagauugguugggcgggagaggaugacacugacagagugggaauagugguuuagccgugucuacacuucacaccccucucuuuguaggggcggggacaauuuuagagagugagggacuuucuugauagcucgcuaagaaucuugccuccaagugaguugucuguuggcaucucugauucacgcugggaauccuggaguugaguccugggaaaaucugcaagcccugcccccauuucagccuaaagccugauagagaacacuuucuaaccuugcuuuugguggucgcauagaaagcaguuacuuuucucugggcugcugaacauaguuuuccauguuuuaaagaaguuagguaucugcuuugacguuuugagaacagguugcuaacagcucccugugccguuuugacucugcuaacucuauuggguuucacuugggaugucaaguagauuugcaguuuugcagcuccugcauaggaauacaauggcagauuggaauuggauagacaugaucccagaugucccuacuuaauuucccaugccgcuguucagaggcauaacuucccaugcagaggcauaauauaaucaauuuuuaaauguacuauuguuuuuuuaacaaaggguugcuuauuuacuuauuuaggaacuuaguuauauuuucauuuuaacuacccuuuuagagguuuggccggacgcggugguucacgccuguaaucccagaacuucgggaggcccagguggguggaucacuugaggucaggaguucgagaccagccuggccaacauggugaaauccugucucugcuaaaaauacaaaaauuagccgaacguggugaggugcgcuuguaauuccagagguuugggaggccgagguggguggagcgcaguggcacgaucucggcccacugcaaccuccaccucccgaguuaaagcgauucugcugccucagccuccugaguaauugggguuacaggcgcacgccaccacgcccggcuaauuuuuguguuuuuaguagagacaggguuucaccauguuggucaagcuggucucgaacuccugaccucgugauuugcccaccuugaccucucaaaaugcugggauuacaggcgugagccacugcccucggccaguaaauuuuuuaaaugcugucauuuuaaugguuucuuuuauugauuauaaacuuaauugcuuuuaauguuugaaguugacuucuugaauauuguauuuaucuuaauuucauuagguuucugaucagaaacccuuggggagcuggucagugaaacaaggucaaauuauaacauguccagcugugugcaacuuucaaacuggagaguauguuguuguacacgauaauaaggugaguuuuaaaacuuuuguauaauauauacaauauaaauguugauuauuaacuauuuguauuuauuauauguaaauggagaauaggauaguuuuuaacuaguauguuuugauuuaagguuuuaagaauauggaauaaugaagauguaaaccuggauaaaguauuuaaagcuacaguaagucuuugaauuuuccaacauauuuguuuagcuuauuggugaauuagaaucauucauaauaaaguauguguuauuuauuuuaauaccucugggaaaauaagcauaagguccuaaucagguuuucauucuaauuaucuuacaauguaucuugguaacaugucuccaugaguuaaggagaugaggauuuauauaauugaugaaugagaaauuuauacuuauuuccaugaguuuggauguuuggagugugucuuuugugagagcaaaaugaacuucugugcccuuucuuagaauagguagaauagacccugcaaguuucguguauugguguauuguacuuuuuuuuuuuuuuuuuugagacggaguuucgcucuugucccccaggcuggaguggaauggcucgaucucgacucacugcaaccuccgccuccuggguucaagcgauucuccugccucagccucccgaguagcugggauuacaggcaugcaccaccauguccagcuaauuuuguauuuuuaauagagacaggguuucaccauguuggccaggcuggucuugaacuccugaccucagaugauccacccaccucagccucccaaagugcugggauuacaggcaugagccacugcgccuggcccauguauuguacauuuugaagaguggcacauaauacaguaaaaaauaaaauaaaaacaugacuagcugugcauguucuacugaugaccuagaguguguucauuuuuucuuacuuauaaaaugaggaucuuaaacuagguuaaucuugaaaguucuuuccaguucuaaaugucuaaauauaauuggcacauuuuagaaguggcucacaauaggguuaauucagauauaaugcaguuguugccuggauccuugaaacuucuagcuagcuagcugugcuguucccuggcuccauucuuuucauuuaccuugaaauucauaacacaauccugaauuuuaaacaguggggguuuuuuuguuguuuuccucacacacgguguuaacuucuuuuucuggaauugcaggcuguaguuacaauuguggcauuaguuuuuaucuaacaccagaauugcauguaccucugcaugaauggcuuaucuguaucuuucccaguuuuaagaaacccagguuuuagccuaaccucuaguagucacaacggguaaaccaaaaaugaauuuacagauuaaagcagggacuagguagagaggauaagagaaaaaguuaagacuucuaaauguguuuuguguuguagguuagauuuuggaaccauacauaauuauaaagcaaaauuaauucaaaaugaaaauaaagcagucacuuaaaaagaagccuucucuaaauauccuuauauuagguauaaauuguuuuagaauaaaaauuaaaauuuuuuauguucuuccaguugucagcagaaguauauaggauacuuucagugcaagggacagaacccuuggugcucuucaaggaaggugcuguucgugguuuagaggccuugcuugcagacccccagcagaaaauugaaacuguuaucucugaugaagaagugauuaaguaaguuccaguacuuguaaguaaauuuaucaaaauaaaaaugcacugaacauuuuuuugccuuguucaaaaguauuuugguuauaaacauaaugaaaguaaccuaauuaaaaaucacuuacaaaacacugacuaaaacaacauccuaaaaagccucugggcaugaagauugaagaaaccauagagucauaugaagucuugacagaacuggauacuuaguuauuugaggaugaaauguguuaucccaaaagaccaaaaucuuuuuguuccucucauauugcccugacuaccaagcucccauccuuguccccuggcuaaaagugcaucguguuagugaaaucaugaugcauuaagaccucugcuuucccagauucugaaauaaaacuggaaaaaugacucaucaagggauagaaggacacuucaugauuccacaucuuucugauacucuuuauuucaucacauuuccuguucauuuuacuuguuuucuccagguccaccugguagaaacuaauuuucuaaaagucagagugaagacugguacuuacaacguggccaauaaccaguuauauauuagacugaccugaugaaucccucuaaggugugagcaacuguugugagggaaauccuuggaggauuugaguucuaguugcugcuuugccacaaacugugcagccaguaacuucucuaugccucagcuuccucuauauugagaucuuaauguuuuccucagaacacgagucccaaaaguaacucugaagaaaaugagguaggggagucaauuuaaguuugggaagcacugcaucuccccucuuagaacuuuaaaauucacauuaucaucuggggaguucaauaaccugcauuuaauccagagcugcauuugacaaaugcguauugcuugugguauauguuucaaaacgcccaauuaaguguucucugaugucuuucugguucuaaaaaauauuuaaugaaaacuuugauuaaauuuugauugauaugugucucccagcuggugauuuuugcauccuauaauuuuucuuuuuucuuuuuuuguagauggacaaaguuuuucguaguauucagacauccuguuuuaauuuuuauuacugaaaaaguaagugauaucuucaauuccuggcccauuuugugaaauuucuuuaaaaaaaaaaaauuuauuuagagacaggguguugcccugucacccaggcuugagagcaguggugccacgaugguucacugcagccucaaccuccuggcucaagcaguccucccacuucagccugccgaguugccucguagcugggacuacaggcaugcacuaccauccuggcuuauguuuuauuuuuuguagagacagggucucacuguauugcucaggcuggucucgaacuccuugggcugaagggauccuccugccuuggccuuucaaaguccuggaauuacaggugugagccacugugcccagcugugaaauuucaaaacuuuuuuuuuuuuuuuuuuuuuuuugagauagaguuucguucuuguugcccagccuggagagcaauggugcgaucucagcccaccgcagccuccuccucccggguucaagugauucuccugccucagccucccgaguagcugggauuacaggcaugcaccaccacgcccagcuaauuuuguauuuuuaguagagacgggguuucuccauguuggucaggcuggucuugaacucccaaccucaggugauccacccaccucagccucccaaagugcugggauuacaggcgugagccacugcgccuggcgcaaaaccauuauuuuuuaaacuaaaaugugacuucguuauucucucagaagaucucuaauuuuuuuuuuuuuuuuuuuuuuuuuuuuuuuuuuuuugagacgauucucccucugucacccagguuggaguacaguggcacaaucucggcucacugcaaccucugccuccuggguucaagcgauucuccugucucagccucccaaguagcugggacuacaggcgcccaccacuacuccuggcuaauuuuuguauuuuuaguagagacaggguuuugccauauuggucaggcuggucucgaacuccugaccuugugauccaccgacugcggccucccaaagugcugguauuacaggugugaaccaccaagcccagccucuaacuuuuuuaugaccuuuuaaauuuaaggcuggguguggugaccucaucucuauuaaaaaaaaaaaaauaguguagcaugguaacacacaccuguauucccagauauuugggaggccgaggugggaggauugcuugagccugggagguggagguugcaaugagcugagaucacaccacgguagcccagccugggccacagagcaagacccugucucaaaacaaacaaauuugauagcauaagauguuuuuaaguacucauugauguaaguagaauggggugacaacuucugguuuuaacauauguuaaaauacuugguugaaaugggaauauuuauaaaauaaccuuuuuuuuuugcagcauggaaauuacuuugcuuacgugcaaauguuuaacucacguaucuuaaccaaauauacacucuuacuuggacaagacgaaaacucuguuauaaagaguuuuacugcaucuguagaucggaaauucaucucuuugaugucauuaaguaaguuuucuuucuuuaaacuuucagagauuauaaauagaggauuguuauaggauaguguauguuuuugaaucguagacuuugugaagcauucaguuacagccauuucugugcuucuuuacagcguucaugccuucacuuuuuuuuuuuuuuuuuuugagacagagucucgcucugucgcccaggcuggaaugcaguggcacaaccucugcucacugcaaccucugccucccagagucaaacaauucuccugccucagccuccugaguagcugggauuacaggcgcccacccccacaucuggcucauuuuuguauuuuuaguagagacgguuucgccauguuggucaggcuggucuccaacuccugaccucagguaauccacccgccuuggccucccaaagcgcugggauuacaggugugagucaccucgugcggcccaugccuuugcuuuuuguacuuugcaugucuggccaugcauuagaucagugauccuguguuuugagggccuauugaaguacuuuagauacagcauccuuuucuaacauugcuucuuuauauuuuaugucuuaaaauuuaccauaagcuggccgggcauuguucacgccuguaaucgcagcacuuugggaggcugaggugggcagaucacaaggucaggagaucgagaccauccuggcuaacauggugaaaccccgucucuacuaaaaauacaaaaaauuagccaggcaugguggcgggugccuguaaucccagcuacucuggaggcugaggcaggagaauggugugaacccaggaggcggagcuugcagugagcugagaucgugccaguacacugcagccugggggacagagcgagacucgagacucgucucaacaaaacaaaacaaaaaaauuuaccauaagcaauaaguaacaauguuaauaccagugaaaaagagaaaucacuuuuuagcugauaaggcccagguucuuugaguguaauuagugaaacauaaacugucuaugcuuggcauugaauggccccucugcuccuuuuuuccaaccauuagauuuaguaugcccuuccuugaauagcaacugagacagaugggcaaaaggagacuaacagcagcuuuggcccaugccaguugcuuuuuauuauagauuguaauaccuuuaugaaauggucuaaaguauaaccccagucuuaggccucuagggcggggaagaaaaaaaaaagucuuugugguacccucuccccuccacccuucauggcugcuuuugaaguuguucugagaaggugaaggagaaguaaacaagagcaauacauaggaaacauuuccauauuaucacaauuaaaaaucuuugugaaguuuuucagugugcaaauguuugcgguggcuauuuuuuaaaaggcuccuaucauuuucauaucuugggggcuauuggaauguacuuaauguuuagcuuaaugaacuuugaagugaggaagugugcaccaaaggguuauauaaaucuuuacguaacaauugcuagaaccacaugaaacugccgaaauucaguuggcccacaagaaagagcaauuucauaagguuuucagggugaugagguaggaagaauuauaauaaacuaagcacacuggcucacaccuguaaucccgguacuuugggagaccaaggcaggaggaucauuugagcccaggaguuggagaccagccugggcaacauagcgagacccuaugucuaaaagaaaauuuuuuuuaauuagcugggugagguuugugcaccuguaguccccgcuauuugggaggcugaggugaaagauagaucacuugagcccaguagguugaggcuacagugagcugugaucacaccacugcacuguagucuugggccacagagugagacccugucucaaaaaaacaaacaagaaagaaagguaacguauagaccagaugcuaauuacuuucuaaugagggauauauccuuuuagggacuagaugaucuauauucuugggagucccccucaauauuuuaaguuauugcagguauuuacaguuuguauuucuugacuauuacauuucuuacugagauuuuuauuaauaguacuucuuuccccaguuuaaauuugugguacucuuuaagagaaagcacagugaugggauuguuuauuuuucugguuggcuguuuuaucaaauugguaaaaucuuauaaacaaccuaguacauuuaacuguaauagauauagaaguauccuucaauaaccaacaacaaaugcuuguuuccaacaggcucugaugguuguauauaugaaaccuugauaccaauacguccagcugacccagaaaaaaaucagagcuuaguuaaaucacugcugcucaaggcuguuguaucugguaacgcucgaaauggaguugcacucacugcccuggaucaggaucacgucgcaguccuaggaaguccacuagcagcuucuaaggguaacugacauccaauucauuaagaaggccuuuguauguuuccuucacgguguaccuuuuagucuuccuuuucuuuuucauuucguuauuacccagacuaauucauucucuuuaucagcauacucaauuuuuuuugugccuuccuaauucuucuugaauugguuuuuauuuuuauuuugcauugaucuuucaaaaacacuucuugcuaucaccaccaugcucauaacuaugucauaaagaaauaaaaauggcgaauauacuagucaccaucauacuagccugcagguauuugaaacauuaguaagccuacauuugaggauuggauucuuggcaacauuucacaucauggaaauccacuggacaugaacaccuugaaaugugggaacuaauaguguaccuuuggacuccgugacuucugaacaggauucucaucgccaccuugccuccuuacccaccaacuccccgccagacuuccuagucagucaugaagaacacgauugcuccuugccagugcaggauagcagaccccagccuucacuagaaaacucagacucugucguuuagcauaagucccuucacagccuagaccuguccaccuuuuccaaccuuuucucccaaauucugagcaagaacccucugcuuuauucaggcagugcucucuauugaccacacauuugauaugcccauccucaccuguguacuuuguucuguguuucuccugcuuauuauuaacauaggagcaaggcucaaugccuauaaucccagcacuuugggaggccuaggcaggcagaucaccugaggggagcucgagccagccugaccaacauggagaaaccccgucucuauuaaaaauacaaaauuagcugggugugguggcgcaugccuguaaucccagcuacucagggggcugaggcaggaggaucgcuugaaccugggagguggaggucgcagugagccaagaucacaccauugcacuccagccugggcaacaagagcgaaacuccgucucaaaaaaaaaaaagauaggagcuccugccaggcacaguggcucacgccuguaaucccagcaccuggggaggcugagacaggcagauugcuugaggccaggaguucgagaccagcuuggccaacauggugaaacuccaugucucuaccaaaaauacaaaaaaucaccugggcuuuuuggcgcacaaacccagaagguggagguugcagugagccgagauugcacuaugcacucaaccuggucaacagagugagacuuugucucaaaaaaaaaaaaaaaaaaaaaaaaagagcuccugguuauaguauaacuauaccaugugcgagccgggcacaguagcucaugccuguaaucccagcacuuugggaggccaagacgggcugaucacaaggucagcagaucaagaccauccuggcuaacauggugaaaccccgucuccacuaaaaauacaaaaaauuagccgggugugguggugggcaccugcagucccagcuacucgggaggcugaggcaggagaauggcgugagccugggaggcagagcuugcagugagcugagaucacaccacugcacuccagccugggggacagagcaagacuccgucucagaaaauaaauaaauaaauaaauaaaauaacuaccaugugccuggcacuuuacuaagauuaucucauuauuuguaucauuuaguccucuaccauuuaggaggaaauaaaguuguuacuaucccccuuuacaaaacaggaaacugagguaugagguaacuaaguaguggaacuaggauucaacccgaacaggugaacucuguuaagccauguacccugccgcucuuaaguccuggcucuugaccacuucacuaagcugugcuucuccucucucuucucccaucuuccucucuuucuuauuucugcucuaccucccugccaaaaaaacccgguggcuacuauagaguuuccugugucucuuccuaugguuuuuuuuugguccauauacaagcaaauacuacuacuuaagggguuuuuuccccuccucguuuaacacaaaugguagcacaccaugcauacuguuguguaccuuguuuauucaccuacccaagaucucucagagaucauuccauauaauauuauuuguuaaucuuccuugcuuuuugaauagcuguguaauauuucaccgaaggguggccccacagugugcuucaucauucucccauugccagacaugaaccaucuauucuguuuuuuuaaauuaagaugaaauucauauaacauaaaauuaaucguuuuauuuuuuaaauuuuguaaugcucuuuuuaauuuucauuucuuuuuucauuguuuacuuucauuuaucuuuaauuuuugguaggcccuuguagaagaaauuaaagugaaggagucacugguguucguugugcaucuacuucugucuaguuuuuuuuguuguuguuguuuuuuuuuuugagacagaguuuuagucuuguugcccaggguggagugcaguggcgggaucucggcucacugcaaccucugccucccagguucaagcgauucuccugccucaggcucccaaguaacugggauuacaggcaugugccaccacacuuggcuaauuuuuuuccuuuuucuuuuuguauuuuuuguauuuuuaguagagacgggguuucaccauguuggucaggcuagucuugaacucgugaccucaagugauccacccaccuuggccucccaaagugcugggauuacaggcgugagccacugcaccuggccaacgucuuguuuuaaaacauuuucauuaugucaaaaggaaccuguggacccauuaggcaguugcuccucauucuccucugcccccuacccuuggcaaccaccaauuugcauucuucuauggauuuaccuuuuugggauacuuuguguaaaugaaaucauacaauacuuuuuuuuuuuugaggcagagucuugcucugucucccaggcuggagugcaguugcgcaaucucggcucacugcaagcuccgccccccggguucaugccauuccccugacucagccucccgaguagcugggaauacaggcgcccaccaccacgccuggcugauuuuuuuguauuuuuaguagagacgggguuucaccuuguuagccaggauggucucgauccccugaccucaugauccgcccaccucggccucccaaagugccgggauuacaggcgugagccaccgcgcccggcccaucauacaauacuuuuugugucuggcuucuuugacuuagacuuagccuaauuuuuguuuuuauauuuaguuuuuaguagcucugaggucuugcuacgagcuccuccugccucagccucccauaguguugggauuacagacaagagccaccacgccuggcuagccaaauguuuuugagguucaucuaccucguugcauguaucaguguuucauuccuuuucaugguagaguaauauuccauuguauauauauaacaguuuguuaucuguucauccauucauggauauuuuagcuauuuccaccuuuugguuauugugaauaucacuaugaacauucgugugcauguauuuguguaccaguuuuuuuuguuguuuuuuguuuguuuguuuguuuuuuugagacaagagucucgcucugucgcccagaggcuagagugcaguggugcaaucugggcucacugcaagcuccgccucucggguucacaccauucuucugucucagcuuuccaaguagcugggacuacaggugggugccaccacacccggcuaauuuuuuguauuuuuaguagagaugggguuucaccgucuuagccaggauggucucaaucuccugaccucaugauccgcccgccucagccucccgaagugcugggauuacaggcgugagccacugcgcccagcuguguaccaguuuuuaauucuuugggauauacaccuagcaggggaauuacugggucaugcguuaauuccauauuuaguuuuucauuuuuuuaauuuuuauggguacauaacagguguauguauuuaaggggcacaugagauauuuugauacaggcaugcaaugcauaauaaucacgucagggugaaugggguacccaucaccucaagcauuugucauuccuuugcauugcaaacauuuuaguuauacucuuuucguuguugauuguguuuaacuuuuugaagaacugccgaacuccacaguggccgaaccauuuuacauucccaccggcauuguacagugguuccaguuucccugcauucuugcucacacguggcuauuuuccauaauuuggauucuggccauucuagugggugugaaguaguacuucauuucgguuuugauuugcauuucccuaaugacuaaguguguugaacauuuuuucauaugcucauugucuauuuauaugucuucuuuggagaauugucuaugcaaguccuuugccuauuuuuaaauaagguugucuuuuuuguugaauuguaagcauucuuuauauauucuagaugcuacacccuuaucagacauaugauuuccaaauauuuucucccauucuauagguugucuucacuuggauaaugucccuucgugcacaaaaguuuuuuuuuuuuuuuuuuuuuuuuuuuuuugagacggagucucguucugucgcccaggcgggacugcuguggcgcgaucuccgcucacugcaagcuccgccuuccggguucacgccauucuccugccucagccucccgaguagcugggacuacaggcgcccgccgcugcgcccggcuaauuuuuuguauuuuuaguagagacgggguuucaccguggucucgaucuccugaccucgugauccgcccgccucggccucccaaagucgugcacaaaaguuuuaauuuucaugaaguccaauuuuuauuuuucuuucguugcuugugcuuuugguuccacauccaagaacccauggccaaauccaaggucauaaagacuuauccccacguuuucuucaaagaauguuaugguuuuagcucuuacauuuagguuguugauuuauuuugaguuauuuuuguguaugguguaaaauaagggauuaacuuuguuccuuugccuguggcucuccaguugucccagcaccacagugguccuggcaccuuuguugaaaaaucaguuggcccuagaugacucucaaucuauuacacugggccaguaccacacuguuuugauuacuguaacuuuauaaucaguuuggaaaucaggaaguaugagcucuccaacuuuguucuucuuuuucaaguuuguuuuugcuguuuaggccccuuacaauuauuccaugugauuuugaagacuggcuuuuccauuucugcaaaaaagaccauuggaauuuugauugagauugaacugagccuguagguugcuuugugugguauugccaucuuaauauuaagucuuccaauugcugaacacaggauaucucuauuuauuuaugucuuccuuaauuccauucagcaauguuuuauaacuuuuaguguacaaugcuuucacuugguuaaauuuauuccuagggaccgggcgcaguaaucacaccuauaaucccagcacuuugggaggccaagguggccggaucacccaaggucaggaguuugagaccagccugaccaacauggagaaacccugucucuacugaaagaaaauacagaauuagccgggugugguggcacaugccuauaaucccagcuacuugggggagcaggggugaggcaggagaaucacuugaacccgagagguggagguugcggugagccaagaucacaccacugcacuccagccugggcaauaagagcaagacuccgucucaaaaaaaaaaaaaaaaaauuauuccuagguauuuuauucuguuggaugcuaauauacauggaauuauuuuucucuuuuuuuaaaaaaauguuuuauuuuuggagauggagucuuacucuguugcagggcuggagugcaguggcaugaucuuggcuuacugcaaccucugccucccgcguucaagcaguucuccugccucaaccuccugagcagcugggacuacaggugcaugccaucaugccuggcuaauuuuuuauauuuuaguaaagacaggguuucacuguguugccccggcuggucuccaacuccugagcucaggcaauaugucugucucggccucccaaagugcuaggauuacaggcaugagccaccaugcccugccggaauuuuuuuucuuaauuugcuuuuuguuuuuaguauauaggagcaucugauuuuuguauguugaucuuguacccugcaaccuugcugaauuuguuuauuaaugcuauuaaugcuaaucuuuuccuguggauucuucgagaucucuauacaggaucaugucaucugugaguagaguuaguuuuaccuccauuuaaauuuggauuuuuggcugggcgugguggcucauaccuguaaucucagcacuuugggaggccgaggugaguggaucaccugaggucaggaguucgagaccagccuggccaucauggugaaaccccugucucuacuaaaauuacaaaaauuagcugggcgugguggcaugcaccuguaaucccagcuacucgggaggcugagacaggagaaucacuugaacccaggaggcagagguugcagugagccaagaucgugccacugcacuccagccugggcgacagaguaagacucugucucaaaacaaacaaacaaaaauuggauuuuuguuuuucuucuucuugccuggcuagaacuugaauagcaguggugaaaauaagccuccaugucuuguuucucauuuuagggggacaguuuucagucuuuaaccucucagugugaugauaguugcguagaauagcaguggugaagaaggcagggcaagcaccuuugucuuuuuccuuaucuuagggggaaagcuuuuagucuuucacuguugagugaugguaauuguggguuuuucauagaugcccuuuaucauguuaaggaagcuccuuccuuuuuccuagcucucugaguuuuuuuuguuguuguuuuuuaagucaugaaagacuguuggaguuugcacaaugcuuugugucaaccgaggugaucauaugguuauucccucuguucuguugauguaugugcugcacugauugguuuucuucuguuaacuacccuuucaucccuggagucaauccuucuuggucauggaucuuaauauuucccguuggauuugguuuguugguauuuugauuaggauuuuuuuuugcaucuauacucauggggauauugcucuguaguuuuuuuguguggugucuuuguccggcuuugguaucagagcaaccaaaagcccaaaugaguuuaggaaguauuuccugcucuuuuauauuuugaaagaguuugggaagauuuguguuaaauuguaaauuuguagaauuuaccagugaagccaucuggucuugggcuuuucuuuguuggguguuuuuaauuguuauuccugguucauaaagcccucccuuccucagggcucaccuuuccaggcuucuucuuaccaugagcucucauuucuuccaguuccuguggcaaucacugucuucauaauucauuucuauacuaaagcaaagcauauauauuuaacuguaacuccccccuuccccaaaauaucauauauuuauacuugggacuuuuuucugaauuuaugucuuauuuuauagaaugccucucuguauggaacauaaaauuucaaacacuacagacuucaaaagaguuaccacaagggaccaguggucaaguaaguuuuuucacuugaguacuuucucugauuuaguuauuuuguuguguuuuguuuugcuuuguuuugagauggggccucacucuguugcccaggcuggucuuuuacucuugggcucaagugauccuccugcuucagaaauuuaguuauuuuucugccuaauaaauaugcuguaagggaagagaucucuuugaaccuaaauauuuuggcagcuuuucaaaccagguguggugguaugugucuguagucccugcuacugaggagguugaggcaggaauaucuuuugagcccaggaguucaaggcuucagugcuguaugauugugccugugaagagcugcugcaguccagccuggacaacauagugugaucucaucucuguaaauaaauaaguaaauagcuuggcaguuauugaucaaauuuaagaauuauuuuuuaccugagggauuauguuuaguucaguuauuguugaaaucacuuccaaaauucuaaauuuuugccagaacaauuagcuauuuaauaaaacagcuuuuguuuuuagcugcucuuugguuuugucuuuuuacuuauguauuuugaacuauacccucaagcuguuacuuuuccuaauaaauuagucuuuuagauuauguguuaaauguuaaauguuaccaugaaauuacauaaaaauacuuaaaagaauuaaaauugaagcugaacagacugugcacuuccugaggcaggguuccuugugaguuuuuuucuccaguguauuuucagugcuuagcaaggugcacaguaaguuuuaguuacuuagugaaugaauauucauauacaaauaaaucaaggcaauaggauguuuugguaauuuuaauuugaggauaaagagacaagguuucucagcauacaauuuaauuauacuuuauauguaaaaaaguaauuuuaacuauucacaauuuuuuauugugaauaaacucacacuuuuuuauuacaacuuauuauuuuauuuguuuuaucauuuuauuauuuauuauuacaaacuuuuuuuuauuuccuuguucccucaggcuuuuuuuuccacauaccugucuuauuuuuacaaucauaaaauauaaaguguuaaauuccgguuuguaaauuuagugcauuagaaguuugcccaugcuauaguagccuugguaauuauuauguuaauagauguauaauagugaccacauuaauuuuaaacaauugaguuuuuuaaaauguauauguugauuaaauuuuucugaguugaaaauauucuuuaaauuaugcuucauucagacuugggcaaaaauaagagccuauuuaauaagcucugcauauaaaauucuucuugaaaguugcuuacuuugccucguuuuuaauacugagcacuuauacagugagugauaaggcuuuauugagucauaccuuagaagagaaaaaaauuugcuuauguuuuugauaacuuuuuuuguagcucugguauuauggagaacauuuguuuaugcuacauggaaaaucucuaacugugauuccauacaagugugaagugucaucauuagcaggugcucuuggaaaacucaagcauagucaagauccagguagaaacuuacuucuguuuguuuuauuaauacaaaccguuuuauuaacuuguaguuucguacagauucccacagccuucuauuuguaaagcuuuuucuuaauuuugaaauuuaccgcuguuuauugaaacuugugaacaggccaggcacggugucucaccccuguaaucccagcacuuaaggaggcagaggcgggaggauagcuugagcccgggaguucaagaccagccugggcaacauaguaagacccuguacuccacagaaaauggaaaacaaaaaaaaaaaaguuugaaacuugugaacaguccaaauugcagguucuguggcaagcugaagagcuacacuguguuuugaaugccaguguucugauuuuaggggcaaugggagaacccccaaacaaaaucaguaauaccucugcccucccuuguuuaccgauggccucaucuguuagcuuaacguuguuggacauacagccuuuucacuauauuaugauuuucuuaucugagguuaucagaauuacauggacuucaaagccucucuuaaauuguaugagugguuuuuuuuaaauuguucuuugauuguuuaguugggcaaaaaguaagucaaaacauuccagaaauugugcauuuugcauuuucuuaggaacucaugucgugucccauuuuguaaacugggagacaccucaaggauguggacuuggguuccagaacucagagcagucaagaagaauuguaaguuucguaguugaaauugaaacauuagugcaaauguugaaaaacagaaaaagacugaauuauuuuaaugaaucauauccuuacaacucuuagagcuuugacuauaaugacaggacaguuugcggcuugaacccaguaaccucacauucuuuauccagaaaugccccauguugucuauuaguuauauuuacuuuuaaaaguuuuugaugagagcaaaagugugcuaaucucuuuggaguguuucauaucccucuaaauguguauuggaucucuuauauuguuuugugauccuaaucaauuuacuuaauuccaguuaaggagacgaaaaauugaagugaguuuacagccagagguuccaccauccaaacaacuuuugucaaccauaaugguaaauaaauaauauugaaauaugaaaaaucaaacucaaguguuccaaagaaaucgcaucuacucuucguucugucuuauuuuuaugaucaucuuuauaccuauagcuaacaucuuguaguaucuuaagggugucagaguugauccgauauuuuggcuucuuugaugcucgcugucaccucaugagauugauaugguguuggucuuaucucuuucucauuuaacuuugcagugucagcuucagcuuugcaggaaugcaugauaacuguuagucauuugagaaaauguugugcuaggaaacguuaaguucagagugacauucguuaaugugccaaacugaauucuuuaauucugcgcuuucagaaagauucagaaaaacacauugaaguagaaguacggaaauuuuuggcucugaagcagacaccugacuuucauacugucauuggggacacaguaacaggacuucuggaaagguguaaagcagaaccaucauuuuauccccggaacugucugaugcagcuuauccaaacgcaugugcuuucuuacagguagcuguuuguguguaccacacuguacgugcauaauucuucugaccuuguuuuuuauaguucuaaucuucugaaacucucaaaaggcuuauaaauguucugcaguugagaauuuucuuaauauguaauagugauucagauuuuuuugucuuaguuugugccccgacuuaauggagauugccuuaaaaaagaaagauguacaguuguuacaacucugucuacagcaguucccugacauuccugaaucagucaccugugcuugcuuaaaaauuuucuugagguaaguuagacuccaaugguccuuuuucuucacuacauuuauaaucuguuacauuauuugauuuccaaaauuuugaugcuuaggaaaugaaauuuuucccaaaagcuuggugauaaggauuaaccucuugcuuucaacuaccaucauagcauuggugaugacagucuucaagaaacagauguuaauauggagucaguuuuugacuauaguauaaauucuguacaugaugagaaaauggaagagcaaacugaaauucuucaaaauggcuucaauccugaagaagauaaaugcaauaacugugaucaagaguuaaauaaaaagccccaggacgaaacaaaggagagcacuucaugcccugugguacaaaaaagagcagcucuacuguauccuuugacauagagcaucccucuguuucucuuuauaggauauaguuauaugccaagcaguaaccaaggaguaacucaauaauuuaagguuuuucuuuccuuuuccaauuguuuuuuguuucuguuugaaaauagauuauguucaaugcuacguuaaguaagguuuacuuaaaccuguuuaauuuaacuaggcugggcauggguggcucaugccuguagucccagcacuuuuugaggccgaggugggaggauugucugagcccaggagucugagaccagccugggcaacauggcgagacccccaucucuacaucagauuuaaaaaaaaaaaaaagaagaagcuauacuaacacagaagcucuaucaauucugaagaucaguauucugaauaaauaccaauuaaaguauuccacaugaucuccaaugauuaggagaguguuuggugauagagcucuuuuagagauguaaaacuuuuguauaaauuuagaaaacuaacauugacaaaggaaguuacucauaaguucaauagaauagcuucuauuuguugaaguacgauuuuccuuuaguccuaaguaaugcaauucuucauucagcauauagcgagacauuucuucugccucauuugaaagacaucccagcacagcauaucacgguaaguguucauacaaguuguauagaauuuuacuucugguuuaaauauugcuauuuaacucuaaccagcuguuagggcauucuaaagguuaugaaauucuuucaugugaauaagagguugcccagcucuaauggcaaaaaauugugcugagaaaacuagagcgauacuagggugauagaccauggcauauuccuugugccaaacuugaaggccaaguuaagcuuccuaaguuauaaaugaauaaacacuaaaaagaauugcagacagaaggguucucucuaccuauuauuuacaaacaaugagcuuaucaccaccacuacccccaaaccagaugagcuccucauuaaugggagggacugcauuuuauucauuuuuaugucuccagaugucuggcguauuuguuugauguauaaauugaacauuuuuuucaaucuucgugauggguuuauauaauagaaauuuuuucuaucaaaaugauaaacuauccauuuuuuuucccacccagcuguuucuuaaguauuuguauuuccuguaccugaaguguagcgaaaaugcuacuaugacucuuccuggaauacacccaccuaccuugaaccaggugagauuauuuuuuuacuuugauuuggugcugggaaaaaucugugaaaaaaaguuguauucaaggucagcaccugcauucaagagcugacuucuuguuuccuaggccguaggaaucccuuccucauaaaaccaaaccacugcagcuagaaauggggagucucucauuuaguagauuucuagauccauaaaucuacacgacagaauuuuaauuuaucuuaaauuccugauucuucauuaugacccuucccuuuuccaagaauuuccucagccuugaugggagacaacaggaaggggcugauaauauagguugcccccuuaaucaucucuuaagaauaagagaacaggccaggcauggugacucacgccuguaaucccagcacuuugggaggccgaggcgggaggaucacuugaggucaggaguuugagaccagcccagccaacauggugaaacccugucucuacuaaaaacacaaaaucauccaggcauaguggugcgugccuguaaucccagauacaugggaggcugaggcaggagaacuguuugaacccaggaggcggacguugcagugagcugagaucgcgccacugcacuccagucugggcaacaagcaaaacucugucccaaaaaaaaaaagcggggggaauaagagaauacagauuagugaaaaaauauucccagagaaucccaugguagucccucuuuaaaaauaauacuuaugcugggugcgguggcucaugccuguaaucccaacacuuugagaggcugaggcggguggaucaccugaggucgggaguucaagaccagccugaccaacauggagaaaccccgucucuacuaaaaauacaaaauuagccaggugugguggcauaugccuguaaucucagcuaccugggaggcugaggcaggagaaucacuugaacccgggaguuggagguugcggugagccaagauggcaccauugcacuccagccugggcgacaagagugauacuccgucucaaaaaaaaaaaaaaacuuauuuaaaaaacaguaagaaacauuuaaaaauaauguauuuacccuccuacaaaggcaugucuauaguuccuugucuuuggacauguaagaauuggaggcaaagaaauguggacuuggagaaaucuggggccagcuugcucuccgcaggcucaagaucaaccaucccacauagaagcaguaaaaacaauaaauuguuuugguuugguaauauguuauucuaacgaaggauuuuaaacacuuaaguuggcuauucuucauauaaaaaauaacuucuuuuuuuuuuuccuuuucaagaaggcaaggucucgcucaaccacacuggagugcagugggaaucauaguuuggggcagacaugaauccugcccugaagcaguccuccccacuuacccucccaaguagcugggacugcugguacaugccaccacaccacaugaaaauacaauuuuuuuuuccuuuuuugagacggagucucgcucugucucccaggcuagaaugcaguggcacgaucucggcucacugcaaccuccgccuccaggguucaagugauucuccugccucagccuccugaguagcugggacuacaggcacaagccaccacaccuggcuaauuuuuguguuuuuaguagagaugggguuuuaccguauugaccaggcucaucucaaacuccugaccucaggugaucuacccaucucagccucccaaagugcuaggauuacagguguaagcuaccgugcccgggcaaacuacaauuuuuuuauuuuaauuuuucuuguagagacagggacucccuguguuacccaggcuggucucaaacugcugggcuuaagugaucuuccugucuuggccucccaaagcauguggauuacaggcaugagacacuuaccuagccuaaaaauaaguuaaauuuuucagugguuauuuuuuauuuauuuauuuauuuauuuaauuuauuuucuuucugagacagagccuugcccugucacccaggcuggagugcaguggugcgaucuuggcuuacugcaaucuccaccucccagguucaagcaauucuccugccucagccuccugaguagcugggauuauaggcccccaccaccaugccccugugcuuuuaguagagacaggauuucaccauguuguccaggcuggucuggaucuccugaccucaagaugauccacccaccucagccuccuaaggugcugggaugacaggcuuaagccaccgcacccggcccacucagcacuguuuuagacauuuccuggaccaguagacauacaucugccucauuccuuuuaaccaaugcauacuauuucauuuuacaaauauaaauuaauguaccuaucaauccucuauugauggucauuuguuuaccauuuuuugcuguuguaaaucuucagugaggaucuuuauacagauauucuuguauauuuaugagaaugccuguugaauacauucccacaagagaaauuauuggaugaaauaguacaugcaauuuuuaguuuucaaaaugccagacuuucugaagaguugugacaacuaccaccagcaaggucugaggcauucuuuuucacauucuuacugacauucaguuuugucaaacuuacuuuuugccaaucagauggguaacagguguuaccucauuuuaauuugcauuucuuugauaaugagagaaggaaaccgucucuucuuguccauuuauauuuguuuuugugaaucugccuagucggguucuuuguccauauguauauugcauuuccugucuuuugguuuauaaaaaguuccuuuuauauuaaggaaauuagccuuuuucuaucaaaugcauuguaaguuauuugucuuuuuacucucuuuaguauaauuuuugacagauacuuuuucaugcuauuaaaauuaaaguuuuccucuauaacuucuuuauggcuuauguuauguuuaaggcccuucccacucuaagauuaugaaaauagucaccagcuuucccuacuacaugguuuuauuucuuguguuuaacucuuugauacauauagaauuuaaucugauauaaggaguuccuuagggaucagcucccccucccaaauggauagccaguuucccgguugcuuugauauuugcauguuaacuacaccacuggaagauguaggacuacauaagaaacuucuauaaaugcuuaguaauaauucugguuuauggcaacucaucuauaauacacaacaccuuguccuuggggaaaauuuaucuugcagaauagaagaugagugguuauuuuuuugugugugugacugaaaauuauugaaacugaaaacuaaaauuuuuaaaaauaaaaagacaacuacuggcgcggugucucaagccuguagucuuagcacuuugggaggcugagguuggaggauugcuugaggccaggaauucaagaccagcuuggcaauaaggcgaaaccccaucucuacaaaaauugcuaaaaaguagcuggguaugauggugcaucuguaaucccagcaacucuggaugauugcagcuacucugggagguugaggcaggaggaucacuucagcccagguguuuggaggcuccagugagcuaugaauugugccauugcauuccuacuccagccugggugacauagcaagaucccaucucuaaaauuuuuuuuaauuagaauaaauuuuuuaaaagccagaaaugagccuuuuuauauuucguagaaauugcuccaucucuaaacaaaaauguucagauuuuauuuauaaagacuuauuuuucucauaacuguuuauuuauggacuuuguaaagugaauuaaccugaaguuaaauuuaaaaucuuaacuuccuuuuccuauucaucuucagauuauggauuggauaugucuacuucuggaugcaaauuuuacuguuguuguaaugaugccagaagcaaagaggcuacugauaaaucuuuacaagcuuguaaaaucucagguuugugauuauuugauauauacugauuuuauuuguacccaaguaucaccugaauuacaauuauucuuaaaauuuguccuuaaauaacuuacucauggaagauuuguuucuauguagacauuaugguaaaaguuacucugaaacucuuuucuuuagauaucuguuuauucugagcucaacaagauugaaguaaguuuucgggagcuacagaaauuaaaucaagaaaagaauaauagaggauuauauucaauugaagugcuggagcucuucugauauuaucaauucuccuucauagacauuuuauaaagcucuuuuaugugaacucuugcuucauccaggcaagaacgguguuuuguuugcgaccaucucagugucaagagaaacgugucagugaguaccuggaccaucacuuaacugaugcuccgggguaggacugcagguuucacaugaaccuguucuaggcuguggacauugguguggagagguucugcaauuuuuuaaaaauauguaacuggguugauuuuaaguaaaauuauuuguguauugauaaaagucuaauuucuu

SEQ ID NO: 192318 - RNA, 26103 nt, Homo sapiens
cugagcgggugcgcgggcaacuuccggugugggugacgagugguggccgaagcagggggacagcaagggacgcucaggcggggaccauggcggacggcggcucggagcgggcugacgggcgcaucgucaagauggagguggacuacagcgccacgguggaucagcgccuacccgagugugcgaagcuagccaaggugaggagaggccggcuggcuguuggcgggcgccaggggcugagucacggcgcggagccugcuuaggccucagggggccugcgggcuggagcgugcaccccccaaugccuguccagcccuaguugggccugcacgagugggagaccccaggucggcccggccagggcugcggaguacgccagcgccuauagcuucccagacccuccccaaaacagauggucacuucccuccgugggacuuagggcuccguuuaacuuuuugccguuucuuggaugcuguuuaagugauauuuaccuuaguaguuucccagggguuaaggccgcuucaguauuaaggcuagaucagagaguuucguucuguugcuguugcucaaucaauuuaugucguuacaucguuuguggaucauggcuaugugccuggucuuuggccaggagaaggggcaggaaagugauaguacgaagaugacuaacacaggacccuguccuuuaggaguugauguacgugaugaauuagucaagucaugcaugguggugagggccauacaaggggaaaguguuacuggaacaccgagaaggaagcuaugcauucuuaauggugccauaagggaagguuuuacaggaaggcugacguuuguauugggucuugaggaauuaguaagauugaggugggguggagucauuacugaagacggaacuacagaaguaaagacaaguaggcacuauaagaguuuaacgggcuuuccaagaaacaaggauggagaaaggugauaaaguugguacguauguauaucuuagguucaguaugcuugcugagggggagccacaaauucauuaagagcuuucuagcagcuagcaucaacaaacaucaguuacauaagggugggaaaacucagccgccuccaaugccagacagauaacaauaacugauauuuguugaguaguuucugcagugucaggcaccgugcuuacaugcacuaagccauuugauccucaccucagcccuaugcgauggcuauuacuauuauccuuauuuuacagguaagaaaacuugggcuagaaaaaguugaaucacaugccccaagaucauacagcuaguaaaguggugaagccaagaagcaaacccaggcagaccgauucuagauucuggagcuggugcccucacacaccaugcuguccugccuagaagccuauuguagugaaaaccugaacuuuuuuuuuuuuuuuuuuugagacggaguuucacuuuuuucacccaggauggagugcaguggcgcaaucuuggcugacugcaacccccgccucccggguucaaacgauucuccugccuccgccucccgaguagcuaggacuacaggugccaccacgcccggcuaauuuuuguacuuuuaguagagacgggguuucacuacguuggccaggcuggucgcacgcgaccuccugaccuaaagugauccacccaccucugccugccaaagugcugggauuacaggcgugagccaccgcggcuggccaaaaaccugaacuuucgagcaccugcccaggaaaaggagacggcagaucuucaccuucagauaaucuuugccaauuggggaugaaggccgaguauugucgaugcugcuaauuugagggagaaaccaggaagaugaauuucucauuaaauaccuuaauauuuagaaauuggauacuaaucugucauauuaaaauacuauuugagccaauacaauguagcuagaacaaaacauacaggccaaggucagccccugaaccuccacuuuggaauuaauagaaugauaguguccauaaggaagaaacaaguaauuugcucuagagaaggacaaccaaaucuuccuuuuaugaauuucuguuaauaccagucuacuguuugcaagaccuagucaguguuagacacuaugagaaauacagagauuacuagacaaagcucuugcccucgaacagcuuauagaucaguaagaaaaaagacuucacugcuacaguuguucuggugaucuuauguagcauuuauuccuaaauaauuguuguuaugcuccaggcuguugaaaaacuugcaaacuccaauaccauaugccuuuuuagguguccaguggguaacagaaguguuuaaaaaaaagaauguuggggccuguuaagauagauacauuugaauuuugauuuuuuuuuuuaagccagugugccagcugaauaaaacaagguauauguugugggaggguauacuuuuuuuguuuguuuuuugauaccgagccaguuucaacuguaaauuagaugguuacccuacacuccugguuaauuuuuuuaaacauauuuuucuguuuugcuuuuuauuuauuuuuuuuauuuuuuguuucgagacagaguuucgcucuuguugcccaggcuggagugcaguggcgcggucuuggcucacugcaaccuccaccucccgguuucaagcgauucucgugccucagccucccgaguaucugggauuaccggcaugcaccacuacguccagcuuauuuuguauuuuuaguagagacgggguuuuaccauguuggucaggauggucucaaacuccuggccucaggugauccaccugucucugccucccaaagugcugggauuacaggcaugagccaccgugcccagcugcuuuuuauuuuccauuucauauuauuuucuaaccauucugccaaacauaaaaaaaaauuaacauugcauuucuacauuggaauguauggaacaguuaguauacauucuuuugauuuuauuuugagcccaucaaacuaugaagaacgucuuguuauuuucacuugugagaaaauuuaagcuucaggcagcuuaagugguuuauucaaggcagaucaaacucacaucuccugguaaaaagaauaguguucuuuuugcuacuaccucuuuaagagauuaucaauucuguccuuaauuuccuuaaggcauuuuuuauuuuaaaugugaaagacauuugaagaugaaaauuguguauauagcacuuugggaggcccagguggaaagaucacuugaggccaggaguuugaggccagccuaacgagaugcugucucuacaaaaaaauuuuuaaaauuagccagguguugugguacgcaccuguugucccagcuacucuggaggcugaggcaggaggaucgcuugagcgcaguaguucgagguugcagugagcuaugaucgcaucacugcacugaacccugggcaacagagugagaccuuaucucuuaaaaaaaaaaaguuguauauagagacuuaauaauguauuagaugggaaacuguauuuagcagaagccuuagaaaggcagacaaauccuagaguugguuuguaaaauugccaaauguagauccuuuaaaucacuuguaguugucaccuaguacaguuuuaugucuguccuaacacccauguugcaaaugauaauaacuaauauuuauugcuguauacguuuuauuaaaaugucagcugcuaugaugauaaugauauguacucauacuguguuccaggcaugccuuuauagguauugauuuaaaucuuacaccaacccuguggauugguacaauuauugugcccacuucgcugaagagaaaauugagagucagagagcuuguguuuuacucaagguaauaugguaguacagcugggauuuagaccugagcagucuggcugcagagccuguaguggguuuuuuuuguuuuuuuguuuuuuuuuuggguuuuuuuuguuuuuuuuuuuuugagauggacucuugcucuguugcccaggcuggagugcaguggcgcgaucucggcucacugcaaccuccaucucccggguucaaggaauucuccugccucggcguccccaguagcugggacuacaggcgugcacuaccaugccuguauuuuuaguacagacaggguuucaccauacuagcuaggcuggucucaaacucuugauguugugauccacccgccucagccucccagaaugcugggauuacaggcgugagccaccgcgcccagccagagccuguauaaauuaaccauucuaccgccucugugauugguguguaagcacccugugucgggaugaugggguguuaguaaaagugauacuaguucuugaugaugguuaucucuuugccuuguauucaggaguuaaaaauuaaggagggccuuuucugcacuguaaagauaugguauuuagcaguucuuaauauacugaggguuucucauucucucuuuuugauuauguuguauuuggcacaugguuauuuggggacuacuuacauucuuaaauugaauguauccuuugauucuccuuccucuuaacccauuugugcugcagguugcaaaaucuuuuuugugaaaaaucagaucuuggcgaugaccuugagcaguaggauauaaauaacucccacaagcuuagcguuccaguaauggaacacuaggccuaaauguuaaugucuuccucucucucucccucccucccucccuuccuuccuuccuuuuuuuuuuuuuuuuuuuuuuuuuuuuuuuuuuuuagauacagggaucucaaacucuugagcuuaagagaucuuccugcuucagcuuucugaguagcugguagugcacaacacuguaccuggcuuaaugucuuuucauuucuuuuggucaccuucagccucuuaugguuaaugucaaaaagagcaagugaaauguaaaacaguuuacauuguuaacagcuuaaacaaaagagaccccuuuaaggaauaggucacuuuaaaaguuggacuauguagggggaguauuggacuggcuuuaaauuucaacuauuuguggugacuuuuuuuuuagaccgaguuucgcucuuucacccaggcuggagugcagaggcaugaucucagcucacugcaaccucccguucccggguucaagugauucuugugccucagccucccaaguaguugggauuacaggugcuuaccaccacgcccggcuaaauuuuguauuuuuaguagagaugggguuucaccacguugaccaggcuggucuugaacuccugaccucaagugaucugcccgucuuggccucccaaaguguugggauuacaggcgugagccaccaugccuggcuguggugacuuuuuauuagccuuuuucuuucuuauuuagguuguguaacaaaucauugaaagauuggauucauucaggaauuaaaggaggugcaaacagaacuuauacucaacauugauguugaacaaacucauuagucgcuuacaucauuuacaaggauuauuuuaaugaggaaaaugagucacugaagucacauguucuaacagguugguuuuggauagcuuucuaaccauuuguuccucugaguugaaaggcagcaucaaggaguuggaauuucaggaccugagugaauagacaggaaaaagaggaggauguuuagccauaggguagaauguggaagauugggagaaaaaagggggaugauuugaaaauuggaaauuguauuaaaugaaaugaugguaguguccuucaaauagcacuaaauugucaacgguauaguuugucacauccugcuuauugugacaguaagaaucaggaaucguaagccauugagaucaacugaauacagaucaggugagugccaauccauucaacacguauuauauggagguuggugcaaagagaagugacaaguaaacgaggauccagcccuaaaggaacuuguagaccacuuaggagguaagcuaugugcaucaguaacugauacaaggauggaaggauggaccauagugucugcagaagcaguggcaugugcuuggugugaugcagcucacugaacugcagugaugaacaguauagacauggcaucccugcucuuacagaguucgcauucuacugagauuggaaagacaguaaacaccaaaauagaauauaguuugggguaauugcagaguagagucaguaugguugaguaugaaaggaagagguacuaagugacuacugauuuuuagagaguguuauccaaaaaugccuuuguaagaaaaugacguuuaauguuuuguugauacuccagacuguggcuuuaggccaaugugugauucucucacauguaugaugcaauuuaauacccaugcuucugaauuagaauaccauauauuaaaccacacuuuauugaucacagucacgugacuaauaguaauugcaaaugugaugggugacugucauuaaauaguauuuugcauuuuaacuauuuuugcccuucauuuuguugccagauaguaaccauagagaugacuuugaucaaagcgaaaggugagauuuaaacuaguacaguaggggaagcgcugcacucuaguggagagagcuuuggagcuugaggcaggagccccggaucuagugcugcucauuuccuuuuguggcuaagcaagucauuuuaagcuguuuaguccucagucuuuuuaaucucuaaaaugaaaugauugaauuaaauaaugccuagccgucuuucuaguucuaagauucuuucaucuuuuaggauuuauuagccuucaacuuuggagaauuuauagauuuguucauuguuuuuuuccucugaugaacauuuagccaguauuuauuauauauauaaaucuauagaacuuucagagaaaggagaacuagggcucuccaaacaggaaacguuguuaaaauauguuaagaaucacauauuucagauuuaauuaaaauaaguucagacgggccaugcaguauauaugcugugccgcauggaagauucaugcauguuuaaaagcuaucuuggaaaaauauggcagcaguauuuuaaaaagucaaaacauuauuuaugcccauaauucagaagcuauuuaauaaguuucuuucaucaguagaaaaggauaguacucacguaucauccaugaauguuauuaagauaaaaaaaauucauuuuugguuagaaaaacaauuuuuaaacaauacucuucucauuucaauuuauugucagagauauuuacaugauaguuauuaauauuagcauguuaaauaaaugcauuuuaaaaauuuuuuaucuagagaccaggucucacucugucacccaggcuggagugcagugguacauuccuagcucacugcagccucaaacucuugcacucaagugauucuuccgccucagccuccuggguagcuaggaccacaggcacaggcuaccuugcccagcuaauuuguaaauuuuuuguagagacaggaucugccccuauuuuccaugcuggucucgaauuccugggcucaaguguccucccaccucagccucccaaagugcugggauuacagugcgugagacaccaugccuggccaaugagugcaguuuuugugcuguauguugguuuugguuuuaucaaaaugugugguuccuaauaggauaacuuguuuuacuccugguguauuaucauuuauguuuauauuauuugaguuuuauuguuccaaucucuaaauauauagccuagggagaauguuuuauuuuuacaucugaguuagagauguggagagguuaguguaaguugucagaaacuguauuucaguugaaucaguaucugcucaagagcaugacuuuaaggauagcauguguggguguucucagaugccuucauuuccgguaagcaugauuacuaauuuauucuuaaagucauugaaaaauuaaaccauaguuuccugucuuuuagcuccaagcauucuuuuuauuucuccuuggaacucuguauuuuaaaauaucuguuagggugacgguaacuucauaaaggaaucauuuauuuuccuacuuuuuuuuucuuuuuuuucuuuucuuuuuuuuuuuuuuuuuuugagacagguucucacucugucgcccaugcuagagugcaguggugcgaucuuggcuuacugcagccuucaccuccauggcucaagccagccucccacuucagccuccagaguagcugggacuacagguaugcaccacaaugcccagcuaauuuuuguauuuuuuuguagagacagguuucgccauguagcccagccuggucucgaacuccugaguucaagauaucugcccccuucggucuccuaaaaugcugucauuacaggcaugagccacugcaccuggccucuguuuuuauucuuuaaagacacaugugacuaccacuuagagucucugaucagaacaggauccaccagaugcaguggcucaggccuguaaucccagcacuuugggaggccgaggugggaugaucgcuugaggucaggaguucaagaccagccuggccaacauggugaaagcccaucucuacaaaaaacaacaaaaauuagccgggugugguggggcacuccuguagucccaccugcuccggaggcugaggcaugagaaucgcuagaacccgggagguggagguugcagugagccgagauggugccacugcacuucagccugggugaaagagugagacucugucucaaaaaaaaaaagaacaagauaaacagguguuaccacacugaguugauaaauuagaauccaaaacaaagacuugauguuuucuuagguguuacaugauuguuauauguucaguuucucuuaggcauuuaaaaauauuaaaaauagcuuaugggcuucaaguagggaaccacugacugauggaacccacuagagaaggaagcacuaucaugaaaaggagagaaacaaaacuaguuauggguaguccuuuuccucuagaagaggcuguugauuuuuccuuuucugugucaaaaccauuucauuuuagacuaguuauuugcauuuuguguguuuuuuuauuguucauuuucaucuuuuguuuuaggaaggaagacuucaagaagucauugaaacccuucucucucuggaaaagcagacucguacugugaguaguuuacaggggaaagcucaguuaccauuaauuucauugaacauucuuccauuaacuuucaauauauuuuuacccuuacaggcuuccgauaugguaucgacaucccguaucuuaguugcaguagugaagaugugcuaugaggcuaaagaaugggauuuacuuaaugaaaauauuaugcuuuuguccaaaaggcggagucaguuaaaacaagugaguucaugaucaugucugcuccaaacacaaaagcauuuguauuucagaacuuuucacaagcucuucuauaagucuguuuaaaauguguuaagucaacguuguaacauccuagaggguguuuuaaaauucagucuacauucucacaaugauaugacuguuuucuguuuuuucuucuagucuuuauauguuugcauauuuuuaaaaauuguguuguacuuagaguguucauacagcuuuguucuauuuugguauugcuacuuuuauuuuuuccuuauuuauuuacuuauuuugagacagggucucacucugucacccaggcuggagugcagugguaugauuacaacugacugcagccucaaccuccugggcucaagcagucuucccaccucagcccccaagcagcugggacuguaagcgcaugccgccacaccuggccaauuuuuuuauuuuuuguagagaugaggucucacuauauuacccaggcuggucucaaacuccugggcucaagugaucccucugccuuggccucucaaaaugcuagaauuacaggcaugagucccugugccuagccccacuuuuauuauuuuaaaugguuuuguuuuaauuuaucaagcugauauucucauuuuauuuagucauaucccuuuuauuaagcacaucuuuuuaugcuguuucaaaauuuuuuuuuaguaguaacuaaauauuucauuuucuuuuuuuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaaguucauuuucuuauauuaucccaauauaugauuuuuuugcaaaacagcuuuuugagguauuacugacauucaaaaacuaugcauguugauaaagauuucucuccuugacuaaacucucugagcccucuucuugacaaguccuuaaccuuguccuguguagacuuaaacaaauacuaagauuguuucuaacagcucaaggcugcauuuccaggaugacccaacccccacuuagagugccugccugagaaaacugaagucugccaaaagaauguacuguuaaacauuuaaucuugugugugugugcguguguguguguguguguguguguguguguguguguguguagaaaugggggcuugggucucacuacauuacccaggcuggucuugaacuccugggcuuaagugauccucccaccucagccucccaaagugcugggauuacaggcaugagccacugcacccggcuuccaacuuauuuuugaggccauuuuuagagagacuauuuugcucauuuuguuuagagauuauguaaguucucuuuuaguguuuuggugaaguuggauuuuucuuuacuguuuccuuauucuucuugagauauauuuaaauguuccccuguacaaguagaucucauuuuuuacauuuuuaucucaucuuuuaaauacuguuuccugaguaguuucuggguuuuaauuucuugcuuuaaauaauaaagacaauggcauuguaaaagaggauguaauggaaccaaaaauagauauauaguguuacuggacaaauuccugauuuuauuaauuagacugcuucuaggguaaggauaguauuaaaguggguuaaauuauuuuuugcagaagucaguuacuguaauugauuuugguuuauuuuucuuuagguaaguuuacaugcauauaaaagacaguguuggcucagugcaguggaucacaccuguaauaccagcacuuugggaggccaagguggguggauugcuugagcccaggaguucgagaccagucugggcaauacugugaaacccugucuauacaaaaaauacaaaaauuagcugaguguaguggcaggcgccuguaaucccagcuacuugggaggcuguggcaggagaaucaguugacuggggaggcagagguugcagugagccgagauugugccauugcuuugcagccugggcaacaggaugagacucuugucuccaaaaaaaaaaaaaaaaaaaccaaaaauaugcaagccgaugugaagaauuaguauagauuuaauuuaauugagacaaccuaaaauaugugaaugugaaauuuauguauguauuuauuuauuugagacagucuugcucugucccccaggcuggagugcaguggcaccaucucugcucacugcaaccuccgccccucggguuuaugcacuucuucugccugagccucccaaguagcugagauuacaggcaugugccaccacacccagcuaauuuuuguauuuucaguagagucaggguuucaccauguugcccagguuggucucgaacuccugaccucaagugauccacccaccucagcuucucaaagugcugggauuacaggcaugagccaccacacccagccaugaaauuuacuuaaaugugccuuuuggugcccaguucagugguuugagagacaauuauuagacaaaccaucgucuuacucuauuuucuaagaaacuuacucucuaugggacaauuuugaaagggcuccuuaauuagaagucuuggggcaaccuagguugaaaucaacaaaaauuuauguuuuauguaguauuaggacaauucaaagcacacaucuuaaacuuuaauuucucaugccauaaaaacucagagcuaguaggggguguugcuuaacgcuuacuuuuuucuucccuuuuuuuuuuuuugaaacagucucugucgcccaggcuagagugcaguggugcaaucauagcucacugcagccucaaucucauaggcucaagcaguccuccccaucagccucccgaguagcuggugcuacaggcacaagccaucacacccaguuaauuuuuguacuuuuuguagagacggaguccugcuauguugaccaggccucuaauucgugagcuuaagcaguccuccugccuuugccuugucugccaaaguucugggauuacaggcaugagccaccgugccuggccccuggcccuguuaauuuccaaauggagaaacguauuuuuauguaaagugcuuggaaugugaagagacaugcagccuauaguucuugcccuuggcacccuauugguuaguaacguauguaagucacaaguaaucauagcacaucuuuaacaaguagucuuaagauuuuuuuuaauugcuacacauacauuaggcaauguauaagugacacaagaguaauagauguacaaagaaaugugaaagaaggaagaaaauauguugaguuagauuuauuggggaaggcuucuuggagagagaggaauuugagucucucucaccgcuggcuagugacagccagaaguggagccaggcaugcuccuuucccuguaacauauuaugucuucauagcuauggaaaguucuuaggaaacauaaaugucucuguggcccacagaguccucuuuucucauaauuauuuuuuaccuacgaaauuuauuuuuugcuuaagcagacuuagaaaguagcuuuaagaaaauaaacuuuuuggcugggcaugguggcucacaccuguaauccuagcacuuugggaggucgaggcaggcggauuuccugagcucaggaguuuaagaccaaccugggcaacauggcgaaacccugucccugcuaaaaauacaaaaacaauuagccaggcaugguggcgcacauagucccagcuacucagaagucugaggcaggagaaucgcuugaaccccaggaggcggaagcugcagugagccaagaucgcacucuagccugggcgacagagugagacugucucaaaagaaagagagagggagcggggggaaggaggaagggaaggaaaggaaggaaggaaauaaccuuuucuaaauugcuuaauaugaaugguuuauauucauugucugucacucgagcccaaggggucacuccaacuguaacuuccugaaugucuugcauuuuuuucagagaggagcaagacguucacuuauuauuagaauuuuuuuaauagcuuccccauugcauuguuagcguauuaauguacaguagucccccuuuguccauaaggaauauguccaaaaauccucucuggagaccagaaaccacagauaguacaaaaccauauauccacuaugcuuuuuccuuguugagaacuuucaccuuuucauuuaaaggaggcacuuuauggcuucgcuuuggcauauacaaauggccagcaucaccacucuuggguuuugaagccauugugaaguauaauaaggguugcuugagcacaagcacugcccuggauacaguggaucacaugagacugagauggcuacugagugacuaggguggguaguguggagacacuggaccgaagggugauuugagggacugcauuugauuucaucacuacucagaauggugugcagcuuaaagcuuauagauuguuuauacauggaguuuuccauuuaauauuuucacaccacaguugaccauggcuaacugaaacuggaaagcaaaaccuucguaaguggagacuacuguaguuguuguuuuuaaccccaucugauuucuguuaauguauuuuuugcacagcuuuuagaauuaucaaguugugugcucuucuagaaauuauuauuauaauuaacuuuacaggcauccuauguuuugugagacacuacauguccuagggccuugaacuuauugaaagaguuauaguuuacaauaaaaccauagcuuuccagaaugccugggucucuaaauagccaguguuucagauaguuaaaaguuuaauacugcuuguucucauugauaaauggaaguuaaacaguaggugcacaugggcaugaagauggugagaccccugucuuuacaaaaaaacuuuaaaaauauuagcugagugugguggcacauaccuguagucccagcugcccaagaggcugaggugggaagaucacaugagcccaggaauuugagguagcagugagcuguggucaugccagugcacuccagccugggugacaaaaugaggccccaucucuuuaaaaaaaauuuuuuuuuuuuuuuuuuugagagagauucucgcucuugucgccaggcuggagugcaguggugcgaucuuggcucacuggguucaagcaauucuccugucuuagacuccugaguagcugggacuacaggcaugcaccaccacacccggcuaauuuuuguauuuuuaguagagacuggguuuugccauguuggccagaauggucucgaucucuugaccucgugauccgccggccucagccucccaaagucugggauuacgggcaugagccaccguacccagccaaaaaaauguuuuuaauuaaaaaaaaaaaaagguggaaauaacagacgcugaggacuccaaaagcagggaggaugaaaggaggugaggguuaccuguguauccaaaauuaccuauugggugcaauguucacuguuugggugauagguucgcuagaggcccauaccucaccacuauacaauauauucaugaaacaaaccuccacauguacccccugaaucuaaaauaaaauaaaaccaccuccacaacaaaaacauuuagccugagcugcuuaaacauuaaauguuuuucguggaaaucuuucuaagauauucuauucacuuuucugcugccuuaaccaaaauauacuuaauguaauuuaacauuuucuugaugacucaugguccuaauuauuauuauuauuauuauuauuauuauuauuauuauuuugagacaagucucgaucugucucccaggcugaagugcaguggcgcgaucuuggcuuacugcaagcuccgccucccggguucacaccauucuccugccucagccuuccaaguagcuggaacuacaggcauccgccaccacgccugguuaauuuuuuuguauuuuuaguagagacgggguuucaccauguuagccagguuggucucgaucuccugaccuugugacccgcccaucucugccucccagagugcugggauuacaggugugagccaccacgccugacccaugguccugauuguuagugauuaucauauauugcuuaaaaucuagaucaaacauuggcaaaugaugggacacaaaucaaaucccacccgccuccuauuuuuauaaauaaagucauugggacacagccacacucauuuguuuuuaaggaggcagaguugaauaguugccacagagacuggcccacaaagucuaaaauaacuacuuuaugaacauuugcaaaaauuuacagaaaauguuugcugauuugugaccuggaucauagaauguuagugcugaagggaguguauucuagccccuugauauaaccugugaggaaacugaaggcaugagggucucuggcucucagugucacaugguauugaggugaauuugggugacuguggcucuuccucccacccgggugguagaaccguuucgccuuuugccucugccacugccuuuuuccuccucagucacagugucugcaggucauggcuucaagccgcuguggaccucugcuuucucuuccccuagucagaugccauuucuuccauguuuuccugcuuggcugcaucucugcaucugagguuuuccugaccuuuacugacuuguuacgggguacucgguacuuuuuagguaucagugagauuucgaugugauguucuuuaugacauuuuggugucuagaguuacuugggaagaccaaguucgaucauugcucuuugaucaauaaaauacauuuuuucgcucugugaggaauguauuuuacuuaugaaugguuuuuaauauuuuaggcuguugccaaaaugguucaacagugcuguacuuauguugaggaaaucacagaccuuccuaucaaacuucgauuaauugauacucuacgaaugguuaccgaaggcaagguaaauuuucuguugacauaacucaaaaugauaugaacuguuuuuucuguauucagagauacuuaauguauguagauauuuuguauauuuuuauguuuauuuuuuaaagaaauacacaaaaugucaucacuguaauucaaccaauaaugucuuuguacaucccuuucugcaaaugaaucuauuuaaauacugacagccaugguauaucuagauuuuucugggaauuggguaucuuaucacggauuuaaaugugacuuuaaaaaaaaugaauaaaaauucuacagggucagggugugggagaagagcauuuuagacauagaggaaauaauauucaaagauaacaaaguaagaaauguauaauagauguaggaagcuguaauugguuugauauuauugaaaauaggguaagcaagccuaagcaugaaaauucauucacuaggugcuuuagguuauacuguagucauauuuuugguguuuaauuuguuggaaauuauaaaucuacuaacauuacuuauagcuacaaaaauguuaacaacuuuaauaccuagcaaaauuagauauuuuuaaagaagguagucuuguauuuaaagauaagucagaauuagaguauuaauugaagacauuggacuacauauaacacacuuuucaaauaaucacaaggcauuuugcaucuucugugccguuuauguagcuugugguccuauuauuuguuaaacauaguaauuucauauuuagguucucaaagcagaguuacaaaauauggauaagguuuuauagagacauuuucuuaagaauuauggcuauauuugugaaauauaaaaugucucacagcuguauuuguacauggcggauaaagugcacaagagcuguaaaauauucuuauagcuggguuaaagaauaguucgguucuggccaggcacaguggcucacgccuguaaucccagcaccuugggaggccgaggugggcggaucaucuaaggucuggaguucaagaccagcuugaccaacauggagaaacacccucucuacuaaaaauacaaaauuagcugggcgugguggcgcaugccuguaaucccagcuacucuggaggcugaggcgggaaaaucaguugaacccgggagguagagguuguggugagccgagaucacgccacugcacucuggccugggcaacaagagcgaaacuccaucucaaaaaacaaaaaaaaguaguucaguucuaccuuuuauuuuuuugagacagucucacucuguuguugaggcuagagugcaguggccugaucauggcucacuguagccuugaacucuggggcucaagugauccuccuguggcacccucccaaguagcugggacuaaaggugcaugccaccacacucagcuaauguuuugauuuuuaguagagacgggcucaacauguuucccaggcuggucucaaacuccuggacucaagcgauccuccugccucagccuuccaaaaugucaggauuacaggugugagccaacauacccagccuacuuuuuaaauuuuaacacguuuccauggaauuuugauuguguaaauuucucauuuguagauuuauguugaaauugagcgugcgcgacugacuaaaacauuagcaacuauaaaagaacaaaauggugaugugaaagaggcagccuccauuuuacaggaguuacagguaagguauugcauuuuagaguugguaaaacuuuguuuugucagcagcauuuucuaauggaaauauagguugaguaucccuuauccaaaauguuugggaccaauaauuauuuuggauuuugauugaaagccugugaauggcaucuuuuuucauacugaaaauugucauuuccucauuagccauuaagaagaugcaaauuaaaaccacaaugggguaccacuacauaccuauuaaaaugccuacaguuuaaacaauaaaauacucauugcugguggggaugcaaagcaccuggaacuccuguaccuuacuggugagaaugcaagguggugcagccagucuggaaaacaguuuggcaguuucuuauaaaguuacacauaugcuuaccauaugacccagcaaucccacucuugaguauuuacccacgggaaaugaaaacuuauguuuacguaaacccagucuacaaaaccuguucagaauagcuuuauuugugauaguaaaaagauaaaaucagcucagauauccuucaacaggugaauaaacugugguaugucuguacgauggaauacuacuaagcaauaaaaguaaaugaacuauugauguauaacuugagugaaucuuacaauuuaggccauuauacagagugaauaaagacagccucaaagaguuacauacuauauuugacauucuugaaaagacaaauuuguagugaugaaguacagaucacuggaugucuuaggagggcuuaugagugggggaagugugugauuauaaagggacaguaugaggaagauuuuugggguucugugucuucauugugaugaugguuaugcaaaucacuacaugaguuaaaauucauagaauuuuauaccaaaagggggaaaauccauuauaaauuguaauuuucuagcgguaacuagcuuuuaauguaauugucaacacucucccuauauacaugaagguucuuauuauuuaacaaggaugaauauuuuaauaucuauuucauuuuauugcaauucacaaaauugcaaaguauuauaaacuuauuuggggaauuacugugcuagguggaaaccuacgggucaauggaaaagaaagagcgaguggaauuuauuuuggagcaaaugaggcucugccuagcugugaaggauuacauucgaacacaaaucaucagcaagaaaauuaacaccaaauuuuuccaggaagaaaauacagaggugagcauaucugugaccacauguuuacuuuaaaaguaugaauaaaacccauaaaccccaauuuguuuugucaacuuuuuugcagaaauuaaaguugaaguacuauaauuuaaugauucagcuggaucaacaugagggauccuauuugucuauuuguaagcacuacagagcaauauaugauacucccuguauacaggcagaaagugaaaaauggcagcagguaagaauauauucguguaauugacauggcuucuuauucagaagaguaauuugcuuuuuuuauuuucaaaucuuuuuaacugcaauaguuagaugcaauuguauggugcugcuuucuauucaguguuguucaguauauuacugauucaguccaauugcagccauaguuuagauuaugucucacuuuuggagaaauguaggauuccuguuuaaaauguguacagugggucauauccuaauaaagguugcaguuaaagacccggcauuacuuuggaaaauuauuuuacaaaagcuguuuuaaggggcuuauuuauauauauauuccacauuuauacugcuaacuuguuauaagaacuuuuucuuuauacauuugucaaaaaugaaugucaagaaaaaugucagcugaggggaguaagucagauuagcaaugauuuauuauaauaguuuugugaaaacuaaauacuauagaaagacacuaugaaaaggcagccuugcaauauuuuuccccuuaagacuuuuuuuuguuuguuuauuuguuuuuuguuuguuuuugagacagagucucgcucugucgcccaggcuggagugcaguggcacagucuuggcucacugcaaccuccgccucccggauucaagugacucgccugccucagucuccugaguagccgggacuacaggcaugugccaccaugcccagcuaauuuuuuuuuuucuuuuuuuuuuugagacagagucucacucuugcccaggcuggagugcaguggcgcaaucucggcucacugcaagcuccuccucccagguucacaccauucuccugccucagccucccgaguaucugggacuacaggcacccgcccccacgcccggccaauuuuuuguauuuuuuaguagagacaggguuucaccguauuagccaggauggucucgaucuccugaccucaggugauccgcccgccugggccucccgaagugcugggauuauaggcgugaaccaccgugcccggccuaauuuuuuuuuauuuuuguauuuuuaguagagaugggguuucacuguguuagccaggauagccucgaucugaccucaggagaucugcccaccuuggccucccaaagugcugggauuacagacgugagccacugcgcccggccaagacuuuaaaauuugaaauggauauauaguuauuccaugauuguucaguuuuugucaaaguuuccauuauguccagucuugcauauaacuuguuguacaacucuuuuaggcucugaagaguguuguacucuauguuauccuggcuccuuuugacaaugaacagucagauuugguucaccgaauaaguggugacaagaaguuagaagaaauucccaaauacaaguaaguacuuuugaaauuagcaugauauaucucagucgaaacaccauuuugaaagaaaauuggcuaaccuaaguguauacuucuguguauacuucuuuuuuugagauggaguuuuacuauuguugcccacacuggaguguaaugguguaaucucagcucacugcaacuucugccuccuggguucaagugauucuucugccucaaccuuccgaguagccgggauuacaggcacccgcuaccaugccgagcuaauuuuuguauuuuuaguagagacaggguuucaccauguuggccaggcuggucucgaauuccugaccccaggugauccgcccaccucggccacccaaagugcugggauuacaggcuugagccacugcgccuggccuaaguguguacuucuuaauugguuacugauagcguauacuagagaauaaaacuagagaggauaacgugguggaauuuuuuuuuagcauugcaucagcaguaaaugagauuauaacauacuuucuucuaaauugcuuaucaaguggaaguuucauaucaggucuacauuugcagcuuuugauuaauuauuugauagaguuucaucauuaguaguuuagagcuuugugauuuucagaaauacauacuugugaaaaucuauuauauaaaauagacuugcuucaucauaaacacaacaggcucuuauuucuguuuguuucaugaguacauuuacauucaguuauuucagaaauugacagugcagaagagagcagaguguuaagugggagaaugcuguauucugaacuacugugggaaaaaugguaauaaaguugguaaaauacacaauaaucauauggugucucauucuacuaaauaaaauuuaacgaaaacagucuuugcugaauuuuuugaacuuugcuauuauauuaguuaauacuuaauuuuuacagauuuggaauauuaagauguauacaauuuucagggaucuuuuaaagcuuuuuaccacaauggaguugaugcguugguccacacuuguugaggacuauggaauggaauuaagaaaagguucccuugagaguccugcaacggauguuuuugguucuacagaggaaggugaaaaaagguggaaagacuugaagaacagaguuguugaacauguaagaaucugucauagagaugacaauuuuuauuuuaaccuuuagugaauuuacuuuuuagaauuaaauuuuggcaauuuugagcauaaacuauuucauuugucacauuugauaaccaaauguucauuuaggauguuauguguuuaauucuucacuuaggauauuuuuuuucuaugcccacuguaguagugaugcacauuugguguucagauguuuacucugcauuucccaaagcauauuggaauguaucucacucaucuuggguuuuuucccuauuuuuggcuuuucagaaaagauagcuauauuuuagcuugcuucauugugagagaaccucuuaagaauccaaaauuuauaguauauaaaccagacagaauuuccgaagaaugggggcaggaggguguuucucucuuaauauucacuagucuuggaagcagguaacaugucuuaaaccugaacuuugaucuuuuuaguaucacugccguuauguuguauuauguugccauucacuccuucauguaacaaacuuuauugugagccuucugugugccagacacuuuacaaagcaccagggcacacaggagaauaagacaguacccucccuaggccgggcgugguggcucacaccugugaucccagcacuuugggaggcugaggugggcagaucaccugaggucaggaguucgagacaagccuggccaacauggugaaaccccaucuccacuaaaaauacaaaaauuagccgggcgugguggcgcacaccuguaaucccagcuacucaggaagcugaggcaggagaacugcuugaacccaggaggcagagguuucagugaacggagaucacaccaaugcacuccagccugggugacagagcaagacgccgucucaaaaaaaacagacauuacccauuacucuaccuuuaauaagauuaaaaauuauagggaaagacguacuuauaaauaaaaagaguaucagauauuguaguacaaguaucuagagagcagagggaggcuuaugggaaacuuugguaguucuacauggagaaaugaucaggucggaugaaucgaugauugaggugagguuuguaagaggagugugagguuaucgggcagacaggaacaagggagggcagccugcgcaccaagucccucugagagugaguguggagaaugcauuuggagagauaggagacuagagaagacuaguaaggugagagauacauggauuuuaaauaaggcaguagccaacggauuaaagacugcuuggaaugggauuguuuuaaggaaggaaaucaauagaaugcagccauugauuagacuuaaagcaugaaggaaaagguuagauuuaaaggauaaaagcacagagaagaaugcuucucgugcuuucugauguguugguguugccaucagcccugauagagaugggagaagauguagcuucuucaaagauugaguucauuuuucuccccacuguucccccaccuuuuuuugagugcuauuguuaauaauacuaccaauaagaacaguaaaggggagucucugugucuuaacuucagcaccaucgccaguugaaauuaggaaauuuaauuugaagcuaucuuuaagucauuggaauaaugguaaagugaugaguauuugaaaugaugucuaaucuuuuuuuuuuuuuuuuugaaagagagucaguguagcucugucauccagacuggaguacaguggcacagucauagcacacuguaaccuugaauucucggguucaaagaauucuccccccucagcuuccuagguagcuaggacuauaggcaugcaccaccauauucagcuaauuuuuaaauuuuuuguggggauggggucuugcuguguucccaggcuggucuuggucuccuggccucaaacagucuucuugccucagccucccaaagugcugggauuacaggugugagucccugcacccgaucgaucuccaaucauuuuuuagauuuuagccuuuaaaacauuuguguuauaauuagaaaaucuuaacuuuagauucuugcacucagcaaaaauauuucaguacaauuauaauuuuuaaccacuaguuaagacaggcauauauuuugacuauauauuuaaagagcuguguagaauauucauaguaauucagaauaacuacagaaaccaaaauaucuaaguauuuaguuuuguuauugaaacuuagaacuagcuuugcuccagugauggacuguagaaaaauaaaagcucugagucuaacauuuuaaguaaacuuacuuggauaugaaaauaaauggacuuuuagacuuacugacaaauguuacguguucucccugcucucuauccucuccccagaauauuagaauaauggccaaguauuauacucggauaacaaugaaaaggauggcacagcuucuggaucuaucuguugauguaaguaguaaucaacuuugaguuauuuguaggcauuccuuuugaauguugacuuguaaaaauugaguaagaaaaucaauguuaugauuuaauuuuauguuuagguaauagaguaauaguuucccaagcaaucuugaguaccaaaaacuaacuuaaguaucaagugauccuaggucuuguuggaacaguguugucuuuagguccauguuucuauguugacaaaaugcauagcacacaaagaggaguuaacccaaguguguaguaauggccugaaagccauuucuguccccagaaggaucugugacaguuuaggugguaagacucauggaacauuagaguuggaagguuuguuccuugaucagcuugucagcucuugucacuuaugaaugagaguaccagaguccuuagaagucaagugucuuguccgugguacauacuugccaaguagcagagcauauauucuaacccagcauuucuggaaacaaauuaacuguaccauacugccuuuuaaggggaaacuuuguagaaaagggaguagaccaacuugccguuggcauggauaccagcaguauugagcuugcaaggaggcagauucaaacucaccccugacugagucuacucagauucuauucauucccuagacuaucaguaaaauaaguacuuauuauaggaagucagcaguugcuaacucuuuuuuuuuuuuuuuuuuuuuuuuugaggcagagucucaccuugucgcccaggugggagugcauuggugcgaucucagcucacuucaaccucuaccucccaggguucaggcgauucuccugccucagccuccugaguagcugggacuacaggcgugugccaccaugccuggcuaauuuugguauuuuuaguagagaugggguuucaccauguugcucaggcuggucuugaacuccugaccucaagugauucacccaauucagccucccaaagugcugggauuacaggugugagccaccacacccagcugaguguuacuaacucuuaagaaugaauuccccugcauauucuuggaugaagaguucagaaaaugcuuuucugaaguuuuguuuauugucuguaauuuauccugucuuaauccaauuuaucuuucucucuugcaggaguccgaagccuuucucucaaaucuaguaguuaacaagaccaucuuugcuaaaguagacagauuagcaggaauuaucaacuuccagagacccaaggauccaaauaauuuauuaaaugacuggucucagaaacugaacucauuaaugucucugguuaacaaaacuacgcaucucauagccaaagaggagaugauacauaaucuacaauaagggucuuagugcuuuagaaaaaaguuaaaauuggaagucauuaaaaaaagacuguuauaaugguguauauguugggguuuuuuuucuaagcuucuuugucuuaaauuuuaaaauagugaauauguuugagacucccuuugaccuuucaguuccccaaguucauuguuaacuuugcauuugcaauuggugcaaaaauacagauuucugucgucugaauacacaaaaaguugugucauaacuuacccagauauguuuuucuaucauuugaaaccuuuuuagcuacuguuuguuuucauucaacuaacaaacauauuccaauaauaaaagcaguauauacaua

SEQ ID NO: 192319 - RNA, 127633 nt, Homo sapiens
uccuuuuugauauuuuuauaauauucucaaagaugcauauuaaauaauuucuucuggaccacagacacaauugaacuuaaaaaauaaaagcccuauaaauauugcuaacccaaccuuauauuuuuuuuuugaaucucccuucuuguauaaaauggaaucuuuucaaccaagcacuuaaacauaaauauuaaaauaauaaaugggacaaacuacaaaucuacuuauaauuucaucacuaccguagcaccuuuuugucagggccaaugcauucauuuuguaaagaauaagagaagucugagaagcuugaggacucauaugacacaucauuaaauauuuaaucaccuuuugaaguccuaagccuuuaucauaauucauccaucuagacaguucauucuauacuauagauuccaaggcccccuuaagagggggaguaaaaagaaaauugggagagaaaacccucugagaggcaggguuaaauuaucucaaagaugacuuucuauugaugcuguagugaacuugcuucaccccgaaacccaccaauccacaguagggucaaccgauuaaguccacugcuuuuuagucuccaagaaucaguuuuacaaaagaugccacaucuguuccuuuggauucauguagggugaaaaauggauguugcuggaaaagaaaaagaaaaaacaugguauuaaugucuuacugacaaucaauauaugagauuagcaaaugaauagaucugcuugguacagggauuaaguaucccuaucagagcuaggcugggcuuuuccuacccuuuccaaaaucaagcacacaucuagugaugcaaacauuuuaaagauaucucuuaguugucacucuuuccaucuugauaucucuagguuuccacuauauuaaauuuuaaaaaaaaguguaauuaugcuacguaagucucaucuacagcaaaauacaaagauugacaaaaaacaacccaaacucugauuuacaaauagcccugggccccacaaggucauuuuaggcuaauauaguaguaagauaauaagacaauucauagguguauguacuuuuuucuuuuugagauggagucucgcucuguugcccaggcuggagugcaguggugcgaucuuggcucacugcaaacucugccucccggguucaagugauucuccugccucagccucccgaguagcugggauuacaggugcaugccaccaugccuggcuaauuuuuuauauuuuuaguagagacaggguuucacuguguuacccaggauggucuugaucuccugaccucgugaucugccagccucggccucccaaagugcugggauugcaggcgugugccaccaugcccggccagcaguaugcacuuuuauuucucaggaaaaagaugauggaaugagaagccaauuuuguugaacaguaaacgugcaaggaagguagcccucgcccuugacguuggagaauugguuuagacuaaaacaguuaaagccauuugccaagccacgagcuuuauuuaugucucuccugaugaagaguugauccaucugaaaaauaauguagacugccaaacucuaguuaugugcagagaaaacugaacucggagauuaaagauugaaaagggaaaagaagagucucuauccucacagcucagaacaaguaaacucuaaaaacauaacaagucuuaugcuuugcuaggggaacaagcaugguaugugauucaagaggccaugcauuucaaaacaauccugagcaggaagccauuuucucugcacuagaacaauucuccccagauugcucaauuuuguuacaauaagugcccagcucucacaguggaaccugccaccucuacuuagaaagauauaucaggucaugagccacaguucuuauaguggaaauagaaccaaccaaaccuaccccaaauggauaauucuuacagguagaacuuagucccacgugucucaccucccaugcucacucccuugauugccugguagucuauuuucaaugaccaguugaguagcuaaauguaagcauuuuuacauccagacacauaagugacucacucuguuuccccugacuuuagggaguuuaguuuacaaccuuuauguugcccagcuguagguuuucuaauuauauuuguuuuaaaccugacagcagaggguuggaugagucagcuccguggaaaacugaguuccugcucauggaaacucuaggaaacaaugcaaaugggaaaggaacaaagaaauaaaaaccccaaagaagauagcuggucgcgauuaaguaucaugacucagaaaauggaaaagagauuuucucccuuugcccaucugaggacacagguugagugcuggcuccgauccuuacacucaugaaaucaacugaagcucugagugccagguccuuccuccugagcucccucaaaaacuaaauagcagccauacuucugauuagucaccacauacacagcacacuuaccaaggacucuaccaucaugcuuauuagcuuucccacauccucuggacauuuggaaaucuuuuaauguacuuaaaagcuuuuuacuaucaaaacaggacaugccaaaccucagauuaucuuggugacugcuuccaacaccugccagccccaccuugccuuuuguucugcuaguggcuauuagcucaguagauguugccugagucugcaaaugaauuaaauaaccugacuugaagucuuuaaucaaaaaaaaagaaaaucgcuaggcaucuuuccauuuauucccagguugagaaaaugcuaugagagccagaagggcagggggaggggaaaacggguaggcaugacaaauggaaagugugacuugccuucuuguguggguuuugaggcuguaaaagguuaagagggaacccagucccuccuauaagcaauggauuaagauuagcaagggcagcaaccaggaaauugacaaaugagggacuaugaauaauacucagacuauaauaccaggcuggguuucccaaaagaggagccagggagacaagaagggaggacuuuacaccauuuagucucacugaugugccugaagaaaacauggagauccgugaacauacuacgaggaauagacagacaagcuacagucaccagcaggucucccugucccaugcacagcaccucaucccuuaagacuaugguuuugaaugggucaggcaucuuuguuuaacauacaguucaaucuagaacuuccuaagauaauuggagaacauuauuucacugggcaaucacuugaaugaacugguuaucuuuucuggugauuaucaucuaggacagggaucagcuaccuaugacccagaggccaaauuuagcccacugcuuguuuuuuuaaauaaaguuuuauuggaacacagccacacacaccccauuuuuuuuuuaacacaucggauauggcugcuuucacauugcaacacugaauuaagccauuguaaacagcaacuguauagccuacaaagacuaaaauacuuacuauuuaguccuuuacagaaaucguuggcugcuaccuacuuuagaagaacaaauucuacugagucauacuccccagugacauuugagagaagaagcaaaugacaugaucuuaaagaauacacacccuucaauccguguuagggagagaaacauuugggauuucuauaagagggacaugucuagguuaaggccuuaauuaaacuguccuucaccuggaaaaaggauuauuuuuuuccuucauacuuccucaccaacuccuaaaaucuaaacaauugccucucagcaaguguuuucccaaugcuaaagucagggaguuuggacucagauuuuccguuugaaaaccucaguuccacaggaaagcagggaacaguuauagucuuaaaaggcaaguccauuuccaguaccacaaagacuaaugcuguaagaagaaaagggggacugacaugauuuuauaacauugauauauauguaggccauaaaauaucacaggguuagaacauauuacaaauguagaauuugacaucagcugcccauguauauuaagcauucuuuucucaaguguguuucagugaaauuucugauccgaaaccauuuggaagaagaaaaaguagccagaaauauauagaaaauguucuucuuaucugaacuuaguuacaaaacauggcaacuuuagaauaggaguacaggugcacacuuguagucccagcuacuuggggggcccaggccgggggauuguuugagcccacgacuucgagaccagccugggcaacauaaugagacuccaucucuaaaaaauaaaaauuaaaauauaaauaaauaaauaaaauaggauuacaggcuccauaguauccuacaagaauaacuguauaucuacuguauuuuauaugaaauuaauuuuaaaauggccuagcgggugcauaagcauauuuaaaaagaguaaacagaaccaaaaaagccuuugacuggcuauuaaaaaauaaucgggaagaaaauauucaacuuaaacauguacuaugcuaggauuuucucaaacauuacucauauuuccuucuuuaacugugaguuuuaguugaauaaagaugguagagugcugagcaccaggggcugccuuuuaaugcacccaauggaggcccaaugagauggucucaucuccaauucauccaguugcaaaaugguucaaucuucaaucaaagcuuaggcaacagaagugaaaaccuaugugauuggcuguaacuaucacgcaucuuccugaucagcuuucuguaacucuuccugacucgacauuuccaagcugugcuuccucauaucuaagccaccucaccacagcauuugacacuaggaauccaugcuucuaagacaugcccugaguuggucuugaagacagcagggcuuguggcugggauagcagaggagcaagcauuuaaugccugaugaauaacuguguuccaguaagaaagggugucaguguuuuauugcuuuugaaauugugcaugaacguaacucuuccuuccccugcuaaaaugaaaaccuugauaauugaaacaaaucuaggaauuaacauaaauuagcaaauagucugaauuuuauauauuucucccccccaaaaauguguuucuccuacauucaacauauacuuagauaaagcaaagcauugccaaguuuagguccuugccauuuguauuuagcuuuuagaaucauuaguaauuagcuuagaauuguaguuaccagaguuuuguuuguuuguuuguuuguuuuucuuugagacagggucucacucuguugcccaggcuggaauucaguggcacaaucacggcucacugcagccuuaacuuccugggcucaagugauccugccaccucggcuuccugaguagcuggggcuacaggcaaaugccaccaugcccggcuaauuuuuuguacuuuuuguagaggugggguuucgucauguugcccagguuggucuccaacuccugggcucaagcaaucugcccaacucggccuaccagagugcugggauuacaggcaugaacagccaccaugcccggccuauaguuaccacaauuuaagaaacguuauuuuaauacaacaaacaaugcuaagauauuacuuucuucacucuugcuuuuuauagacacagcaagugauaaacugugaaugcugagggaguauaauuuaaacuaaucaugcuuugucuuacuuuuuuccaccaaagugaaaacaaaaagcaaaauuuuuuuuccuccuuagcuaccccccaaaaaguuguucaucuaauuuagcccagauauuugaucaaaaauugaucagucaaagagcauuuaaguuuuccucaguauugaaaucucuuaaaucauacuuuccuuaauuuuaucuuaguaauaugaggcuucucauaucuuuuaaauucaaaaauauaaauuguauacacauaauuugcucuguaucaugacagguuuauuagccuggaaaaaaacuacuaagaauagugacaggucccaaccuauguuuaagaaggauguaggaugaacucuuuaacucucuuuccuggaguucaauuccugucacugauguaucaaugaaccaacucuuccaauauggugaugugaugauaauuuaggucuuagugacuuugccuuuuguagcuaucaguauagucauguuuacguugcuaacaauacucaccauuagcucuggguauguaggccguucuuuggaauucuucuuuaagcuuaaagaaaaaaaaauaaucauuaaaaucuagaagccauauauauuuucauuagacaaggauuucagaaccuguagaacacuaaacauaaucagcuuuaaaaguguauugaaaacacagccuccuaucuugacuuuccucuucuguaacacuuauguaucauguuuuaaaucacccugguugugccuuaaugggaaaaauaguuguguguguguguguguguguguguguguguacuuuccuuuugauacuuuaccgaugauaugcacacuaauuuuucugaucuauagccauuuuauuucaaaaaaucuacuuuccuucaaagcagcuuuaaugccauuuccacagacaaagaaauuggcaaguguuucuuacauugccauuuguuaucucuucacugucagguaccugguucuuuuugcuucuguuucccaugaauguauaauuugcuuuuauauaguccuaaccaaaucugccugagauagaagcaauaaaccccuaauauuuauuuucuuuuccuugagacaggggcuggcucuguugcccaggcuggagugcaggggcauacaaucucggcucacugcagccuccaccucccuaggcucaggugaucuuccugccucagccuccugaguaguugggauuacaggcacgugccaccaugccuggcuaauuuuuguaucuuguagaggcaggguuucaccauguugcccaggcuggucucgaagucuuaggcucaagugauccaccugccucagccuuccaaagagcugggaguacaggugugagccacugugcccaaccccccauaacauuucuaagguaauacuacuuguuuaugacaaagguaauaagaccuguuuaugacagcugauaaaagagagagcgcacucagugacagcaauuauucuuguuagaaauacuuuauggucaugcgcuauugucaggugacuucugguuauucugcucuccauugacacagacauuuaauaacauuugauaccggaggcaauaaaugcuguuacuuauuauuuaacaguaauaaaacuguaagaugaagagaccaacccaucaccccauucucagcccaucccuauccucuauccaacucuggccuuaaaaugaaaaaaaaaaaagaaaaagaaagaaagaaaagaaaagaaacaauuuacuuggaguuggaaucccagguuacagaaugcagaaaaagaugauuuugaaaacuaugauuugcaaggcaaccuacagacuccugugcccaacggaccacaaaaucauacaugaauggaaaggagcuuugccuggcauuggaauggaaaggaauuuugccuggaguuggaggaaucaaaauguaacugauuguuagguugcugggauuugagcuaagggaucauuuugagcaaaugagaccuagcaugugugacgugagcucugccucacccuccgaagcuaagcaugacgggguaagguacagaaccaugagagagcgaaguaguucaggcacuuugagaaacugugguuuaaaacgaaauaaaauuaaaaaaaaaaaaaagagagagagaaaguuuuugaaccaaaacaacuuaaaaucagccuaccaguuuguuccaggcaaugcuguggguggaagccagggaaccugagacaggcuacagguagaugugaggacagaaguuucaaccuggaacugagggcagaccuaggaccuagugaccucagugaccagacaaccuaugagagaaaguuucaucucaacugaggauaaaaauaagagcgcauuagaaagaggaauuaacaggcggcaaagucugauugauaugggaaugugugcugagugaaaugaaugaguccguguaacucccaccgaugguuuuguagguaccuagaugcugagagucuacgugggugguucucagcuggaggucauuuugcuccccaggggauauauggaaaaugucaggaggcauuuuugguuguuacaucugguggcaggguguuacuggcaucuaauagguagaggccagggauguugcuaagcauccuguaaugcacugggcaaucccgcacaacaaagaacacucuagcccaaaaugucaugagugcagagauuaagaaacgcugugcuuuguguaauagguggucccuccuuguugcggcuuccucuccccuucacuuaaaaggaccaucuccagcugguuugucuuugucuuuaagcacauucucaccacgaccgucuccugcccucaaccccaggaagcaaaaguguuucuuucuaaguucaagagcuaguuuaccuagaaagaaacacagaagaagcaaugugaucccaggagcguugcugacuugcacacagacccugguaaaaaaaaaaaaaaaaaacaaacaggcuagaagcccugaauuucccacuauuguucaaagcaaaucaaaaaccagaaaugcuucucuaucgcuggaacaauguaacacgcuaaguaaauaacaaaaagugcaagcacaacauuaaauccacacucaauauucagaugguugauucuggcugucucuauuuagaccuuaaacuccgcauugcaucuggaacacucucacugaggacccaggcccacuccguuacuagcuuucauuggucaacaacagaaccaaggcaaugucaggaagaaaagcuuguuucucaaauguaaaaaugugcugauuuuuuaccuuauauuuagcagaaaagauaaaaugacugucucuuuccaacagauagaugagcuuaaacaucuccauuuuuaaaaauacuguauuuuuuuuaaaugcuguauuuuuuuaaaauacugauuuugagucaggauaucuuaucuuuucacuucuggaacagcuuauaaagauuucucgaccaggugcaguggcuaaugccuguaaucccaacacuuugugagggugagacagguggaucacuugagcucacuugaggucaggaguucaagaccagccuggccaauacggugaaaccccgacucuacuaaaaauacaaaaauuagcugagcaugguggcaggagccuguaaucccaguuacuagggaggcugaggcacaagaaucacuugaaccugggaggcggagguugcagugagcugagauugcaccacugcacuccagccugggcaacagggugagacuguaucaaaaaagaaaaaaaaaaucuccagauuuuuguuaacucuguauaaagaaaauauggggaaaguacccuaguugauccaucauaaaguguuaaggauuccugaaaccuccaagacuaacuggucaauaggcuauuccuugacucauggccccugauuagaaagcucacaaucuaccccaaacacuacugcagaauauagauggaaaauacuuacaccgcaaagcaaggcuguuuauuaaauuaauggaacugauauaacccauucucuccaucuuuuaaaucaagaacacuucaaaacaugggcuaagaauagcaauacacucaggauaagguuggggggaaagcaaauuuuccauguuuaguaggaaguacuugaaauucaguauacaauaacaacuuuggaguucaaagcaacaccaauuucuuuuugaacuggaaucagacuuuugaauuuucaaagagcuucucauuuucaagcgugcaauuagcuaacugcccuaauuccuuuuccaaaugccacaacacacgcuucugaccauagcugacacuaaaaaacagcucaugcugucuugagaauugcuagcuuguaguuugugcugaccagaggauuucugccuauuugaauucccccgaucauuuccaagaagggcuauuugguacauccacagaauaaaaacacauugcgcguuucaaggcauacauuugucaaaagcuaaauaaacaucuagugccucuuuuuacuguccuuccuacacaaguaggagacuguauuugacugucuguguuuuaugcuaguuucccugagucagacaauauugaugcuugagugggccuccacuacccuucaauaugccaucagacuggucaguugggcccacagcuucuuaaauaggccuggagaaaaagccaaagggaaguccagcugaucuggcacucggcaguugacuuccagugacuuccuucugugaaccuauaggaagaguuuauaaugaaaaguguaaaccggcuaagauuccaaucuuuugcgaacucguuuguuaacccuucugcaggacuagaaagcaagacuucucuauuagacuucucuaugaugaaucucaaaacaaggcugacauggucaacacaacccaacucaagaacuccuuaaaaccccuacgauaagaaagagauauauaggaaaaagaggaagaaaaucucauucuguaguccuaucucaaaauaaauacagaaaagaaggguuuguaagaaaccauuguggguuugcuuuuuuccuuuacguucauaugguuaauucuuccuucuccuucaagauaacauuugucagauguuacugcaaaagaaaugcaaaaacuggaacucuggacucuaggucuaacuuuggguguggugaugauagccuguuagagcuuuucuacuucacccuacaaacuaagugauuuacugucaacuaacaagcagugaucaauacugaugggccagacaagaguggcuaccaagucaauucccuggauacagaauuaugguaccuugcaacauggugauggcaucgugccaaguugauuccuuggcacggguaugauaccuaggcagguguaugauaccuaguagcuuugugacaucgaaugcuuagguaggauacacaaguucacaaauacucugacaguuaccuaggcugcggguauaauggguucuuuuucugcauaccaaagacagauguaggcaauaaaaacauagauguaucuaucuugaaauuugagauuaaauauuucacuuuugaaauccguagucucccuuccccacuuagcacauagagcggccuuucugagaagucugggaggaccauagccuacauaauaaaaauauaaaaaacauggagcucacgaaaaaaaaaaagguccuuuaaugaaguuaugucucaauaacacagcuuuauucaugagaaaaauaaaagaauagcugauaaaggggaguuacgugcacagggaauguucaugaagagguagaagagguacucuucuguuaacauuaucacuuuuccauucuuuccaccaagcuccagaucaaaccucaagcuuucaguaaucaaacaaguaaaaucacuagauggcuaauggcuggagguauguacccauauauuaauauauguaugaaaaauaaaauugcuuccguaaaguucuaggccagucauaaacucuaaaagaaaaucagugcuacuuuuugaguauaagaugacuuuuucaacccaguugaaaaauaauguucauacuuaagggauaucaaagaaaauauauuggugguuuguggcagggaaaaaaaguuauugaccugggaucugaaauaggagagcuugcaugcugaaaaagucaaacugaggauaaguaagaaugcucauaaaauucagaauuaacgauucccuucuauuucuuaauucccauaccaacaaaaugacuauuuuagacaacugauauucuuaaguauagcauucuaccagaacuauaauacugacacuuugaggaaggaaaauuuaucuuuuaaugacuucuaggguaaagugauuuggguuuuguuucuagauaguuucauauuuuauuuuauuuuauauugcauuuuguuauuuauuuaauuuuaucuuauuuuggcaggaucuugcucugucacccaggcuggagugcagugggacaauuauggcucacugcagccucagccuuccaagcucaagcgauccucccaccuuggccuuccaaguagcuggguccccaggugcacaccaccacacccagcuaauuuguguauuuuuuguagagacagaguauuguuuuuaauauacccagauauaagacaaacugacuuacuugaguagaaaugacaugacaccgagcaaacaguauuaauagaauuaacaguuucaggaaagcugagacaugucuacggcucaaaauuuuuuaauuaaugaacugugguagcugggauuaaaauuaaaagaaaaugagagagaaggggauaucuuugcaggcagccaugaaggcacuauggguguuauaaggagagagaaggcacagggcagucauuauaugaagagcaaugaugccgguaucuggaacuuccauauaugugugcauacauuaaaauuagaaaaauuggccggacgcaguggcucaagccuguaauccuagcacuuugggaggcugaggcggggcagaucacgaggucaggagaucgagaccauccugguuaacacggugaaaccccgucuuuacuaaaaauacaaaaaauuagccgggcgugguggcgggcaccuguagucccagcuacucaggaggcugaggcaggagaauggcgugaacccaggaggcggagcuugcagugagcugagaucgugccacugcacuccagccuggguggcagagcaaaacuccgucuccaaaaaaaaaaaaaaaaaaaaaaauuaaaaaccauuuauuucucaagauguucauuuuaaaauaucucuaaaaaguuucaaugcucugauucuucggagaaaauuccaguaagagaaaaaauacacuggugaaagaaaauucaagcaauuggaugauuuuuuuuaaacaaauugaagaaaauaaaccuucuaaacagaaacuaguugauggcagguccauagaucauaugucuaaaccugggguuaucaccgcagcuguacauaaaaaugacuugagaacauuuaaaaauauauuaguaucuuggccccuccccagaucaguuaaaucagagucuaugaggaugaggccuagggggcagugauuuugaaagcucacuagaguuuuauaaaugagcagccacaguugagaaucauuggauuaaacuggugauucacaaugguagacucagcuuucucaaacuuuucacaccagccucguucuuaccaaaauuuccuaaagcacccagaaucuugggaaaaggggauaggugggagaaagguaauagggagaauaauuugaagagacuuagcuagauaagaucauuccccauuaccaccccucuugagaacuacuguucuguacuacccaagaugccucaucuuuuuuuuuuuuuuuuuuuuuuuuuuuuugagauggcgucucucucuuaucacccaggcuggagugcaguggugcaaucucagcucacugcaaccucugccuucuagguucaagcaauucuccugcaucaaucucccgaguagcugggacuacaggugugugcuaccacacuuggcuaauuuuuguauuuuuagcagagauggguuuucaccauguuggucaggcuggucucgaacuccugaccucaagugauccgcccaccuuggccucccaaagugcuggaauuacaggcgugagccaccacgcccggccccucaucccuuuuuuugaugugaccuuaaacaucugaggauaaggcaauaaauaaauaaauaaccaaccaaccaaccauccacaaaaaacaagucuuugaauccagaaggcaaaaucaugaacccaggucaaccuggcagagguacuaccacauccagcacacucccucaaggaaaacagacaggaagcagccuagaagauauaucuuuuaagaggcauccaacaacuauuacacuagugcucgaggcuccagccccucucuagucauccagccaaaaacaaaaacaaacaacugcagaccagccucauacaucaucagggaaaaguaccagaaaugagaaggggccuagggcuaacaaagagucgaagagcucuuagguucacaagcaacagacaguugcuuuguuuuauguuucuuccauguuuccugaugaaugcuguauucacagcuuuuuuuuuuuuuuuuugagacgaaguuuuauucuuguugcucaggcuggagugcaauggcgugaucucggcucacugcagccuccacuucccagguucaagcgguucuccugccucagccucccgagauuacagcuguccaccaccaugcccaguuaauuuuuuguauuuuuaguagagucagguuuucaccauuuuggccaggcuggucuugaacuccugaccucaggugauccacucgccuuggccucccaaaguacugggauuacaggcgcgggugcccugccucacagcacuucuaaaaaccauggaggcugaggaaugaagccacggggaagauguuccuucagcuuccucaguaccucaaacagccuucagagcuccaggcccuuccccagcagugaguacucagaacggcuccccucccagggucacagcugggccugccaccaucuccgagcccccuuccuccuaauucucaucuacuucucccggauggccaaauacgcuaaccuggcucaggggugugcuucacuucuggcauccugcuuccagcaucacuugccaugaucauuacuaucaagccaugcuaggcaucaugaccucuaugcagauagaaauuacuggauugucuagagaauacuuuccccucuugcuuuucuugacugcccuggcaguuuucaugaaaauauaguucaccucaugaguauggcucccucccacuuuccaccccaacuuccuuuggauucccuucccagaacuucagcauugucucuuauggugggcaaguuucuccacaguuagcaaguauucaguagcaaccaagguucuacaagacuucuggggaccuaagaaacacucucaaacuacccacuaucuucucaccgaaaguaauucuuugccucuacuuccuauccccaggccucuaguggguccuaucagcuuucucuuuaugcuuuaaucaacaucaaauugcuuaaagcucacauaaaggaguuucuugcuuucgugacauugugaaugauguuccuucuguuuggaauauguuuccuuuccuauuucccuuuugucuggaaaauuccucucgugaucgcagcuccagauuuaucuccuccagaaaagccuauccugaggucuucccucugaguuccuuaaaucgccuaugccccuaucucuaucacuggacuugccacauuauacuauaauuauucauuuaugagacuucucuacuugacuuugggcucagugagggcagggagugugauacggucaucuuugcuucuccagcagagagggcauacuccacaaaugcuuucggaaugaauguaugcaugauggauucaaccccgauggaagaaauucaugagaacucaucuucuucuuucacacugacacuugggaggugaggcugucuuaccacugugagguaaagucaacaaacucugcagagaacuugucugcugggaguuguggcgauggcuccucuaccaccuguuugagcugcugaaauggaguuccccaugaaucauagggaaaucgaaggauggccaacucaaucuggagaaaagaagaaaaaaggagacaacaguuucaacagggcugcuuuagggaaucacccacguuucauuuguggauagacagcaggaaacacaaggcaaaguucaaguauaaguccagggguaggggggcaggaaauaaacuaauaauuuguucucuagcaauuuuccccaaauuccuagugcuagggauuuuuaaauauuacuuacuagacacagccacuuaagccuaucuaaaauggggacccucacuaaaacccacuguggcacuucauaaaaauuguaagccaaccguauuaaacuucaggauguaaagcuacgaggauuucaaacguuuggucugacaaguaauucccagccuaagaucuuuccagagccgagcaucuacugccaccuucaggucccuuggugaaaugacagggagaaaaagcaaccuagaaccaaaugacagaucuuuuuuuggacuugagaaaaggccacuuugcauuacaggaucaugugcuuucugggcaggcaggagaaauaacucaugggauuuauucagcugcugugccuggggaggagccaggaccacaguggauaauuccagaccuuggugauccacugaaaauguaugaccaccaaaguuaugaaauuuacaaucaccaaaguuaugaauaaguuaugaauaaaucauauaacuuuagggcugugucuaaggaaaucauccuauugguuaucauguauugaggauauaccugacugauacgguugggcuguguccccacccaaaucucaucuugaauuguagcucccauaauuccuacauguugugggagggacccagugggaaacaauugaaucaugggggugguucccccauacuguucuaugguucucaugguagugaaaaagucucacgagaucugaugguuuuaugaagcaucucccuuuucacuuggcugucucaucucauucucucuugucugccgccauauaagaugugccuuucaccuuccgccaugaucgugaggccuccccagcugcauggaacugugaguccauuaaaccucuuuuucuuuuaaauuacucagucuuggggaugcuuuuaucagcagugugaaaacgaacuaauacacugaccugaucagacuuugacuucuacuucuccaauaaaaauauccugggaagcauagucuauguccuggauaacacggcccuaucaggguucacgcacauuagcauucuuugcacagcuuaagcuucuugccuuggcucgaauaauuuaauuuuaaacuauaaggaaucuggucagauccucucguuuuacagaggaggauaggaagauaguccaugugacuguaacaauuacucaaaaaggcauacagcucgucagagguggaaucaagagaaagauugguuuccccaaucccauaucaguguuuuuauuguaccacaauacaaacaauuauuacucaaaaucuccuaccagcucagcaggagagggcgccccaaaccagcauuuagggcauuuguuucuugaacccaacguccaccucauucuaguuucauuacccacaaccucauaguucaugaugauuggcauacacuaccaucgugaugcccagacuccaaaugucagacuucacacuguaucccuucugguugagcucuggguuuauucuuucaggcuggaaagaagacagacaacugagaaacugggaagacaauugagauaacguucuuagcucaauagucucuggggauggggguagcaccagcugccaagugaguuguuauaagcuguuaacaugccaccaaggccaagaagacccgguuaacuacaacaaauaucaaugccuccgugggguuucccuucuucuguguuugucuuuucuuggacacaguaauggaucaaguuccuuucauaacaaauuuaaaauuugccuuaagaagaaacaggguauacauuauaaagcuacuuugcccaucuagaauuauccuuguuuaaaacaugaacaguccagaacucaauaaaacaagugucacugggcuacugucccaugcuaauagaccugagcaauuuuuagcuaaacacagacaggaagcuuuucaauucaaagcacaaguccauuuccagguagaaucuaguggccguuccuccaguuaaaggggauugcaaggucucugcuaaugacggugaaucuucacagcugugagguccucucauaacuaaucuaacugccuuguuuggguaauuuaagcucuauuuacuauuuuguccucaacaaacaagguaauacuccccugcaauacaguguggaaaacugugcaggcuauauguauuguguauauauuuuuucaaauaacguaucucuuucacuugauuuuuuuaaaguaauauauauauaacuaugucugugccccaccaaaauccacagguuaaaaccuaaucgcacaugugguggcaucagaaggcagggccuuuggggggugauugaaucaugaaaguggaauacuaaugaauaggauuggggcccuuauuaaaaaagcccuagagagaucccucgccccuuucaccgugcgaggacuaagcaggaaggugcuauguaugauccugagaaacgugagcccucauuggacaccaaaucuucuggugccuucaucuuggauuuccuagccuccaaaacugugagagauaaauuucuguuguuuauaugcugccuggcuuacauuacuuugccauagcagccugaacaaacuaagacaauauacgaagcaagugaguaaagauuucagacauaaaauuuugaagaaauacuaagaggcagacuacuucuggagucuuagguacauuuccauuuucccucuguggccauccauuucuuguuucccagcaugauuugucggcagugacauuaccagaugccacccuagcuaauguacuuacggccauguaugguuugcaaccugcaucaauuguuuuagcaacagaguccaccaaguagccacugauuccaaaaucgcacaucuucacuugaccgagagcauugaugaguacauuagaaggcuugacgucugaaagcgaaaacaaccaggaugccaucauuucagccugcuuucaagguucauuucucugccaccagagggccuaaaaucuccauuuguccuucaucuuccuuuccccaagcugcccaacacagaaguaacugccaucccugacccacaguuaacaacagcuuauugcuuucaacuugauuuucuauuucauguuuuguucaugccuuguagaauugugaauuucuccauacaaagaacuguuuucuccacugauuuuaugaucuucauuacccucauacuuguaguaagagccuaaaaaauuauuacugaaucaaauguccaauucaaaaugaucuauugauauuuaacguaggaguaauaaaacaaagaacaaaaaggcagacugugacacaaugauacaccaaauaugaccaaagcaaccuuuguuuuuguuugguuugguuuuuucuucaagauaaggucuuacucugucacucaaccggugugcaguggugugaucauagcucacugcagccucaaacuccugggcucaaaucauccucccgccucagucuccugaguagcuuggacuacaggugggaaccaccaugcccagcuaacuuuuuuuuuuuuuuuuuuuugacagacaggaugucucuuuguugaccaggcuggucucaaacuccuggccucaagcaguccucccaccccaccucccaaagggcugugauuacaggugugagccaccaagccuggcccaaagcaacagauuuugauugaaaccucugcuagcgaugugucagaggucacauaguguaaaggaucauaaacccagguauuccagaccacagggcagguuacugaagaagcaguauuacagaccagauuuuaaacgaauccuuuugacuagaaaaauuuaacccacccgcccauaugcccaaaaaauggaacuacgauuaucucuggauaauaacauuugaaauuacagcuaauuuuucccuuugugauacuuuucauaacacccauaaaauuggaaguaaaagauuauuacaaaagcuuuaaaaauuauccuuuauaauuuucccuuuaagcuagaagauacacaaauuucauuuuauuauuuuuauaccuuacauauuuucucuaauaugaauuacauauuucauaauggugaaauaacccuuaauguuaauuucaaaguugugaauaaucuacagucuuuuuccuaucuguauuccuuccuauuuucuucucaucuuccuucauccuauuuuuccaauuuuuaauaauaacaacuaacaauaauaggcacacuguggaaggcauuuuacauuauuuccaggcucagagaguuuaagaauuauccaaaccacaaggcccucuuacuuaccaauacauuccauuauucuucccaaagacaggguucugguuaucucuucccagaaguuucccugacuacaaucaccacaaucacuacaaucaccugccucagccucccaaguagcugggauuacagacacccaccaccacaccuaacuaauuuuuguauuuucaguagacacgggguuucaccauguugggcaggcuggucucaaauuccugaccuuaggugauccgcccuccucggccucccaaagugcugggauuguaggcaugaaccacggcacccagcuugguacuuucauauuucuaaggugguuuuuuuuuuuuuuuuuuuuuuuuuuuguacauuuaucuuacuucccuauaagaauccugaugcauaauuuaaucagaauauauuuucuucucagauaccucucaggggaucuauuacauuuuaaaagugauuuuaaaagaugaauaaauggaugaauggggggauagaaaaugaaugaauggauggauggaugaauggcugguugaagagauaacaggccaauaagaaggaagaaaaggaaagaggaagagauaaaucauuauauccugccuccuguugucugaaagggcucuacuuuauaccagaguuuuucacacuuucaugugcacaagaaucacccggaaaucuuguuaaaaugcaaauuccaauucauuugaucuugagacccaugauucuuuuccaacaagcucucaugugauggccaauacaagaucaauuuuuaucauauucucuaaaauucucaaugauaugaucucauagcucugcuugcuaacaaguguuuauauucaauuuggauguaagacaaagaucacgucuucuucuuauguccucagccaugauaaggaauacuacuuauaugguuugcuauccaaucucaaaggaaagccccuuaguucucuugccugagucaauucuacuuccacccaugggggacuggggguagagacggacuccaggugaaagagaugaacuuuaucaaaggaacagccaaggcagcucauggaugcuuaccucugugaaugacagacagcuuacuauguaaauguucuaaugcuuuuacaaucugcaagagaaacacaagauagauuuauuuaucacauugcuggaaagaaauugaauguuaaguauaucaagguuuauuauccuuggcuuuagguuaccagugagauauuuucucaaauaguggugguccuaucuaggaaaauacauaggaaguuacacaaauuggacuccauccaccagagaggacuguaucuuauaucagagaggaugucucccucaucugucuuguucauuuguccuccuucuuuuucucuccacccuccugagccugaauagccaugaagguagaagaccuucuuucuauuuauuuuccuucugcuuucuucuaugccuacuagucucaagagaacauuuuaaaaauccauaaaugaaaaucaaaauaaacuaaugucagaauauagacaccaggaauguggucauagcugaugaaugcagcacuuagagucauuuaaccuagagucugccaaaccaaagcagugcuagaaucuucuacacagugcucagaaaggaaagcauguauuuauccauccaccaauaaaugucaacagacauguacgaauaguagcuguggcccagguaguauuucuucauacugagguccaaagacacauagggacuuuauuucucacauuauccuugcaguagggaucaaaauguacucacagaaacugcuauuuucccuaagauguccucuggaauugucuggccuuuaucaauaacuuguuuguagaauuuaucuagugauguauccaugagcuccaugcagauccacacaucacccuggagaccaauuguuucaggaauuguuuaaaaggaugaaaaagggagaaauaaaaauaaaaaaaaaaaacaguaaacccuauccugaagaauuaacuauuucuuucuugaauuuuggggggaaauacagugucuucugucaagaucauaaaggaauuuacaaauaagcaagguuaucuacaaagagcaaaccaguagguagccaagcagaaccugcaugugcucuccuaccccuuaaugaaaaauggaaucuaauuacuaacagacauaagcaauacaaccccagauauccaggccuuuacugauaccacugucuaggaguuaggucuagaugccuccuccaugucguaucucucacacuaaauaccagcaacagucagucaaaaagcugguuuuaaugaggugaagccucauaauccauauaacgcuaaaguggaaaacagagguagagaaaagagaucaaaguaagucuauauaguacacaaguaggcuagaugaagcuccuaaagcagucaaaagaccagaauauuucaaauuauaagagaucuaagcaaaucagucuauaggcgauauagaaaguucugccaagauaaacaaaacaaaaaagaaaggagacgagaaacuccacaucuuaaaaaggcuaaccacauuugaaaauaccauaauuucaauccaaccuugcuccagggcaugucaucauugcacacacguaaacccccguauacaagaugugucaaacaagaaagagcuccaugauugugaaggcauuuacgugaucaaagaaacuucuuuuuaaguuauuguuccucuuggacuuugaauugaagggucaccuaccucccgaaacagugcgccauaaaaggugacagugaauggacaguccaccguccucauggaaauauccaaauccaucaguagccguuucuguuccuggcuauuuacuguggcucggauccgcugaauggaaaugcauggaaaauuuaugguuacuacucugaggaugaggcaggcagggaccugaaggagucccaucgugaaaauaguucaugacacaaguucuggcgaugacauugugaauagccacccaaagugauuagcuauuuguaacacaugaaaauaaggaaggcuguuacucauuugauuuccugaauaguccugguaagaaacaaauugauaguguguuuuggagagugacaaaauguuuuggaauguauuuccaagguaugaaaacaaucugguuuacuguauuaugucuguucagugcaaagagggcacaauauuaaggacuuugcugcuuaucuggggucccaagaaaauaaaaagccaaaagcucuucuuugggaacauguaagaguauuuggagggaacagcaacuguaagagaauugguacagcuauacaaaauagaagcaauuagagaaauagagaaacuguucauuccuaucccagugcuucugagggaagaacaaucugucacacuaggaaauguagccuuacagaaacaugauuaugucauuaaaugauaggagagauacaauaucacugggacuucacacuuuuugccuacuuagcaagucagcagaagaacagacugaaaaaucuacaagauaaaaguauucccauucuuuaaaagcaaaaggauccaagucaccugauuauuccuaacaauagccccaaucuauuaacucagcuagagauguuaauucuuuaugauccuccaaacaccuacucaauaauaugaaaugauuuuaaauuuccuuucauagcucaaaaacuaugcaaauuuacucuagauauauuuuacccuccuuuuuccacaaauggagacaauuuucucucccaauucugguuucuugauuuucagaggcaauucuuuaaaagcaacaaaauauagaauaaaagagaucuaugagucauaacagccaaaugcaauacguaaacuuucauugggaugcugauuugaaaauccaacaggacaaaacaaacacacacacuuugagaugaucaaggaaauuuucauuuggacuccggauuagaugaaggaaguaucauuauuauuauuauuauuauuaauauuauuugagauggagucucacucuguuguccaggccggagugcaguggcacgaucucggcucaccacaaccuccaccucccggguucaagugauucuccugccucaaccucccaaguagcugcgacuacaggugugugccaccaugccuggcuaauuuuuuguauuuuuaguagagacgagguuucacuauguuggccaggcuggucucgaacuccugaccucgugauccacccgccuuggccucccaaacugcuaggauuacaggcgugagccaccacaccugggccauuaauuauuuuuaagugugaugaugacaugguaguuuuguaaaaauuaaaaaugguagaagaauggguggagggagaguuaagaguuaaaaaaacaaauaaaaaguagauacaacucacaccaaggaagacuuuuccauaccuuuggaggaaaauacuguucccugcaaauaaucuuuucuguuuuacccuacggaagaugguuuugcuucuauuaaaagggcugguugacaauugagguggacaaauguauacacagcagauauaaaacauuugggagaaugucaacucuaccuucacugccaugaucugcccgcugggcacgugccgcaucuucuccaccaccccguacgcaccucgucccaguuccauuauaggcuccaggucaucugccuucaccucaaaguucugcaagagagaaaaggaauaaugcaaugggaaagagaaaaauaaacagaacagagagcacauuauccucuaucucguuucucucaauguucuaaggauuauuucugggccagaagauuuucuagcaugucaaagcagccucugaaagcaagaagcuacaagaagggccaagagaugucuaggagcucccacgguagcccaccugcuugucccaggcaacacagaaacccaacuuggacucagcuugccaaugucucaguugaagcuauuucacugaaguucuuuagccaugacccuucauugugucuguaacccacuauugacugauggcaacuagauuaugucugagcuuugagaaaugcccucccaagagaaccaucuacucuauucaaauaccuuccaucaaaaccacaauagccugauuucaauucaacauucuuucaaaauagcaaaaacuuugcauaccacuucccuuuaaaugcaaacuuuuuuugacucauccccugacagcaugcuagggaaaauaaauuuuucagucagaaagcauacauauaaaauggccaacguauuagguggcagacaugauuuuuucuuaccugauuuccaauagaaaugcaagccuuggagucuaaaucucgagguggucuaagaaagauaagggggaaaagaagaaacauaagcuauugagucaauuauguccuucccaaaucacacaccacugaggauauuuuuuccuuaagaagaaaguggaaguucaugaguaaacuaaagcagccuaugagugugaauaagaggggauuugaaauaaaucacauuuggguuuaaaucacuuaaucucuuuggggcucccuuucuucuuuaacauggggauauuaauauaccuauauugugaagcaggagugaguauuaaaagagacaauacaaguaaaaugcuuagcugaaugucuggcauacaguaaauaucuaauucguaugagcuauacaugugcuauuauauagauuagggugcccaacccccaagccauggacuaauaccagucagcaggagaugaguggugggugaaggagagaagcuucaccuguacuuacaguagcuccccaucgcucacauuaccacuugagcuccaucuccugucagaucagcaguggcauuagauucucauaggagcacaaacccuacugugaacuguguauacaagggauauauguugugcacuccuuaugagaaucuaaugccugaugaucuguugcugucucccaucacccccagaugggaccaucuaguugcaggauaacaagcucaaggcucccauugauucuacauuauggugaguuguauaauuauuucaugauguauuacaauguaauaauaauaaagugcacaauaaauguaaugugcuugaaucaucccgaaaucauccccccacccaguucauggaaaaacugucuuucaaaaaaccagucccuggugccaaaaagguuggggaccgcugauauaggucauugugcuacagcaguaagucucaagcuuuuucuuucacccaagagcaccaauauauguaauuauuucaccacaugucucacaauuguuuuaagaaacaaauaguaauggcauauauucuguuaacucacaaaauucauagaacauaagaauuucaaaucucgucccuucuuuuauagauggacagaagguccagagaaguaaagugacugcucccagcccacagcugccccaggucuccugauauccaguucugcauccucucuacucaaccaggcugucuuaucaagcccagcaauauuucuucugugcacagcacauauacaauucuggggucuucuuaagagccagagguuugcugauuuuguuucuauagucacuuccugaguauuuauuucuaccacuucaaugaucucucaggugguaucaaucuacuuaagagaaaaauguuuggcucuggcugugcacacaacuaggagcugagaaaggcauuuuccugaaagaaauguaccaacaguaguacaauaaacauagcaaaugcuggccgggcacgguggcucacagcuguaaucccagcacuuugggaggcugaggcaggcggaucaccugaggucaggaguucgagaccagccuggccaacguggugaaaccccaucucuacuaaaaacacaaaaauuagccgggcauuguggcgcaugccuguaaucccagcuacuugguaggcugaggcaggagaaucgcuugaacccggaaggcggagguugcagugagccgagauugugccauuacacuccagccugggugacagagugagacucuguauuaaaaaaaaaaaaaagcaaauuucgagaaacaaauuguuaaugugaucaaacaaaaagaacaacuagaggcuaaagacgaaagaauccuggugcugccagaaaagagggaaagagggugagcagacagguaaagacucaugucucucuggaagcacauuccaugccagaaaaaggcaaaggaaaauggaaagaugaaagugagagagaaaagaaaccuuugccaaugaggauuuuuucuaacucucagguauuaugauucuaacccuuuugcugaaauugaauacauaaauaaaauuaaaaaguaggaauaugggcggaggcgcaguggcucacgccuguaaucccagcacuuugggaggcugaggugggcggaucaccugaggucaggaguuugaaaccagccuggccaacauggugaaaccucaucucuacuaaaaauacaaaaauuagccgggcgugguggcggacaccuguaaucccagcuauucgggaggcugaggcaggagaaucgcuugaacccaggaggcagagguugaagugagccaagaucgugccacugcgcuccagccugggugacaagagcgagacucagucucaaaaaacaaaacaaaaaaaaagagaaauacaaauacagauauaaacaugacucuaagauuuuaauggcaagccuucucucaccucaaaauccuuuuggaauacauagaauacuuaaaguuucuuauacuaacuuaaaacuggggacugagagggagagagagaaaaaaacaaugcaaaacaaaacacacacacaugccccacaaacagcagugauguguuuauauaucuuguguuucugagcagggaauuuuucuucagaaaagguuucuggaagaaucaaauuucuaaaauucuaauuccucuuucucaagauuuccaaagcuauuuuuccucaguugucaaaauuugcuuguacuaauuuguaauggcacuuugaaauaaaggcaaauaugacuugaaacaugugacuaauauaaacaacaaaaauccuuugcaauuauucaacacccugauuuuuuuuuuuuuuuuuaagacagagucucacccugucgcccaggcuggagugcaguggcacgaucucggcucacugcaaccucugccuuaccggguucaagcaauucuccugccucagccucccaaguagcugggauuacaggcaccacaccuggcuaaucguuguaguuguaguagagacaguguuuugccauguuggccaggcuggucucaaacuccugaccucaagugauccgcuugccauggccucccaaagugcuggaguuacaggcgucacccaccauccugacuuuuuaaaaauaugaagcaacagaaaggucacuaauuauuuggggcugcaacuguuuuuuugccauccaaugagguuaucgaaaaaugaguucuuccaagucuaauauucuuauauuuuauauauauaccagggcucagcaaauuacagccugugguccagcuaagaaugacuuuuccaaauuuaaaugcuuguaaaaaaacaaaaaauaaacaacggcauccucuguggcccauguagccuaaaauauuuaguauccggccuuuuacaaaaaaguuugcugaccuuggcccuauacuaacuuugcauuaccccugaaccuaauagaagggucuggugccauuuuccagauugagaaaaaugaaacccagaaaagcugggugauuuucugaagccauacggucaucaacggagcugaaaauaaaacucaagucacccgaaucucagccuugauuuaaggaggagaaagaggaagaagagaaggaaauauaaaaaacugggcuaagagcuuuuuaccugcucuugcgauucccaucgaggcagacugaauacaaggaacuugcucccaauacccaggccuccucuaaugaaaauaaucaauucgccugugccgcaggcccuugggcucaucaagugggccaaaaauaucaaaugauggggccaagacugacaaaucagauuggauuaguugacacuguguucucuccagggcugggcauauuaguuugccaggggcauugcgauucugcaggaaguuuauacuguggguggauguucucugucacuuuuucaauauuuuaguccucuggggaaagaaccaagcuuauuacaaaaauucuuccccuggaagaccaaaggucuuccaaaggucaccuaguauucauuuuuuuauaugaacaaccagcuucgguuuaguaugauaauuauucauuuauaauuuuacaugaggaaucaguucacugguuacuaucgcaaucacuauucauugauucagaaauauuuauuaagcaccuauuugggcaagagacugcgugagaccauuuacauaaaauagcuuccuuaauuuuuacaacucucagagguguuauuaccucuauugaaauagaauaggguaugaauugaaaucaagguauaauaccucauuaauaccucuuucaacaauuaauauugaaagugacuaaauaauuuaagaacacucaggccgggcgcaguggcucacgccuguaaucccaacacuucgggaggcugaggcagguggaucacgacaucaggaguucgagaccagccuggccaacauagugaaaccccgucucuacuaaaaauacaaacuuagcugggcaugguggcgggugccuguagucccagcuacuugggaggcugaggcaggagaaucgcuuggacccaagaggcggagguuguggugagccaagaucauaccacugcacuccagccugggcaacacagugagacucugucucaaaaaaaaaaaaaaaaaacaaaaaaaaaacacuuagaaagacaaugagauuagaacccagagcugcaccauuauggcuucucaugcacaguaugcuguaaaggauacuaccucucauuucacuagccauaaacuguuugcucacagccucuaccagucugauguguggcuaagaguacauaauugagagucagagauuccugagcuuauaugccaguucuuccaccgagaagcugugugauaauacuaacuuggaguuaccuuucauugagcaauugcaaugcaccaggcacuacacuagacacucauauggauuaugacaucuaauccucaugacagcaacaucacuguuauuccugaguuuuguuuguuuguuuuuugagauggagucucacucugucaucuaggcuggagugcaauggcacgaucucggcucauugcaaccucucccuccuggguucaagcgcuucuccugucucagccucccaagaagcugggauuacaggugcccgccaccacgcccagcuaauuuuuuguauuuuuagaaaaggaaacuaaggcuuagcgcaguuagguauuuugccuaagauauucaacuagugaaguuuagaucccaaauauaaaccuaaguguucuggcuccagacccugaacucuuacccaugaagcuaugcucaacagcuuggagcaaugcaccugaccguugcaucguucuguuuguucacaugucaagugagaguaacaaacacugccucugaguuucuuguggugguuaaaugaaauaauaugaacuagcaucgaacugauuuagaauuggucacuaucaaucaagggaagggacagcucacacuggcaucgguagcucaaagaaagagcucaaacagaggggccacacacguugaacucgggagaauggagcuuugucaaggccuauuuauuuuugugaagcgcagcagaaggaggcaggguaugaaugggaagaaaucaccaagccagccuucaaaaauugccaagaaaaacacaaaaugugggagcuacuucuuuaggaguacaaauuuaagccuuggcauuaaaguaauaacaacgagacucuuugagcuacagcgguauacucuacaauaaugaagugauacuuuuugcuucacacagugaaacagauaaguauauucacaguauaccuuauuaauaccauacgagggaaaauauaaacugcuuuuauccuuguuuauaccaagaaaggguuuaugguagccuuccgaaauucauaaaauuuauaaaauuaacauauaauuuaugcuauaauguaaacuaauauaaaagguaaagaauaaaaauuguaaggggaagggauguaagacuccuggcagguugauguaagaauaaaucccaaaggaaauagcaaaaauaaaagcagaaagcaauaaaauugaaaauaggaaaauaaaacaaagcugguucuucagaagaaaaaaaaucaauaaaguugauaaaccucaagcaaaauugacaaauuuaacaaaagaagacacaaauuaucaguaucagggaaaaaaaaaaaggaugucacaacagauugugcagccauuuaaaggauaggcaggaaacacuaugaacaauuuuacucucauaaaugugacaacuuggaagaaauggaccaacuccucaaaaccacauacuaccaaaacucagccaugaugaaacagauaaucugaauaguccuauaacuacuaaagaaauugagauugugauuaaaaagucccagaaaaaaaaaauccaggcucauuuucuuucauuggagaauuuuagcaaacauccaaauaauuagcaccaauauuauacaaugucuaccaaaaaauagaagcaacacuuaccaauucauuuuuauuaagccauuauuaccuuaauacuaaaacuagaaaauaauagcacaagagaaauaauaaauaaaccaccacagaccaacaucucccaaaagccuagaaacaaaaauccucaacaaaauuuuagcaaaucgaauccaacaaugcacaaaaauauauauaccauaacuaacugggauucauuugggguaugcaaagcuagcugaguacauaaaaaugaaucaacauaaucuacauaucgacagaucaaagaagaaaaaucuuaugaucauaucaauugaugcagagaaagcauucaacaagauucaauacccauucauaauaaaaguucucaggcagggcacguuggcucgcgccuguaaucccagcacuuugggagggccaaggcaggcaaauugcuugagcccaugaguucaagaccagccugggcaacauggcaaaaccccgucucuacaaaacacaaaaaaaaauuagccgcgugugguggcauguaccuguaguuccaccuacuuuggaggcugagaugggaggaucacuugagccaggggaggcugagacugcagugagccaugaucacaccucugcacuccagccugggugacagagugagacccugucucaaaaaaacaaaaacaaacaaucaaaaagaaccucucaguauacugagagguuuuauauaguugggaaccuuuucaaccucauaaguaacaucuacaaaaaaccuacaguucgcuucauacuuaauagugaaagacuaaaugcuuucccucuaagaugaggaacaaagcaaguuugccugcucucaugaacuuuauuaaccuaggacuggacauucuugccacuucaauaaggcaagaaaaugaaaguaaaaaucaaaguaaagauuggaaaagaaaaaauaaaacagucuccauuuacagaugccaugacuguuuauauagaaaacccuaacgauucgaugacaagcuucuagaacuaauaagugauuuuaguaaagucacagaauagaagaucaauugcagaauccacagaauucaagaucaauacagaaaaaaucuauugcauuucuauauacugacaaugaacaagugaaaaccaaguucacaaaucaaauuccacuuaaaauuugcuccaaaaaaaacuuagguauaaauuuuaacaaaaucuaauauagaggaauuguauuauaaaaaugcugaugaaagaaauaaaauuuuuaaaguugaagaaauauaccauguuugcagauuggaagaaccaauguaguaaaaaugucaauuugcccuaaauugaucuauagcuuaaacacaauuccuacuaaaaucucaguaaguuucucuguggacauagauaagcuuauucuaaaacuuauaugaaaagagaaaggccuuuagaauagucaacauaguucugaaagagaacagagugagaggaaucauguuucccuguuaugacuuacucuacagcugugguaaucaagacaaugucauacuggcagagggagagacaaauaaaucaguggaacagaauaaacaaugcggaaauaacuucaaacaaauaugcccaauugguauugacaaaggagcagaagcaauucaauggaggagggauagccuuuucaacaaauggugcuagaauaauugguaacccacuggccaaaaaaauaaagcucaaccuaaacucauaccuugaacaaaaauuaacucaaaauggaccaugggcuuaaaugcaaaaugcaaaacuacaaaacuucuagacagaucuaggacuaggcaaaggguucuuagacuuauuaucaaaagcaugaucuguaaaaguaauaauugauaaguugaacaaacuuuugcucugugaaagacccugcuaaaagcauaaaaagacaaauuacaaacugggaaaaauauuuucauaucacauauauaucggacaaaguccucguguccagaauauacaaauaacucucaaaaguaaacaauaaaaaguaucuaauuagacaaugggcaaaagauaugcacagacauuucaccaaaaauauauagauggaaaauaaacaccuaaaaacauauucuacauuauuagccacuagagaaauuguaaauuaaaacuacauauaggcugggcacaguggcucacgccuauaaucccagcacuuugggaggccaaggcagguggaucaucuaagaucaggaguucgagaccagcagaccagccuggccaauauggugaaaccccgucucuaccaaaaaaagaaaaaaaaaaaaucagcugggcaugguggcaggcgccuauaaucccagcuacuggggaagcugaggcaggagaaucaccugaaaccagggggcagagguugcagugagccgagaucacgccauugcacugcagccugggcaacaagagcgaaacuccgucucaaaaaaaaaaaaaaaaaaaaaaaaaaacuacauauauaucacuacacaucagaauagcuaaaaugaaaaacacugauaauaccaauugcuggcagagauccagaaaaacuagauuauucggacauuauugcugagaacauaaaaugguacaauuacucuggccaauaguucagcaguucuuucaaaacuaaagaugggcuuaccauauaacccagcaauugcacuauugggcuuacaccccagagaaaugaagaccuauucucaugcaggaacuuaugcauaaaugcucauaacagcuuuauucauaauagccaaaaauggaaaacuacccauaucuccuucaaaggcuaagguguugaaccaacugugguauaaccauaccauggauggguacuuagcaauaaaauggaacaaacuaucaauacaugcaauuauuuacaugaaccucaauaaaauuacauugaacaaaaaaaaaucucaaaaagagaugcaugauuuuguuuauauaacaaucaugaaauaacaaaauggcaaaggagaacagauuagcgguugcuggggauuaaggacggagauggggagaagagguggguuugauuauaagaggggagcauaaaagagucuuguaauguugcuguagugaaguaucuugauuauaauaguacuuaugcaagacuuacacaaugugauaaacuuuauagagcuacacgugcacacacacacacacacacacacaaaggaauacuugcauagcuggcaaaauuaaguucuaugauuugcacuacugccacauucuugaucuugauaauguauuauaguuguguaagauguuaacuugggauggcgggggaguuuggcauggccuggggaaagggaucuaugggacuucccuguacguuucuuugcaaccuccuguuaaucuacaauuauuucaaaauaaaaaguuuuaaaaguauaucccauaaauuccuauacagguaguaaaaguaggccacauauuugacuguaagcucuugagaaaccagucagagaggaaacaauaguaauuacacaguucacaggucuacgagaaaaagaaauugcucagagagaccgaaaaaaaaagaaaaaaaaaagagaaaaagaaaacaaucuugacagcaaguaugggaagacggaucuuccuccugcagauucuaaugaaaggaacauucuaucuugaguuuagacucuugagcuacaguccagaacccugaagaguagcccucaacucuacuuuguccuuaaaaauucuccaguggaaagugucuguauacugcuucacgcaaugcaaggaccaguggcuuuaacaaagucuuacagcagacaugaucccauuuaagaacacauuccaacacuaggggugcacuuccugauagcagaucauagcuaagaucaaaacccaucacaaagggaggcacuuuuguagacaugaacaaaagccuuaccaacucacuuuuccauuaggaugcccucucuuugcccuugcccugucucucuaacaccucuauugugaguuuccuuggaauuuccauuccucucaugcagaugccuugguaggugguuguaccuccagcuggacaggaaguaccguucccaccacacagagacagauaaaaaauaaaaauaaaaaaaaaaaaaacaagaaggagacauccucacagagaggaugucauuuacacgauguccuucacuaggacuugagcugacuuagggauuugggccaaaaccucagcuaauaaaaaaaaaguguuccuuuaccucauucuuccuucuguuuauaugggacagaauuuaagugucaggauguggguccucaccaaauaccaucuuuccaucucaacccaaguuuuauaguaguggcuuucacagggauuugccuguuugcuccaaucuacagggaaaaggcaaggaaguucacauccaggggccuuucuggccuuacauagagccccaucugccaaauauaugugacauucacuuccuacucaaccaauaacuuaagacacugaguucaaaacuacccauucaacguaacugacugauaagaugacuauuucaggucucagaacagugagcaaauggcuucccccuuaaagggcucuucuaaagucaaggcauugcucagcaguccaaaaauaaacccccaggaggaaucugaaagcacaaggauuuggauucagaugauggucuugucaacuuacguggaacuggucugagguuguucaaaugcuucuuuuggaauuuuaaggccaggguuucgcuucuugccuauggggaaagacaaaaggaaaaaguuaaggacuaaaucauagcaagauagcagagaaagagacugcggcaaaggaaagagcugaccugcacaggcagcucucaugucuccauucaaagcgccacuuccuacccaggaagucugugaguguuaagaacccaagcaccagguaggacagagcuucucaaauacagacuguggucaugaaugagguuuuucauuaguccagggggcaaacaucaggaugagaaugccaacucucuuuuccuaggaagaucugcccuuucuccccacugagaauuugucauugcaacuuuuuuuuuuuuuuuuuuuuuugagacagagucucacucugucacccaggcuggaguacaguggcacaaucucagcccacugcaacuucugccuccuggauucaagcgauucuccuaccucagccuccugaggagcugggauuacaggcaugcaccaccaugcccggcuaauuuuuauauuuuuaguagagauggggguuucucccuguuggccaggcuggucucgaacuccugaccucaggugauccgcugaccuuggucucccaaagugcugggauuacaggcaugagccaccaugccuggccuuguuuuuuguuuuuguuuuuuuuuucuuuuacacuauaauggugauggcagacacuugguuauagcuuuuuuuuuuucuuuuuaguguuaguaaaggguggucacccuuaucuuaguaacccacuauuuucuaaaucgaucuguuaacuacuacaaaguuagcaauggaaguagaauaaaaaaugcuuuuccacuguucugcccuccccuuuucccaaccaccugcuguaauuugaaaaacuuaagagagggauagaguaauacuuauuuacauuuucccuguuccagaaaggauuaagauaacagaugagcuuaugcaaggaaguuauaacuucuucuugggccaaauggaaagguaacuugauguugaucacaccugggcugaaauuacaagagaauuuggcucgaauacuuuuguugaugaguaaaaaagaacagacugagaaaugccagcucaggaagcagaacagagcaaacaagggccugggguuuuccucaugcauggagauccugugucucuuugcacuuggcaggggaaaccaagggagagcugcauagaauggcuggaaagaaugcuaccuucugcccaggcgcgguggcucaugccuguagucccagcacuuugggaggccgagacgggcgaaucacgaggucaggagauggagaccauccuggccgacacggugaaauccugucucuacuaaaaauacaauaaauuagccgggcaugguggcaggcaccuguagucccagcuacaggggaggcugaggcaggagaauggcgugaaccugggaggcggagcuugcagugagcugagaucacaccacugcacuccagccugggcgacagugcaagacucugucucaaaaaaaaaaagaaaaaaaaagaauccuaccuccuuucccaccucuucucuacauugcagaugagcacucagagauaacacaagcccuggauauggcccuggauagauccugaagcugcaaagaaacuuaaaccaauuaaaauaaccuccuugcagaaaaauaacauccaaagacuucagugacuugcuccacaucacagaggucagcaaugacccagucagaaucagaauccaggucuccugacacccaggugggaguucuuucuacuauccugcaauagaagacguuuagagaugacuggagagggggcaggugagacguacccgggauuuugaguuuuaaaauacccagcugacaucugguucuuccacgcaucacgcaacuucuagaaucacuuuucaucugacucucaguuuucucaauuguaaaaugaggaaguaacaaccauacucaccucacuggacugauaugagaaucaaagcagauaacauauaugaaaaaacauuaagauaccuuaaguagcuguuaauuagauucauuuagggaaacaaucaguacugucucauuuuuuuuaaagucauuuaaaaaauuaaugaagagaacuggccacaucauuauagcccacuauaauguauaaugaaauuuuucaauuccuucagaauccaaaaucagaucaauucugccaaguuguauauagccaggaaaaaauaugcuucgcaguaaucagccuagagaaagccuuuuaggaccaccuucagaauaagaggcuuucucaauucucuccucauuuggguuuacuuauguauuuuauaagguucaaaacucaccauucacuuuccugcucuuggaacucaaacagcuguuaaggauguuacuaaauuagucaguuauugacaucgcauagagcuuuccuauguaccaggaacuaugcuaggugcuggacccaguuaugagaauccaaauagauauauggccuaauuccaacaauucccauccaugcaccucagccaaacagacagggaauguuacuuucgaugagauucuucagugaggaaugaaugacggauucaacuuguuuagauaacuauacagauaacuacauacaaauuccagugcaggugacagauaauucagguaaucccaaaaggcgacccuacaguucucucaacgaaaacaaaaacuaaaguaacauauauuuugccuaugaaaacuggucuccaguugucauuuaagcaaaccaaaagcagaaguuacucuuaaauuccuacaucuuucucuucuuuaccucuaacucaguucuuacaagauagauguaaagagaaauagcuauuuauugagaaaaccccuuuggaaaacuuuaauauagcaaguaauuaguagcaauucuuaacagcaauuaauuauuacaccauaacuuaaaucaccaaaacaucuauacaaagaaacaguaaaaaagagagaaaguuuuuagcacagagaccaaaggaauaaaagaccaaaauaauaguaaagucuuccaagugggaggagaaggccuuugauucucuccccagaucacuguuacacccagccacccccacagccccccacaucaacaucauucuuacccugaauuuacugccuccuaguugaaauugccagccuccugucuccagacucuaaacccuugacuauguauauaaguuggacaucugcauaucuuaaaccuaauauuuccaaguauaucagcuccucagaacaacaagaaaaaaaaauagauccaggagacacaaaaccuaguugaauuacaguguuagaaaauacucugccuucacguuuacaucaaauaaaauacaaaucacaagcacacacagcaacacucugcaguucgcuuacuugcccaucucugacagagcagcacaguaagagaccagcagaggcgacucuggugagguuuucgaggcugcaaggaagaccagcagaggaaaaccuaacagaagucauucuucacuuagcuccaaagaccacacuucggcaaggagaaacagaacugaacagacuccacccccuccucaaguucggauugcagcaaaccucugcaagcucauuguuccgaggaaauugcagcuucaggaagggagaagggaagugggucuauguggacacccaggcgugacauuaaucauuaaccagacuuggaggaauaaaucuauaaaucuggacaguaccauguucugcagcuuuucuauaaaugccucuuugauuucuuaaaagaaagaaaaacaauauguggucaguuuccagcuguguuuacuucacagcaaucuguucccccaggaaggcagccaacaccugacgcuaacauugaacacuguuaaaaaaaaaaaaaaaaaaacaugggagggagcacuaugaauaauaaagcuaaguggccaacuauguucaacagucuuugccuuugauauucuaaagcaaagcagaaaaaaugucagaaaaaaaaaaaggcuuucuaugaugucauaugcuagcaacaagccuucucggaaacagagaauucuguagauuucugcagaucgcaacaagccucgacugcuuauuggcacagucugcaaaggguaagccucgucggccugauugggcauaugcagcacuauauugcaucagacccuguuacccgcaugacuguguucucugaaaauaguguaaucccaccacacacauauauuugcaaaauucaucugaaaccaaagcaaagcugggucauuauaauccuggccuggagcaaaauggcacuggaaaaaaaaauuuaaaaagccuugccaauaguuagaaaauauuuaccaggccacagaaauguucgcuagcuuugacugcaccgaaaaugaugggguacacgagaggucuugcacacacucugagaggguaagcacaaagcacuccucugauguuccucauuacauaaaacagaagauuauguuccacugccaacccaaacagcaugagaagcccacgcggucaacagaagguggcaucgugaagauaugcugaugccuaaauauuuguuagcuuggccgaggguugggggcacgacuaugagaguuuaugauuauugacacagcuucacaaaaggauggcaguguuuccagugccaaauuuauuuuaaaaaucuguuucccaauaugaaugggauuuccagccaaguaacuggcaaucuagaggccuuggcugcccucuccuuacuacuugcaucuaggcuuacguuccaaggguaguuggcaauaaaaccagcagugaaguaucauucaguguuauuaaauugcaaucaucauaugcaaagcaacgaacgaagcagggcaggggaagaggcaugcaggaagaaagcuggcuuugcaacagcaauguaaaagugaacagggacucugccauccuccaaucuuccaaaaccacuggcucuuauauaccacugagauuccaaacacugaagacaaaucucucuggaauuacagaaaguuuagagaagaaaagcugaaaaccucuuuuuuuuuuucuuuuuuuuuugagauggaaucuugcucugucacccagccuggaguacaguggcacaaugucagcucacugcaaccuccgccucccggcuuugugugauucuccugccucagccuccugaguagcugggauuacaggugcccgccaucacgcccaacuaauuguuguauuuuuuaguacagaugggguuucaccauguuggucaggcuggucuugaacuccugaccucgugauccaccugccucagccucccaaagugcugggauuauaggcgugagccaccauggccggccuuuuuuuuuuuuuuuuuuuuuuuuuuugagacagagucucacuuugucacccaggcuggagugcagugguccuaucuaggcucaccgaaaccucugcuucccacguucaagcaauucucauggcccucagccucccgaguagcugcgacugggaauacaggcacgugccaccccacccgccuaauuuuuguauuuuuaguagagaugggguuucgccauguugaccaggcuaaucucaaacuucugaccucagguuauccgcccgccuuagccucccaaagugcuguuacugggauuacaggugugagccacugugcccagcugaaaagcucauuuuaaaaccugcagucaguuugauuucagagucagaaugaaucuccuaagaccuuaccuuugcucauacuguuccuucuaccuggagggcucuagcugucuugcagacaagaacucaaccuuccaaauucaaaaccucccucauagaaccuucccagagcuuccugaacacaaucuaaggauuacuauccacacauuccugcuuucacauucuggcaccuuacacucagccugcaacacaauaugagcucaaagcagcuucccugaaacuuugauauuuuaguugaaaaauguccacucucucuacaauagaucuccacgaccaucuuccacucauuucccgcaaaccuuuucucacaaucuagaauuauuuuauuuuuguauuuauuuauuuacuucugcauuuauuuauuacuuguuuaucuaccuuucuccacuagaauauaaguuccaugauggccaaugauuuugcccagcaccugcacaucauaaauauuuguugacugaauguuuguuauucuuuucucaacuguuuugaacauuuguacagagcucuucaaaaaacaaacaaacaaaaugaacaaccaagaauggaauggaaauugcacaaaccucugcaucaauaagaaucauuucaaaucccagcugucccacuuagugacguaauguugagaaaguuucuuaucuuaaacugaguuuccacaccugcaaacuggagaugauguacaaucuccgcaggucauuaagagacucgauugacacagugugugugaagaagccuagcaggguguagcauaauauaggugcucaauaaauacuuccuuuugucccuuccauguuuacgcuuacauuuuuaaaauaugaguuaagcagaauguucccuggauggcaucuuauuucuucaaauuccgugcuccauucucccucuuucguguuauuuacacuagaauuacauuuuucaaacaucucaucaaucuugaaucuaccucucuuugugcccacugacuaugggaacuucuccaggucuauagacucaggauuucugggacugaguguagugagugcuuauaauuuuacauugccucaguauccauuuuuaaaccuaaguuaaacuaucucacaucagaagcagggcucagucacucuuaacacggugucuaauaccacacuccaccagauuggcuccaaaccaguggccagacaugaaacuuagagacaucucuccugccuagcaggcuggccucccuacuuuccugccacucccuuuaaacagaccaugcagacauuugcccacaaacguaaggugaccaccucucagucacgcugugaccuccuagaacuagugccugcuugcuuuaaacccagcaauuaaagcucccugcaggaaacuggauaacgcccuguacccaauaaagacauuggcucaguggucccuucucucucucucugcgugcacguguguguguguguguguguguguguguguguguggcuuccagguguguguguguggcuuccaggcgugcugggugccauacagagucucuaagugcuaaaaagucuuaaaaucucacauuguaguugugucacugaagccacacuugcaauccuaucccuaugggugaaacugccccaaaaggacccaugcagguggguccccugcugaugcccuuuuguccaggucucucagcuacuggggacaguaguuaccagcuaaguugauagagugaggcuucaggauccauauauuuuuuuaaguuucacaagugucugagaaaucagccacaguuaaguagcccuugucuaccacaugucuauguaaaguuguuuuguguuuguuuguuuguuuguuugucuuguuuuaccauuucucacuuuauguugccaacgucacuuuccuccaaggcucuugucacaucccccacaacccaccaguucuuucugauuaguaagaauuaaauuccaagcuagcuccucacuguguuaucucuaucuuugagcugaaauugucaaucauuccccaggguacacauugcaagggucaaaacuuauuaagaugcaauucugccaucgaagcaucaggagauaugaaaacccaacuccauaauaacagcggguaugugugaugugcaauacaagcauugcacccugaaagcaggagagaagaagcaagacaagcaacacugagaaauggucucacauacgaagugguauuugaaguggcccuuugauuuugguaggauuuaaggguaccugaggguuuguuauacuguaugucuucuuuauauauuuaaauauuuccaaaaucaaaguuuaaaaagaccaugggugggauuuugacaaucaagacuuggagagacaauaaggggauucaaaguaaaaugaggaugaaauaucuuuguaaggagaagcacugugguauauucaaagaauucugaguuuucuacucuggacaaacugaaaagugguggagagagaaaccuggaggaggaaguuggagucagagaucaaaauacuguaacaaauauauuuuaaauuucagauguaaaaagagaagucauguauguuuuucaguagaggaacaucaugccacauccaugcuucagaaaaaaaaaaagauguaacaagaugaacugaucuaauaauaucaggauguuuugaaacugugcuacacacacacucaugcauaaacccacauacucucaugccuugauguuuuaugccuccaggucuuugcucuuauuuuccucagaauguuguuauuaccuguuuuccccagucaacugcgacacucagcucaaguauguuuuucuccaggaagucuuccaugaaaguccccaaugcaauaaauaccuuuccucuguguugccacaguacccugaaccuuccuaugcugauuaagugaacccaucuguucauccaugucuuccacuaaaaaugcaagcccuuugaagucagggcccaugucuucuuaccuauguacagaguuuaagcacuagacccaaaaauaagagguagagaccacagcaaucuggcucacaaauaagcugcuugaauuuugcagaggcaaaaucuauaggcucuggucacuuacugcauaagaggaacaaaggaacagaagcauaguaguaguacuggaaguaguaauaguaauaguagaaguauugcuacuaguaauaguagugguaauaaaaaugauacucgucaucuggcuuuuccacccccaaaugaaguuaagugaaagaggaaagucaggucaguggggguggccaguggggaaagggcagaucaugaguuccaagucagauguauuaaguauaagaugcugcagggacgggacgcauggcagaauucaagcaggcaaauggagcuuaagagagggacaggaggaaaugaguagaucugggaaugacaaacagagagguagaaaguugccugagacagacagggaaacaagaagaaugaaagaagguggccaggugcggugccuuaugccuguaaucccagcacuuugggaggccaaggugggcggaucacuuuaggucaggaguucgagaccagccuggccaacguggugaaaccccaucucuacuaaaaauacaaaaaauuagccgggcguggggcacacgccuguaaucccagcuacuccggaggcugaggcgggagaaucgcuggaaccccaucucuacuaaaaguacaaaaaauuagccggguguggggcacacgcuuguaaucccagcuacucuggaggcugaggcgggagaaucgcuggaacccgggaggcagagguugcagugagccgagaucgcaccacugcacuccagccugggagacagagcaagacucccucucaaaaaaaaaaaaaaagaagggaaggcagccagccaagcuaagaacauuucgaagaaucggugaaggacacaaagaauuacguuccugucaaagaagaaugagccagccuguccauccgcuaauugggaaauggccccauuuuaagagaauaaaagugcucaaauggguuuuauuacagcuucaugugauuaaagcuaaaaaaaaaaaaguccuaguagaccuuuuaugucauguuaacaauuugguguugacuaagauguucuuaaaagaaccuaaaagcaaaucacagccaaugcccugaguuauguucuaggcccagggaaaaggcaggaggcaggcaguagggaacuccuacugucucgguucaucuccuuccucauuuaugggcugcuucacucauuagcauugaucgcaaggaaauguagucauaaggguguuaaaaacaucacuuuaaaauaaaaaauggcaauggguugcaaagaaauuuaguggcgugcucgagcuuuucaaaauacacacuggguuuugguuagguuuuaaaaaauaaguauuuuuuuuuuagagauaauacugaaauguuuacgagugaaaugauauuauucuagaauuugcuucaaaaaaaaaggcagagugggggauagagauacagauaaaauaggauuggccaugagcuggucauugucaaagcugagugcuagauaccuggcaguuauaauacaguccacuuuugaauauguuugaaauuuaccaaaauagccaggcgcaguagcucaagccuguaauuccagcacuuugggaggcugaggcgaguggaucaccugaggucuggaguuugagaccacccuggccaacauggugaaacccugucucuauuaaaaauacaacaauuagcugggcguguuggugggcgccuguagucccagcuacuugggaggcugaggcaggggaaucacuugaaccuggaagguggaggcagugagccgaagucucgccacugcacuccagcuugggcgacaagagcgagacuccagcucaaaaaaaaaauaaauaaaagaaaaaauaaaacgaaauuuaccaauauauaaagauguucuuaaauaguaacagaaucacagaaaauucuguuuuaauaguuaaaagaguggcauagcgaauaagaggggugaauuuguuguuuuuuuuuuuuuuuuuauguggaaguaauggauucuuuuuuuccucugguccaagaccacaauuuuggguuuuuguuuuguuuuguuuuuugguuuuugguuuuuuuucuagacagaguuucgcucuuguugcccaggcuggagugcaaugucgcgaucucggcucacggcaaccuccaccucccagguucaagcgaugcuccuaucucagccucccgaguagcugggauuacagaagugcgccaccaugcccggcuaauuuuguauuuuuaguagaaacaggguuucgccauguuggccaggcuggucucgaauuccugaccucaggugauccacccgccccagccucccaaagugcugggauuacaggcaugagccaccacgcccggcccacaauuuuaauagcacucugaucaccucccuuuuaaccaaaggaaacuccaagauaguaacuuuaauucaaccagcugcuugaagacuaaggggguaauaaagaaacaaaggaacguucuucaucugcaacuccuccccuagaaugcuaucaguacagggucuuauuucccuuuuaauccaggggcucuccauucauuuuguuuuuuccuuucuuuuuuuuuuuaaagacagagucucacuuugucacccaggcuggagugcaguggcacgaccuuggcucacagcaaccucugccuccuggguacaagcgauuuucaugccccagccucccaaguagcugagauuacaggcaugugccaccaugcccagcuaauuuuuguauuuuuaguagagaugagguuuuaccguguuggccaggcuggucacaaacucucggccucaggugaucugcccgccuuggccucccaacaugcugggauuacaggcgugagccacugcaccugaccucccuccauuucuuuuugccucucccuuuccucuccuccugcaacuucaugcaauuauuuuguugaagaaaugcaggccauguguccuguaguuuuuuccacuggauucugcugcucuuaucccuuguuauugacucacacaucccucuguugguuagaaauugaucagauucaacuugaucagauuguuuggcaagacuacuuugcagguggccucacuuacuuuuaauuuaugcuaaauugcuuaauuuuaugcaaccuagcaagcuaacuuaaacucuuaaugaaaaaaggaaaaaugaauaaauauaaauaaucccucagcaaauuaacauuuucaucucugucaauuugauggguacaaggguacaaggggugucucauuguuuugaaucacauuuuaaaaauauuuaaugaagcugaguauacauauauuuuuuuuuuucuuuuuucuugagauggaguuucacucugucccccaggcuggacugcaauggcacgaucucagcucauugcaaccucugucucccggguucaagaaauucuccuuucucagccucccaaguagcugggacuauagacguacaccaccaugcccagcuuauuuuuguauuuuuaguagagacgggguuucgccaugcuggccaggcugaucucaaacuccugaccucaggugaucugccugccucagccucccaaagugcugggauuacaggcgugagacaccacgcccagcugcagcugaguauuuuuuauauauccacugucaucuguauucauuuuucugugaacucccuguucaagucaucugcucguuuuuauaacagguuauuauuauuguuuucuuuguaaaagaaggcauugccccuuuuguaguuaguguugcaacacacacacacacacacacaaacacauacacuguuuuuuuuccuuuuugguuauauaaaauuuuaaauuuuuacauucuuuuauguucucugcauuuucauaagguaaaaacauucuuuccgcuuccccaauggcuagauaguucuuccaauaucaccuauuaaucugucuacuuguuuccaaaugaauuguacacaacuuuuuaauauuuaagccucuuauucuuuuguauaaguucauuggcugacauguccaaaacauauaugaaauauucauguagacaucuucauuugauccucacuuuaagagaauucuuucuugcuuuucacaauuaaaaaaaaaugaugcuggcuuuggauucagcugaauagaccaacugaaugauuuuucucauguugaggagguauaucacucuuuucauuuuacugagugggcuaggcugaggaugguucccaaguucaugcccauauccuaauccaugcaaccuaugaauguuaucaugauaauuuuuugcagaugugauuaaauuaaggcuuuugagaugagaagaugagccuaaauuauccaggugggacuuaaaugcaaucagaaguguccuuacacagaggggcagagggagaguagacacacccagagaggagaaggagaggcgaaggcugagucagagacuuuggugaugcagcugcaauguaaggaaugccaaaggccagcagccaccacaggcauggauccucucccagagccucuggagggagccugacaugccaauaccuucacuguagacuucuggccuccagaugucagagaaaaaauuucugguguuuuaacgggacagaauacagagcccagaaauaaggcugcacaccuacaaccaucugaucuucgacaaaguggacaaaaacaaacacuggggaaaggacucccuauccaauaaaaggugccggaauaacuagcuagcuauaugcagaagguugaaacuggaucccuuccuuauaccauauacgaaaaccaacuccagagggauuaaagauuuaaauguaaaacccaaaacuauaaaaacccuggaagacaaccuaggcacuaccacucagccauaggaaugggcaaagauuucauaaugaagaugccaaaagcaacugcaauaaaagcaaaaauugacaaacaggaucuaauuaaacuaaagagcaucugcacagcuaaagaaauuaugaauaaacagacaaccuacagaacgggaaaaaauuuuugcaaacuaugcaucugacagaggucucauauccagcaucuauaaggaacuuaaacacauuuacaagaaaaaagcaaacagccccauuaaaaagugggcaaaggacacaaacagacacuuuucaaaagaagauauacauguggcuaacaagcaugugaaaaaaagcucaucacugaucauuaaaaccacagugaaauaacaucucagaccaguccgaaucaaaucaaaaccacggugaaauaacaucucagaccagucugaaucaaaucaaaaccacggugaaauaacaucucagaccagucugaaagucuauuauucaaaagugaauaauaauaauaauaauaauaauaacagaugccagcgagguugcagagaaaaaggaaugcuuauacauuguuggugggaguguaacucaguucaacuauuguggaaagcaguguggcuauuccucaaagagcuaaaaacagaacuaccauuugacccagcaaugccauuacugggucuauauccagaggaauagaaaucauucuaccauaaagacacauacacauauauguucacugcagcacuauucacaauagcagagacguggaaucaauccaaaugcccaucaaugauagacuggauaagaaaaugugggccgggcacaguggcucacaccuguaaucccagcacuuugggaagccaaggcgggcagaauaguugaggucaggaguucaagaccagccuggccaacauggugaaaccacgucucuacuaaaaauacaaaaauuagccgggcgugguggcacgugccuguaaucccagcuacucaggaggcugaggcaggagaauugcuugaacccuggagacagagguugcagugagccaagauggugccauugcacuccagccugggcgauagagugagacuccgucaaaaaaaagaaggaaggagggaaggaagaaaggaaggaaggaaggaaggaaggaaaaaagacaaugugguacauauacaccacgaaguacuaugcagccauaaaaaaagaacgagaucacauccuuugcaggaauauggguggagcuggaggauauuaucuuuagcaaacuaauacagaaagagaaaaccagauuaucucauguucucacuuauauaaaugagaacuaaaugaugagaacacacggacacaugagggaacaacacacacuggggccuaucagaggguggaaggagggggagggagaggaucaggaaaaauaacuaauggguacuaggcuuaauacuuggguaaugaaauaaucuguacaacaaauccccaugacacaagucuaccuauauaacaaaccugcacauguaccccugaacguaaaacaaaacuuaaaaaaaaaaaauucagggguuuuaaaccaccaaguuugugguaauuuguuacagcagcuacagaaaauuauuaaauaauaugcuguuaucagaaauggacaaugaauuuugucaaauuuucuuccaacauuuauugaaauaaugcagcauccuuccugccacacccacacugccacacucucuaacaaauguauuucuugcuuuucccaugcucuucucuuccuuucccuaccccacuuucacucucuugccuucuuaacuccuguagcauuuggccuucagaagcaucuugugauccugcauugcuaguggcgacagaaacaaagaacuggcuaaucccuggacucaagaaacaucuacagagucuccauuugacaauauaagaaggcaaaacaaccaaaguugagaaauuaacugcaaacuauaaagaauggauauuagcagaggaguccccuccugcucuucaguggagcaaggaaggaggagaggcugacccccuuccaggucuuucuaacucaacgccaucuuggaggaaaaagcauaaggaagaaaugcagcucuuuccccaggccugaaauuccucaugaauucugaaacucuucauguucccuaccaacaagaaacaagaggguaaagaaaccgcggccaaaauaauagaaaauauauggcaagauucuuuacccuguaacucaaauccugcaaccuggaaaaccucaguuuaauccuuugccccauggcuguuucugcaaugucuaguuaccuuucuuuccagagaagcuggacguuugugagagucauguuuugcaaaccauagccuagcaaaagaacacaguagccuuugccuuuuguucggcuacauacuuuccuggcuuagcgcauuucccacuggugacacuucuggcuaaggguucgugaugcccaauuaaaaagcaaagacaaagaaauugcuucaagaaaaucaaaaaauuuaaaucugagauuuucuaaaaagagaacgcuaaucuacaaaaacuaacaacuuauuuucaaaguacuguaguuugguucaugcaaguguacucauuucaauauuaacuaguucagauccucacguaacccuuaaagugaaaauuccacaguccuauagaaagauuuaaacucuaacuuuuuaacuccugaagaaauaaucauuaccguaauuaacaacuauugcuucaggcaaugccauaacucagggugucaaaagaaguggaguucuguagucuuagguaauaagucuggaaauuguuccaggcagucaccuugaaauaucuaaaucaguuaauugcgaagacugagcacaagaaaaaguauauaaauucucuauuguaccagaacaauguuccaccuaugugaucacagaaaugugggugaaacguauuagaguaaauauguuccauguagucucauauacacuguaaccuaugcaauguucccaaacuuauuuuauuuuuccuuuuuuccuuuuuuuuuuuuuuuuuuugagacagaguuucacucuuguugcccaggccggagugcaauggcgcaaucucagcucacugcaaccuccaucucccagguucaagugauucuccugccucagccuccugaguagcugggauuacaggcaugcaccaccauaccuggcuaauuuuguauuuuuacuagagacgggguuucaccauauuggucaggcuggucucgaacuccugaccucaggugauccacccaccucagccucccaaagugcugggauuacaggcaugagccaccacacucagccuuauuuuauuucuauaacugcaguuuuuauuuuagauucaggagguacaugugcagguuuguuacauggguauauuuuaugaugcugagguuuggacugaucucaucacccagguagugaauacaguauccaacaguuaguuaugcaacccuuucuccccucccuccuucaagcuucuacuagucuccagggucuauuguugccaucuuuauguccacgaguaccgaaguggacauaaguguuuagcucccacuucuaagugagagcaugcaguacucgcuuuucuguuccugcacugacuugcuugccuccauguuccugcaaagaacaugcuuuuguucuuuuuuauagcugaauaguauuucacgguguauauguaccacauuuucuuuauccagucuauuacugaugggcauuuagguugaguccaugucuuuacuacugugaauagugcugcaaggaacauaugugggcaugugucuuuuugguagaacaauuuuuuucuuuuggauauauacccagcaaugggauugcuaggucaaaugguagcucuguuuuaaguucuuggggacauucucaaacugcucuccagaguggcugaacuaauuuacguucccacuaauaauguauaagcauuucuucuucucuacagccucaccagcaucucauuuuuugacuuuuuaauaauaaccauucucacugucucauugugguauugauuugcauuucucugaugauuagugauguggagcauuuuuuuguaugucuucuuuugagaagugucuguucaugucuuuugcccacuuuuuaaugagguuauuuguuuuuugcuuguugaauuaaguuucuuauagauuuuagauauuaaaccuuuguuggaugcauuguuugagaauauuuccucccauucuguagguugucuguuuacucuaguguuaguuucuuuugcuauacagaagcucuuuaauucccaaacugauuuuaauggcuaaucaaaaauaugaggagguaauuuguaauauuuccugcauacaguaauuucauaagauuuucuuuaaguuguagguuuuuauuggauugauuuuaaguaaauauuauugauggaaauucucacaagucuucauuauugggaagcagaauuaaagacugaaggaaguacccacucauaucuauacaaagucagaugauuuuaaagucuccaacaaaguuauauguaguaaauuggaaaacaacacaacaagacccugugaaaaagagaccuagugggaaaggaccaagcccgucauuagcagugaaaacuugggauguuauuaauguaagccucacccuuaaaaugggaaaaccaauaucuaccuugguggcauuaaaggagcaaaucaauauaggcugugaugcucaauaaauaugucugggauaaaugaacgcuguaaguuacccaucagcuacacugccguuucuggcagguaccuucuuauuaacaagugguugcucaugagaauaauaauagcaccuagaauuuauugcguauguguuacaugcaaggcacaguucucagcauuucacacgaauugcuuaauuuaaugaucacuacagcugcaugggguauuacuuccucuguuucgaggaccuuguccacauacacagagcuuguacagauguaagcagucggcuuucccauauaauuguauuuaguccuucagcugaaauuacucuucaucacaagucuguuuccacuagcucguguaaggauuauugcugaacuaugucagggcuauauauaaauucugguauccaaaggaaaaaguccaggauuaaauccacuguacaggcuuucuacucacauguccaggcucuucuggaucacagaggcagguuauaaaacuguuuaccagaaacuguuuugacacgacccaggucuauccagggagaucuagacucaaucaaaaaacuaaauugccacgaccuuugcccaacauauuuucaccuuccuggacuuugguuccucugaugcuaaaauggaaaacguuugggcaaucgacuagcugauuuucucacuaaacggugcucugguguuugagaaggguaccacaccagcuuuacagauaaggucaccaaguuuuguauucuucaauagcucuguaguguguuuacaaacgaaugccccuucccuaagcaggggguuuggaugacauugaaaagccuauucccuacuugacauaaauuacuuuagcagaaggguaaggcugaagugacuauuugaaaaguugugucugcgauccuuauuugcagaugcugagcaagaucagugcuguuuguaucauguguggcaguguccccucucaauaucaaaguaaagggcucuuagucccuuaauggauucccugcucaccuuaucccaaugauauucucaaccugaugcuucucacuuccugguagaacacucaucagucucagacuagacuaaacacucaagaucacugagauucugaaaucuggcuucaugccagaaaccuuaacauucaaagugaaaugaacacacuuaaccaaauacaucuugaugacucucucagggcauuuucuguacagggagaacuuccaucucuuaaucucaagaaugguacuuucucccccaagaaacugguccauucuccaaugccuaaaauauaaacaaacaaagugggacaccaaauaacacucucacugcauccagcccuguagccagaauacgagucuaauuacagucguugggcuucaaguaccacaacguggaaaaacaauuuagaaaaugccuucuccuccuuguggccaccccacuucuccuucacaugcagaaugcuuccaaguaugauauguucuagacuuaauuuuagcacaaggcucuuugcuuuguaacucuggucucuucauucaaaguuuacauaaauggaaauaggaaaauacacagacuuuucaaaaaaaaguugacugugagaaaauaaaaagauuguagucuauugagaaagacauaaacaucuaaggaaaguuuugaugcuugggacuuuuuguacauuuguuacuacuuucuuaaaaaaugaugggaaauuugagcaacugucaagccaagaaaaaaagcccaugagggaaagggucaaaagaggccagagagguacacagaaaugaugaagcagugucccaagggacaacgugggaucaagaacacaggagacagguagccucagagacaggagugaaggaugucucucuuuaagacaagaaggaaaaggggcaaaagcgggugacaaacagaaaaaucugaugugaagggaagcugugagaggcacucaguauagauguauaacaggguguucugccaagauuucccaugggguccuaagcagcaugaagccaagaaacauuaggaacagccacaauaggucagcaaaggaguucccguaguuucaaaugaaauuuuacccaguacucuaacaguguauaagcuucugaggaaguagucaauguuccauagagauaagagaaaauucaaacaggcaaacaacucugcaaggcugaauugcaggcaugaucuaaaacuuccuucuuucuucuaaaggccuccuccguuccaaaguugcucauccuaaaaccugaaaaaaaaaaugacucagaagugguucccaucucaagaacuacccacgagucucaguggacacaugugaguaugagaugugaguaugggauacuuuucuagagauuuuagaauguuugcuacugaagaguuugaauuguuaauuuuagaguugguccaugacauuaccuuugcacucugacucuuauuaaaauaccuuuauugagauauaauuuaccuauucacuuauuuaacauguauuucaccuauuuuaauuguacaauucaauggcuuuuagaauauucagagcugugcaaccaucaucacaauccauuuuagaacauuuuuaucacccacauaaaaaacaccauacccauuaucagucacucccucuuuuccuucaacacuacccuucccucuagccccuggcaacuacuagccuacuuucugucucuacagauuugccuauucuagauauuucauauaaugaaauuauacaauaugugcacuuuugugacuggcuccuuucacuuugcaaaauauuuucaaaguucaucuguguuguagcuuguaucaguaauucuuccuuccuauugcugaaaauauuccauuguauagaauaccugugccaccuuuuauuuauucauucaucagauauguauuguuuccacuuuuuggcuauuauaaauaaugcugcuaaguacauucauguacaaguuuuuugagugagcauacguuuuuaauucucuugaguauauaccuaugagugaaauugcuagguccaacaguaacucuauauuuaaccuuuccugaaccugccaaccuguuucucaaagcagcuacaccauguuacguucccaucagcaauguaaaggguuccaauuucuccacauccucaccuacacuuguuauuuucuguuuuuguuacaauugucauccuagaugugaaguagaucucacugggguuuugauuugcauuucccugauaaucagugaugcugaacauaauuuuacguauuuauuggccauuuauagaucuucuuugguaaaaugucuguucaaauccuucacucauuuuuuuaguuaucuuuucaguauuaaaugaaagguucuuuacauggucuacauacagguccuuuaucagauacauaauuuauaaauauuuucucccauucugucaauugccuuuucacuuuccugauugugucuuugccacagaaaaauuuuuaacuuugaugaaaucuaacuuaccuaucuuuucauaggugcuuacgguuuugcuauuauaucuaagaaaucguugacaaauccaagguuaugacaacuuacaccuauguuuucuucuaagaguauuacauguuuagcucuuauauuuaaguauuugguuaauuguaguuuuuguauauggugggagguaagggucaaaauucauucuuuuacauauguauauccagcaguccaagcaacauuuguugaaaagacuacuccuuucccccugaauugucuuggcacucuugucaaaaaucaacugauuguaaaugcaaggauuuauuuauggacuuucgauucuauuccauuugucugugucuauccuuaauccagcaucacgcugucuugauuacuguagcuuucaguaaguuuugaaaucaggaagugugauuccuccgaguucauucuuuuccaagguuguuuuggcuauucugaggccuuuaaauuaucuuaugaauuucaggauuagccuaucaauuucugcaaagaagucagcugaaauucucaugagaauugcauuuaaucuucagaucaauuuggaaacuacugccaucuuaacaauauuaagucuuuugacucaugaacaugguacgccuuugcauuuauuuagaucuucuuuaauaaucuuucaacaguguagcuuucagaguauaagauuugcauuucuuucguuaaauuuauuccaagguauuuuauucuuuuugaggauauuauaaaggaaauuauuucaccauauuuuauuuacaaauugaucauagcuaguguauaaaaauacaauugauuuuuguauguuaaucuuguauccugcacccuugcugaacuugcuuguaagugcuaauaguuuucuuaguggguuccuuagaauuuucuaucuacaaacagagaucuguuuguguuaucuacaaacagagaucaucuuacuucuucuuuuccaguguggauccuuuugauuucauuuucuugucuagcaguacaauguuuaacacagauugcaagaaaagacauccuuauguuguuccugaucuaugggagauguccucugauuuuugcuuugacuccugccaagcccucaugaagacagucaucacuagauuaauaaauuagggccuggucuaauauauuuggaaacuacugccaucuccucgucauuaaaaguuccauaagaugauagugaaaauauaaauugguaaaguccuuugaaggaacgcuuggcaaaaaucugucuuaugaaugcauaguccuuuugucccagcaauucuaccacuaggaauauauacuaaagauauaaagauauaacaucucccacucaugcaaaaugauguauguacaaguuuuuuaaacacaguauugucuguaauaacaacugucuuaauaacaggagauggcuaaaugaggaacagggcauucaacaauggaaugcuauggagccaaaacaagaauguagaaguuuuuuuuauguauugaugugguacgaucuccaaaauacauuaagugaaauaagaugcagaagacuacaaauuaccauuuguauaagaaaauggcaaaaaaaaaaauacacaaauggaguugcuuauacaugcauaaaauaucuuuggaagacuacauuagaaacugguaauaucaguugguuauggggaaggcacacuguugcugguggauaaacauaagagaaagacauucuacuguaaaccuuuauaaacuuuugcaauuuuugaaccaagugaauauaguaccuauucagaaaacuaaguuuaaaaaaauaauaaaucacauaccauaaaagccagaaaauaguuaauagcaaauaacugaacagucuaugaaggacugaaaagaaauggugcauggugguaucaacaguccugacauugccaaaaccuagguuauuuuucugaaucugaugcuaaccagaaacuugaagacauaaguugccuaacuuuuguggacucaauuucuuugccuaaaaauccagggaucagaauaguuaacuuuacaguuuauacagcuaauugaagucaacuuuuucuggggccaacccuacacuagaaauuuuacgggcauuuaaaucucacagccacccuauaaaaaugaacuauguccuuuaaaaaaauuaaaaauaggauuaccauauaaucuagcaacuccacuucuagggauauauccaaaagaauugaaagugggguaucaugggccaaauuguauucccacaaaauuuaugaaaucuuaacucccaguacuucagaacagcauuuuauuuggaaauacauuuuuaaagagguaacuaaguuaagauaugguauuuaggauggguucucaucuaauaugaaugguguccuuauaugaagaggaaauuuggacauggacacacagacacacacacaggaaagaucaugugaagauauagagagggacagucauuuauaagccaaggggagaggccucagaagauauuaauccuaauaacaccuugaucucagaugccuagccugcagaauuaugagaaaauaaauuucuguuauuuaagucacucagucuagggacucuguuaugacagcccuagcaaacuaacacacgggucucaaggagauaucuguacacccauguucauagcaguauuauucacaauugccaaaagguggaagcaacccaaguguccacugacagauaaauagauacacaaaauaugguauauaaagacaacaugcagaugauggaagauuauucagccuuaagaagaaagggaauucugacacaugcuacaacauggaugaaccuuggagacacuaugcuaaguaaaauaagccagucauaaaaugacaaauacuguaugauuccacuuaaacaagguaccuggaguagucaaauucauacagacagaaaguaaagugauggcuacuaggggcuggaggagggggaaaaaacuggggaguuacucuuuaaugaguguggauuuucaguuuuauaaaaugaaaaaagaguucuggggacagaugcauaccaauguggauguacuuaaugccacugaauuauacuauaaugauuaagacgauaauucuauguuguuguguuuuaccacaauuuaaacaucuuucaaaagggcacaaaugaacuauuauucucucauuucacauuucaucuaaacuaagguuuagaugcuaacauuguuuucucaaguucuaacaguuaguauucccauccaggucugaauccaaaaccaagcuagaaguacuacuuucccauccuaccauuaaauuuuuccauuuuaaauaaaauuuuuuaaaaaacuuuuuuuuucuauuaccuccaaauucagguuguuuucagaugauuuugcuuccccaacaagcauucugcuuguuuagcuacccuggagguguacgcuuucuucagaaguuuacuugaaucauucccaugcuucccaaucucuauauuccugauggcacuauagcuucuuguuucaggauccaaaaagaggaagaaugaaauggacuuuuuccaaaauacccaguggcucuaaugacagaugccaagacagcuuccuccuuguaugccaaaggcuacauucucugcaguugaacauauuacuacuucuccucaauugucucaauuuccaaauacuguuggaccagaagcuuugcucucugaaaagcugaaacuaguccccgggguaagacuguggagaguccuguuccccgugcuugccaaguggcaaacagguuagggcuggugagaagaacggaauguccugugaaaaaaaggagggacguagaaguagccacaagcaauaaggguugcugccaugguguuucaugugcuggggaacgaaaguuaaagaacaugaaggagcucaggguaccgaugcaaaauucuaggaaaugaugcuacguucuuuagaaugcucggcucuccagaacauaaggcccugaauugcuggaagauuuuaaaaaauacuuuuugcuuaaauuuuaugaacaaauaaaaaaaauucaaccugggaauaucagauuaauucuccaaaucccuuuauacugugaaagagccaagaguuaaguaacucugcagcuagaguugggaggccaagccggguggaucacuugaggucaggaguucgagaccagcuuggccaacauggugaaaucccaucucuaguacuaaagauacaaaaauuagccaggcacgguggugugcgccugcaaucccaacuauucgggaggcugaggcaggagaauugcuuggaggcaggagaaucgcuugaacccaggagagguugcagugagcugagaucgcaccauugcacuccagccugagcaacagagugagacuccaucucaaaaaaaaaaaaaaaagaacaaaaggaaaaguacauuuccugggcucagcuccccaaauauucucacaguaaggcaaaaucagugacauaagccuccaagucauugcucagauucugucauguuacugaaauuuuguuacauuuaauacagauugaauauacuuuaucugaaaugcuugggaccagaaguguuuugaauuuuuuuuuuaauuuuggaauauuuguacaugcacacugagauauuuuggggaugaaacccaagucuaaacauaaaguuuauuuauguuucacagacaccccuuuacacauagcuugaagguaauuuuauacaauauuuuaaauaauuuugcaccugaagcaaacuuuguguuaaguacccgaguguggcauuuuucacuuguggcaugauguuggugcucaaaaaguuucacauuuuggagcuuuucagauuagggaugcuugaccuguacugcuuggaagaaguaggccaugaacuagggcuaagaauuuuuuuuuauaaaauaaauagcuacagcuauuguagucaucucuuucaucgcagaaugcauccuguucuagauauucuggcagaagcugugaucaccggucacaccacacuuccuucugaguguuuacacaaccacauuauuuuucagugaauugaauacuguauaagcacaggcugaaacacagccacaucagaccuagaaagaaaaauggagacacacacauucaauaugcaucuaagcucaaaaccuguccaaagucuucaaccucagaaccuaagagaaguucgccccugugcuagcucacggcuggcucuggcacaaggcaggcaaaugucuuacccaaggagccacauaagcuaacagugccaccaagaaaagaacuggaagagauaaauacauagcacuuucauucacucauccucuccucaaauauuuacucaguacuuacuauacguuaguuagcacggggcacuauacacuacgccuugaaaguaaaauaugaggccaggcaccguggcucaugccuguaaucccugcacuuugggaggccgaggcaaguagaucaccugaggucaggaguucgagaccaacaugaugaaaccccaucucugcuaaaaauacaaaaaauuagcugggcaugguggcagucgccugcaaucccagcuacucaggaggcugagccaggagaaucacuugaaccugggaggcagagguugcaaugagcugagauugagccacugcaccccagccugggcaacaagagugaaacucggucucaaaaaaagaaagaaaguaaaacaugaaugagagcuagcccccuacuccugcccacccccaucuucccauaugucucuucuggaaugaguaaguuacacagugauauccccagaggcuacaagaaggacacauaugcaaugguaacuuccugcguggccugaaugagcugagggaauggggaaacuagaaagcaaacuggccucuuugguugaauuuccagucuuuggagaaguugucuauagcuccuucuaggcugccuaccaaguauaauucaaacuauucaaacuggcguucaagcgccuaccccagcugugcugucuucuguguccacuccuaagaaauaacuauaaggcacucaaauggaagucccgcuauuuccuggaacacacccaaucuuggucuggacucuacuuugaccauacuaaucuugccaccuuuaacaccuuuaccuguccucucucccuguaacacaugcacaccacucucuguuuaugaagaguucuuuuuccugcauuuuuguccaaugcccucuuccuaugaacccgucccucauccacuaucuccuucccuucccuuccaucuacaagacuagaaaguuaucugugcaucugcugcuuugcauagucaauaccaggcccaaagcaggaacuuaacagaugucacaucugcuaacucucccaguugcauaacgaguugauauccucauugugcagacgagaaacugaacuuuagaauagucagguaaauaaaccaaaguauuacaacuagauaagaguggagccagguguggcuuguucaaagccugcauuuuccucauuagacccuuuggaguguagugugugcaugggacacaauuuauguaacacuccuaauuuaucuccucucaccucccacuucaguccccgaugcagccuuccaauccagcagagguuccaaccaacuuccaaacaggugcaacuugauggcaccucauuuuuggcuguaccagaugccuucuaucucuggacuccugcccucagacuucuccgacaccugaagaaagcuucugggacagcugacaugcacaaccugggagcuaaaacaugugggaccagcugugaccaaugaacaaugauggacaggagacgauaaccccauuaguuccuuacagugcugagauaaauuucaugagucuccuagaagaucugaugggauugaacaucaguuguaccuagcauggccgcuguacuggcuuuccuuccuucccuauuucauccccccucgucccuccuacuccuugggaucacauugacaaauaagucucuugcaugcaauucuuuauuucaagcucuguauucaguuagcagacagcagaaaugugguccaaagcaggagaggacucagcagcagcaggcucugguacaaucugcccugucacucaagccaugugaaugagaagauccagugguggcugguugaaugcaugacuccccuguggaugucagccagagucuucuucucagacaaccagugcuagcacaaugggcccauggaugagauggcucagguggcaggauaaaggcuguaugugggcucgguauugugggcuuucucuuagcaaugaccuagcuauuaccacugcugaaugguccagccaaccaauggcagagggagaugccaaucucuauagcaccuucacagauaucagccaggcccuuggggaaaggcugaucauaacagaccacuuccaccccaaaaaggagaggggagauagaaauucaugcuuacauaaauugacauguacuccagguuuggguuugcuuucucugccuuuagggucucugcaagugccacuauuugagaacauaagaaugccuaaucuaucaguguaguaucccacacaacauugcuucagacccagggaucgauauaugucaaaggaggugcagcaaugaguguaugaguagggacuccaugaguuuucucauauaccaccucauucacaagcauccagcuuaacugaagacuggauuggccuguuaaaggcuuaguuaggagacuagccugagaaacacaaucugcgauuccaguaucaccuugauucacgccccggcccuggaauuucugcaagguagcuugguuuuuugguuuuguuuuugagggguuuuuuagugaagaauggugucagaaucuggguagcagguguucucauuguuauugggaucucauuucuucuugguccuuuuaagaggcagagcuaggaaauauaugaccguauguauacuauacauauauaugucuucacacauauuuauaaauauacacauacauacaucugcacauaaacacacauauaugcauucacuugcauauuuuagaaaucauaaauucaauucacaccaauaugccaauuccaauccacuccauagggcuauuucugccuuuucucauuugcucaaccuuauuauacaccuaaaaaggguuucgagauugcuucauccauacuacuacaugguucgcaucuuaagagugaugaaacuuugucccaaagcuacccggcaggauuacacuccucuuauuugugagaaauguaucacauacccauggcugaaccagucucuagcaaaggagacaggggaccaucaugauugguuuagaccaaucauucuccuccauccccaccaccccugggaccagaggccagggcccccucucaaacacaccaucccauggaggagggugagcuaccuggagauaauaagguuucuccuaggaagaaggaaugcaggcuacagagcauggauaugggaaaggcaaccaacuaucuccuauauuaaccuacaauccagaguggaauaggcaacauaagacuucugaaguuauauauaaaauguucuuuguguguacacacgugagaggagaaaauccucagucaucauuuucucagagggcucagugacccaagaaaaguuuagaaccauuuucauuuuuaaacaaacacagggccgggcgcgguggcucacgccuguaaucccagcacuuugggaggccgagacgggcggaucacgaggucaggagaucgagaccaucuuggcuaacacggugaaaccccguuucuacuaaaaauacaaaaaauuagccgggcguguuggcgggcgccuguagucccagcuacuugggaggcugaggcaggagaauggcgugaacccgggaggcggagcuugcagugagccgagaucgcgccaccgcacuccaaccugggagacacagugagacuccgucucaaaaaaaaaaaaaaaaaaaaaacacagauuucaaucuuaaauuaaacaagaacaagagguuuccaggaacuuaaacccuaauucagaaaauacaaguguuuucucaaucucauuuauuacacucugcuuugagggcaggaaucagaagacugcacagcuuuugucaaaauacaaauguuugucucaauuugaguccucugagcuuauuccuagagccugacuuuucaggcuucuaaggcaauuaaggggcacugaauccucagugaauuagacaugcugccuuuuaaauucucauucuucuaaagaaaaaaggggauggagcaggagucccugaaggaauaaaggaaacagaagugcaaaccgccauaaagaagaagugaauccauggcuuaggagcuaaagagcaaaugucaaggcagcuugucaguuucaaugugcucuugggauuucaucccauuggccccaaaugcagcauucaggguccuagaaguauuaccaccaucuggaacagcuguggucauagaaagagaucaacuuguccagagcuuuaauccucuagggcuucuucaacaguuccauuuaaucuaucugaaaaggcuuaguacaaaacugcagccauuacgcaggguaagaaggagagagggagcauuaaaaagcaugugcuuuuggguguggcucuuacauuuuugccaggcagacaacugcuguucaggcagagaugaacgcauggaaucuagaagauuuuacucagccaccucagucaaaaaguggcccuauaaaacaaucauccaaaugaaagacuuuugagaguaaaagaggauacuauuaaugauuaaaccaagacaaaagccacgaagcagggcagacucagccaaccuaugacauccucaucaaucaguacuuuauauuacucuccucugcucuggucucugucauugacucagcacuuuguacaugcccaacauuguguuaguaucauagagaauacacaaaauuaauuaaaaugaaauagcauaccauaaauaccauaacacaccaaaacauguagcccuugcccauacggagccagcucuucacauuaacaucacucuggccgccuuaagcaauagccauuuggcuagccuuaaaauuaaaauuaacugauguuuacucugagcuaaggcauuaggagcauuuauuugcaugcuuugguuuuuaaaucuuugauucagaauauguccaagugacucacuagucuauuuuggucuugggcauuaagcugcauucagaaagucuggcuuacgaucacacauaccaggguagagggaggcucuccuaagaaaccacuggaacaucugccagaggugaugaaaccaaacagaucugaucaauaacaccuugaaaauagauauauugaacccugaacacauuuuuacauuuuaagucaacuccaaagcgucuccuggaucaauuaucauugauguacauuaacugccauucucuaguccucuuagcuaaaaacauuucaaaccuaggacucccaauuucuugcacucuucaacacuggagggggacaaaaguaauuuuaccacugaugcuuaaagaaaaauuuaccuugaaaaauaaauaccauagauuuccugaguucaaaaagaaaauauuuauuauaaaauuuagaaaauaaagaaagguauaaggaagaaagcugaaauuacccaaauuccacuacccaggcaaaacugcuauuaguauuuugguguauuacuuuacagccauuuuuguacacaaaccuauaacuauauaugcuugcauagauauagaauuuucuccuaaaauuaagaccauacuguguauauaauuuuuaauaccauuuuuaucccuuggcauuuuacugugaacauuuucugcagaaauuaauccuauuuuuguaaacuuuuuucaguugcaaauuauuccacucaaaauacaguuaaguacucacuuaacauuuucaacaguuucuugaaaacugugacuuuaagcaaaacaacauauaaugaaaucaauuuuaccacaggcuaauuaauauaaacaagaauaaguuuccuacggcauauuucugaucacaaaaaauaaccagauuucuaaauaaagaccaagacacaucuaauauuaacacugaagugaaagugggcuaugcauacauuuaagaaagaugaauaggccaggcgcauuggcucacgcuuguaaucccagcacuuugggaggccgagguauguggaucacuugaguccaggaguucgagaccagccuggaaaacauggugaaaccccaucucuacugaaaauacaaaaguacagaaauuagacgggcaugguggcgcaugccuguggucccagcuacuuaggaggcugaggcaggaggauugcuugagcccagggaguagaggcugcagggagccgaggccauaccacuguaccccagcccgagcaauagagugagacuccauuucaaaacaaaagaauaaaacaaguaagauaaugauguugccaauuacuccaguucaggguggccagaucuuaucccaguagcucagaguacugagcugggacccaaccuggacaggaugccaucccgucucagggugcacccacccucacccacacucacucagauggggacaauguagacaugcccacuaauccacaugcacaucuuugagauguaagaggaaauuugagugcccagagguuacccuugcagacacgggcagaauguacaaacuccacacugacagcggcccugguugggaaccgauuuuguuuucucaucaacacuauaauaaaacaauguugaaugaaauggcauuauucaaggaccuacugcacuacaaaucuugcuuauaacgaugcauauuuauuuguaauuuauuauuguuaauguuaaacuuuuuuuuuagauucggggguacaugugcggccuuguaacagggaguauggugcuuaaugcugagauuugagcuucuuuugaacucaucaaguaaccaaaugcagagcuagcaugcauuuguagcaugugugaauauguuuggcucuuuaaaaacaccaaguugaagaacgauauguuaagucacucagcuuuacaggacuugaaaucaacaugcucagaauaacccaaggccucugaaauggauaaagagauaaaaaucagggugguaucagacuacuuucucuaaaggccaaucagaacagaaggacauccccgcggggaagaugugcuagauacugcagcuucuagaaacagauaguaauuuuuaaaucauacgaaaucauucaucuaaacauuuuaauacuuucuacaggcuuuauauuuugugucaaguacugacaauacaaggagggcugaaccauaaucuuuucucucacagacuuuacagccuacagaauaauacagauuuaaagcugacacuuuguuguguuuuuuaacauaugaauuauuuauggaauuuuuuauuugcuauuuuggguuuuuuuguuuuccuuuauuuuauuguauucuauuauuuuagauucaaggguacacgugcuaguuuguuacauagguguauugcauaaucaugagguuugggcuuccaguguacccaucacccgaauagugaacauugcgccuaguagguaauauuuuuaauccuuacccacuuuccacucuccccuuuucuggaguccccagugucuauuauuuccaucuuuauguaugcacuguuuagcuccagcauauaagugagaacaugcaguauuuuguuuucugucccugaguuacuucacuuaggauaauggccuccagcuccauccauguugcuacaaaaggcauaauuccauucuccucuguggcuguauaguauuccauggcauauauauacaccacauuuucuuuauccagucaaccacugauggaugcuuagguugauuucaugacuuuguaaaguugacauuuugaaugcuugagcccacugaaagcuggugguugagagugagcaaaaugaaaucauaccaagucaucaaagaguauaacaacaguucuuuuccgcuuaauacaguucauuuuuuuccuacccuauuuugauaguuugagauauaugcucaaucaauuaauuuaccugcaaugaaguuauuauauugaaaaacauauacugagcucuuccugugugcagguacuguccuaggugcugugaauuucacaaugaaagcaccagggccucugccccuauaaacagccagggugaggguguguuucaaggcugguuccuggaaaaggagugugcauugggagguggggaugggagacgguaaaagggaaagugagaagaggcaaggcauucugguaaaggccauaagcaaacacaccaucaaaagcaaagaggugugguguguccagagggcuaggcagaaugugugaggagguagugucaaguucuaggcagacagcaccaggaaacaaaaacagagguaagcagguagugccguugaggaguuugaagcaagguugguauggucacaguucuguuagaugaugcccugcuucauacuucauugacaaaauaaaagccaugagauggcacuucacuuaucucccaucacaaugucacaaagcauccaaauccuccaucuucccuucuauacacaagggggcaugucccucccaucaaaggccaagcucucugcuggcucuggauucauccacucuuguccugggaaagauuccagugcuuccuugcaggguuuccucccuucccugacggaugaagcaucuauccucccuggaugaaggauuccagggccucaucuuggugaugcuccgaguaucaucaucaugcuacuuuugccugguuuauucuuaucaguaaacaucauuuguauuugccuaaaaaaaugcuucaguucauuccacauccccuccagccauaauccaaguuaucuaaagaguugucuacacacuacauuguuucuacuuuaugguuuucuuucugcaacagggucucgcucuguuauccaggcuggagugcaauggugugaugaggcucacugcaaacucuaccuccugggcucaagggauccucccaccuuagccuccugaguagcuaggacuacaggcacacaccaccaugcccagcuaacguuuuggauuuuuuuuguagagaugggguuuugccauguugcccagguuggucuugaacuccuggacucaaaugauccacccgccucagccucccaaaguucugggauuacaggcaugaggcaugagccaccaugccaggcccauuguuucuacuuucuaacuucugcuuucauugcuccaccgaccaugauguggcucuccuuugccaucauauguccaaaaaagcucuugucaaggucaucaaccaccccaaagauacuuuucucuuuauuuacuuauuuauuuuuuugagauggagucucacuccauugcccccaggcuggggugcaguggagcgaucuccauucccuguaaccucugcuucccagguucaagcaauucuccugccucagccucccaaauagcugggauuacaggcgccuaccaccaugccuggcuaauuuuuuguauuuuucguagaaaccagguuucacuguguuggccaggcuggucuugaacuccugaucucgugauccgcccaccucggccucccaaagcacugggauuacaggugugcaccaccgcaccuggaccccuauagauacuuuucucauuugacucuaccuuugugguaggcagaauaauauccacuccacucucaaagcuguccauguccuacuucccagauucugugaauauguuaccuuccaugacaaaacgaucuuugcagaugugauuaaaguuaaugauugaucaggauuacuuggauauuuugagcgggcucaaaauaguccuuaaaaguggaagaggaagguagagggguugguuagagagaugcaaugugagaagaacuugaccagccuugcaggcuuuuaagaugaaggaaggggacagaacucaaggaaugcauguggccccuagaaccuagcgacaguccucaacugacagccagcaagaaaacagggaucucauuuccacaauuacaagaaaguggggucuauucuccccuagaaaauagguccugcacucucugcugcagaccacaagggccucuguaacacgauucuugcccauuuuucugaucccaucucccaugacuuguucaauugcucugugcauuaaucacucucuucuaguguucaguucuuugaaaccaauaagcucuuacacaucuuugcacagacuguucauucugucuggauugcuuguucaacccgccuuuuguuguuuuuguuguucuguuuucuuuuguuuuguuuuaggcuuuuugcagccugaaaucaugguuuuuaguuucucucucuagugauaagcagaaaagagggaugaugaaggggcuuuacuggcccaaccagaaacagaaacuaagaacccauaacuguauucucuccuuuggacaccccuggcucccuucauuccucuucuaguuucuucgcaccuuuucgaacucagcuucgaugucaucaucaaggacagcccuuguucaucaacccuacgcaaaggauaccuucccuuucauccuccaccucaaauccugguuuguuuccuuugcaacaguuuauaaacacauuaguuauguuugcguacacagcuuuauuggccuucaguacuagaaacuaaguuuugcgagagcagaaacagugauucguuggcuguguuaucccagccugaaaagaguaauuggcucguaaaugguuguugaauuacuuccuuagucauucugguggcagauggagagugggucaaauagaggaugaaacuggagucaggaaaacuaauugagagauuacagcagaggcucaaaugaaggaugagaagggccuggauuggauuagugaugguagagauggggagaaggaacucugaauuacacuaaagguccuucuagggaaauagcagguaacaacugagaacacuaucacaggagaagcaaucuaggaaugcgggaaggggugcacuugggcugaaacagguuaagauucaggcaccaaccagguaaagaaauccaaggccaguugugauggcucaugccuguaauuccagcaguuugggaggccaaggcagguggaucacuugaggucaggaguucgagaccagucuggccaacauggugaaaccucgucucuacuaaaaauacaaaaauuagcugggcgugguggcacaugccuguaaucccagcuacuugggaggcugaggcaggagaaucacuugaaccuggguuguugcagugaguugaaaucacaugccacugcacuccagccugagugacagagugagacucuaacaaaaaaaaaacacgaaacuaagaaaagaaauccagcaaacaacugcuuacucaauucuuaagcuucaaggaaaagacugaauaaaaacugagauuugggaguuacuguuauacauagauauguacacauuaacauuuuuauaguaugguaguuccaggauguucucaguugucucaccaagaagucuaaaagcauuacuuaacagucaaccuagcaacagugaaaauggaaaaagacucaguccagagcuguccucuagaaaacccaaucaauacacaaugaaaggaaacucaccacaauggcauuucacagcuccauacaauccauucuccucccacuuucccccuccugauuaucucaagccuuccuggcuacagauggcccacuuccuaacaaacaucagccaaugagcaccacauggcugugcucccugcagagcagagcagucagauaucauuaaguauuagguaaaacaucaucccaggaguucucccugacaaguaucaaaacacaaauucuaacauguuucagucucuucuuguaccuauucauauaugguaccucgcuuacuuaauuccauauucuuugccuuauauagagaccccuuuauuacugccuaggaugcagguaugaagaaauaauuaguggaacaaaacucagcuucaaguaaagcauuaaccagaaggauagaaugggagccgcugagauuaccaguucaugagucauuaccaauucuuauuguaauccauguaaauauuaagaugcacuuuucugcuuuguuaguauuaucuuugcaacagauuucaugguagaaccaccauaauaaacagaugguacaucaaaaguucacucguuaaucugauuguuuagcucugcauauauuucccagauacacaauauuucaauggggagccuccaccaucagcccaacaaaagccuauuuaacugauaacauaagugaauccuagaucuuugaaccuggaacaggccuuaagugaguagaagucauuuuaugaggaaaaaugaggaaagaugaggaaaccgaggcugcuccaagucauacaauuaguccugugaauaaugcuuuaaacccauccacccaguauaaccuguuucuguaagaaaaugccacgggauuucccggcauucacagggauugcuaagagcaucugauuuccacuuuugcuuuggaaugcaaagucuugcccgguuucaaaccacuggaggggaugcagugccgauggcuugagaaacaaauuccagaaaggaaugggccaaggaauagagcugagggaugauaaggagggucuacacacuuucugggaaaacggagaucauaguaaaaguaaaaauacagaauacccucuugcauuuuugacuucuuuaauuuacaauaugcuuuuccauagaggaagggaagauaaaggacaagcuacuagaggaaggggguggaaagaggaggucuauauauuucuuuuuuucuuuucuuuuuuuuuuuuuuugagacagucucacuccgucacccaggcuggaguaguggcuugcucuuggcucacugcaaccuccgccuccuguuucaagcuauucuccugccucagccucccgaguagcugguagcugggacuacagcugugcgccaccaugcuuggcuaauuuuugcauuuuuuuuuuuuuuuuuaaguacugauggggucucaucauguuggcuaggcuggucuugaacuauuggccucaggugauccacccaccuuggccucccaaaguccugggauuacaggcaugagccaccacacccagccaaaggucuauauauuucuaagaaguggaggaaaaggcucagaagaauuagaggcacuaaaaagcaucaccagggcugggugcaguggcucaugccuguaaucccagcacuuugggaggccaaggcgggcagaucaccugaggucaguaguuugagaccagccuagccaacauggugagaucccaucucuacuaaauacaaaacauuagcuggacaugguggcacacgucuauaaucccagcuauuugggaggcugaggcaggaaaaucucuugaacucaggaggcagggguugcagugagccgagauugcaccauuguauuccagccuggacaacaagagcgaaacuuuguuucaaaaaaaaaaaaagaaaaaaacaaaacaucaccaggaagggcacaucccuccucugcauccccuaccuugucaccucuaccauuaacaaaaucagcaauaaggauguaucaggagguggccuuuugucuuucagccugcugccaaguguacaguaggucgcuucacaaacauuugcugauugaauacacauacacugggaaucuuaaagcaaaaggaagaaauguuuaccuuugcugaaguuauuaaacuuagguugcuuuugauacaaaaugcaagagggcaggaaaaauuuaaauaagggaaauaagggcaggcuguaacuuauagauuuauagagcauaguaauaucauuuuauuaaagacuuuguguuccaggcagucauuucaguuaacccaacuaggguacugacaaggacaggaugaaucuggaauucuugccuggauaugguccaaucucguaugcauagauugcaacuuaaaugaguccagguggcucugaccauuaaaauagcuaccauucauucaaucaacaaauauuaucaaggagcuauuaugcaucaggcucugugggggucuguaaaaaugaacacaauauuuauucucuuaaauaaaugcacagucuggaugggggcaguggcucacgccuauaaucccagcacuucgggaggccgaggcggagggaucacaaggucaggaguucgagaccaaccagaccaacauggugaaacccagucucuacuaaaaauacaaaaauuagccgggcgugguggcacgugccuguaaucccagcuacucgggaggcugaagcaggagaauugcuugaacccgggagacagagguugcagugagcugagaucacaccacugcacuccagcuggggcaacagagcgagacucugucucaaauaaauaaauaaguacauaaucuaucaaagauaaaaggacaucuuacaaaaauaaguagcggcggcuaacaccuguaaucccagcacuucgggggacugagaugggcggaucacuugaggucaggaguuugagaccagcuugggcaacauagugaaaccucaucuuuacuaaaaauacaaaaauuagccaggcguggcggcgcacgccuguagucccagcuacucaagaggcugaggcagaagaaucacgugaaccugggagguggagauugaagugagcugaaaucgugccucugcacuccagccuggacucgaacuccagccuggacaaaagagcaagacucugucucaaaaguaaaaaauaaaaaauaaaaauaaguagugaguguuuauaaggggaaagcacuauacuaaacgugcaauaacucauuuaaucuucaugaaaauuauguaaucaacuauuacugucuccauuugacagaugaggaaccuaagacccagacacuguaaucccagcuacucgggaggcugaggcaggaaaaucgcuugaacccaggaggcagaggcagcagugagcugagaucacaccacugcacuccagccugagcaagagugagacuccgucucaaaaaaauaaguaaauaaauuaaaaaauaaaauaaaaacauacaauauuuuaaauauuuauuuaucaaucaacaaacugguuuuguuguacuggugagccuaugcaauguauagcuggagugcaguggcgcaaucucggcucgcugcaaccuccgccucccagguucaagcgauucuccugucucagcccccagaguagcugggauuacaggcacacgccaccaucccuggcuaauuuuuuguauuuuuaguagagaugggguuucaucauguuggccaggcuggucuugaacuccugaccucaggugauccacccaccucggccucccaaauuguugguuauagcuuauuuucaaaauaaaauucuuucuaaguagauucacuaauauacauauauguauuuguguguauauauguguguguguguguauauacauauauguauguguauguauguauauacauauauguguguguguauauauauagagagagagagagggagcuagcuacucugggggcugagacaggagaaucgcuugaacgugggagguggagguugcagcgagccaagauugcguguguauauauauauacauaugugugugugugugcauauauguguguauauauauacacacauacauauauguauauuagugaauaauauacuuauauucacuauuauauagugauauauauacauauaauuauagauacacauauauauacacauacauauauguauauuagugaauaauauacauauauucacuauuauauagugauauauauauacauauaaguauauacacacacauauauauacacacauacauauauguacgugaaagcaaaauguaaaaaaaugcuucauauugauuaucugaacauuauaaaauaacaaaagccgaaucauuuuuucuuggcacacguucacacacuucaaaucaguuucuuagccauaaaccucuaacacugugucucauggaggugucccgguggcuggugcacccacaggucagcaggggcagcagugucaaauacaucucccauuaccgugaaggagucagccaauccugaccguauggauuuaucagccagaaagcacccugcgugcugcccaugaaaggcaaaaaaaaaaaaaaaaaaaagacaagucauugcugggccucuuucacaugggguuucacuguguuggccagaauggucucgaucuccugaccucguuuuccgcccgccucagccucccaaagugcugggauuacaggcaugagccaccaugcccggccaaaaacaugacuucuuaaaggcaaauauggagaaaagggcauucuaagggcaaggggaaggaaagcagcaagaacaagagcaugaagguggaaaauccaagggcuuugcagaacaucuagcugacgcccggagugugaaaaaggagaauagugcaggagaggcccagaaaugaggccgagacuuaaucacacagggucacguaugcagggcaaaaauauccauggccuauacacauauugaaaaagaaaccguaguucugagugguugagaaggugacccaaggccgucaaacucaaaugggguggaaaugggacuugaaccuaaagcuccuuagauggcuggucuagaauucacuugaaaaaccaucuuugucauggcucuagaggaaaacguagauggcucaauacagaucuaguggcguucaguagcacacuguguucucuugucguuuuauggagggacugcaugugcuggaguccacagagaccagccaagcaucucuuuacucucguaauaauguacgugccaccaaucagcugaccagaguccauccccuggauagaggaggugcuaaccuguccccugcuaacugagguagagguucucguguccucuauggccaguguugugccuugcuauauuuaaacccugccugugaaggauucugcaaugugcccagggcuaugagaugaagcagggggcgcugagaaggaaaaugcagcauacuuucgcaugccaccaucccgaaugucuguaauucgucccaagugcgaacuaaaaccucacuaauuucaccuuccuuuccaaacugccuccuugcgaauuucuacacauaaauucugacuaaaccugacaucguguuuucugcaaaagaaagcaaucugacugccaaccacggaggaaaaguuaugaagaguggcacacagcugcagcuuuuucuuucuuuuuuauuugguaaugugugauugacgauuaaaauggaaucuugcuggccugaacuccuuccugacuacuauuaagcuggugaagcuggcaacaguuucucuccccuccacuaucugaguuagacuugggacgaggaugcaaagggccucagaugaccuccgugagcaaggggugccugcgggaugcuaaaucgcagcucccuggggggccuuggagauauccccagaaaaaguggagccccacagcuuucucagcagccugcuuuaucaaaugagcucuccccagaacaaaaacaacccugucaggcaccauaaacagucaggaaaacaugccccuaaacaaagcuaggcuauucaguggucccagagcugucucuuccaccccucggguucaccaacccaacaacucccacagaguuggcugcagaaauuggaagaaauaaaucuccgcugaaggagaaaaggaugaagacagggccagucacugcccucauucuuuccauugcaucgggaccacgugcugcuggcuauguucacagggcaggugagugguuuagaaaccaugucacauacagagcagugaggacacccaggaguacauaaaccagggaggaagagauuaaggaaagucaugagaguuuucuuucaaucauuucaagagcugucuuguugaaaggggagucaauuugcugugaguuacuccagaaggcaaaggaauaagggaauaccacucacaucuuuuacuauaugcuuuuuauaguagaaaaaggacuuucuuguuagucagaaagggauauugaguguuuugaaucuguaucacauccuacuucucuaaggagcucuuccuucacuccuccugaucaaagguugauucugucuucagccuauucuuuccccgugcggcucacccacggcaaccuauucuccagguuucuaccacucuaugucacuucuuaauacugcaccccaaccagguaugguggcucaggccuguaaucccagcaccuugggaggccaaggcagguggaucucuugagcccaggaauucaaaaucagccugaguaacauggggacacccccucucuacaaaaacaccaaaauuaaccaagggugguggcacaccccuguaguuccagcuacuugggaggcugaggugggaggaucacuugagcccaggaggucaaggcugcagugagccaugaucaugccacugcauuccagggugacacauugggacccuaucccaacaacaacaacaaaauacugugcccuggucuaacaagucuuagcuagacuuuugcacugguuuucuuacugaucucucauuuuugaggaguaaacuucuccuauccacuguccuccaucacagacauauguucaugcuacuucccacauuaaaaucccaacacguuccuccuugcuugccccagccucaucucucaauacuccuucagcugcaccagguaaccucacaccuccgggucuugcucauguaucugcagugcguuaaauaccuccgucuuccuaauggugcaaacuuuugacauucagcucaagcaccuguccuucuaauaugaguuuccacccuuucuccauguaccccaccuucaugacacccuccccucaccacuggacccugacuuucccaguauguuuagcaaucuguuauguuuauuugaugacaggacugccccaugcuaagcuggaagcaucucaaaggcaaggggccacuuuuguuucauugcucuauccccagagccuaaugugcuaucugggaugugucugaugaauacguaaaaagaaagaauggaggaaagaaaaagaugaagggaggaagggagagaaggaggguaaaaaggaaagaagaaagggagggagggagggagggaagguggaaggcagggagaaggaaaggaaggaaggaagaaaaagaggaacgaagggaggaaggaggggaaaaggaaagaagaaagggagggagaaagggaaggcagaaggcaggaugaaggaaagggaggaaggaagaaaaagaggaagggagggaaggaggcagcgaagaaggaaacaaaauuuuuuuuuuaagaaagacaccuugcaaucuauguauuucuuguguauuucuuuuuuuccucuuuuuuuuuuuuuuuuuuuuuuuuuugagacagagucuugcuguugcccgggcuggagugcaguggugcaaucucagcucacugcagccuccgccuuucggguucaagcgauucuccugccucagccucccgaguagcugggacuauaggcacgcaccaccacaucuggcuaauuuuuguaucuuuaguugagacaggguuuuaccauguuggccaggcuggucucgaacuccugaccucaggugauccaccuaucucggccucccaaaguucugggauuauaggcaugauccccaguguauguauuucuuauucuauuuccuuuuaaucuaaguucuucucuuuuccuugaauuguaaagauuuaguucccauauucucaaaggaaagauaaugacuuauuuaguuacucugaauaugggugcauuccagaaaacaagggaaaauucuaguuagaaucaacuacauaauauuaaccaucacaagaaaaguacaggcaauuauuugccugaaggaauucaguaaucaaaggaauuagaaauuaaaauaacuagcuuaauguuuaaaaaaaaucacaguaaaccugaauuuguaaaacacguuuuuaaguauaaaaacuuucagugaccaacuacuuuccuacccugggggcuggcaaguaaagacacaguaagauccaauuucucucuggcuuagagguugcuauucauguucaacuuugcacaccagcaaaggagguuagaaccaaauacaaauuuuuuuauaagguugccaaccucuaagagguuugcuuuaaugugcuccaaaaggucagugaauuugaaaauaaggaagucccuggugacuuuugagagaagaguuuugguggagaagugggaagagaaggcagacuacaacagagaacgaggacaggggcgacacaccaugaacuugacaggaaaguaacaccugcaaagaaacaggacaauuacuagaaaaggccacagaugcuaacaaaaacuucuucuuuucuuuccugaaacguggagacacugcacaagguaagaguauuucaauaaugggaaugaaagccagguagaaaucuagggacaguaggagaacgauagugcuauuaacagcaacagggaaacuggaaagguagauggguauagaccacaacagaguuaacacuaauuuugaaggugagcaucuucaguccacgguuuuggggaaaaucagagacaacuaaagaguuaaaauuugcccuggaaugugguccuuauacuucagggugauaagaaucuccugagguauuuguuuaaaauacaguggcccuccccacugggauucugauucaguagguagagggcagguccuugaauguacauuuuaagaaagaaggagcggcagggugcaguggcucacgccuggaaucccagcacuuugggaggccgagacaggcagaucacuugaggacaggaguuugagaccagccuggccaagauggugaaaccccaucucuacuaagaauacaaaaauuagcgggcuugauggcgggcaccuguagccccagcuacuugggaggcucaggcacgaggaucacuggaacccagaaggcggagguugcagugagccuagauggcaccauugcacuccagccugggcgacagagcaagauucugccuccaagaaaaaaaugaaagaaagaaggagggacagaaggaaggaaggaagaaaggcaguugcaauuuuguuaggacucccuuaauucuaagguauuguguuauagguaguaaugggccauaauuugagaccagccuagagcagugcuucccgaacuuuaaugugcacaggaaucuucugcagacauugcuagaagacagauccugaugcagcagcucuggggugagauuggagauccugccucuuuuguuuuguuuugguuuugguuuuguuuugagacagcaucucacucuguuacccaggcuggaguagugugaucauagcucaccacagccucuaucuccugggcucaagcaauccuccagccucagccuccugaauagcugagauuccaggcacaggccaccgugcccagcuaauuuuuguuuguuuguuuguuuguuuuuagcucaagugauccuccugccucggccucccagagaacugggauuacaggugugagccacugcacccagcugcaagccugcauuucuaacaagcucccugauguugccaggcugcuggucugcaaguccagggaccauacuuggaguagcaagcccccagggaaggacagacuuuaauaagaagaggauccccuaugaaaauuccaacuugagcuccuauguucauucagacauucauacaaauaccaacugugggccaaacacugaagauuuccagguaaauaccacucaaccuaggggauaaacguguccacaggcaucagauaagacagggaaaauaguguaauggugcuggcgugggaguccuuccucaaaugcuuccuguuaaugcacaaagguaauuagaaggacuagcaggggccaugcuuugaucugcuaaaucccaagcugcauccuucaacagaagaaaccaccauuguagagagaugcugaagucucucugggguaggaacucuugcugaggaggucucacagagaagacauuugauuuagaucagagaggaugguuccacaaggaaaaggagauguucuagaagggaacagcauaugcaaaaacguggguugugagaggauuccguaugcacggccgugaagcaguaggucagguagggcguccaagcuaagaagcuggcauuuaucagucaaauggaaguguccaaaggaagcagcagggacaacuuuaaaacggaagcguggggacagauguguuguaggaagauagucagcagcagugcagggcagggauuuguagagugaugaaaaacaucucuagauaagggcaggugggguaagaguacucaugaaauggucaauacccacaagaaagcaauuaacuaggaugaaggaggaaggcuagguggggagacaucucuggguagaaauaacaggguuuaguggugacagaccaguggggaaaaaucacuuagggcagacaucaccagaugccuagaccccacugagaaaacaauugauccagucaagcaaaucucuguacacaacaacaccucacccuccaauuaccauccaccuuaugaacgucacaguuggguagcucugaguagaccaaacucuaaugaguuucaauaucugauaauuacaauggagaaggguaauucaagccaaucucuagaaucaaugauuuccugaaguucuaaagacauaaaauugccuuacuuuaaaauaagacucaauacaaaccccaggccaucccuaaccaaguuucuucucuguaauggaacagaagagacaucucaagacacagguguuauuuuccgccaaagaggcccgaagcauaggcacucaccgcuccagaccagccacagccagguuccuagaagguccacuaaacaggaugaucaacuacacccaguuugcucuggauguuucuggguuuaaaacugaaaggccaggacaggagcuguggcucacgccuguaaucccagcacuuugggaggccgaugcgggcggaucuacugaggucaggaguucgagaccagccuggccaacauggugaaaccacaucucuauuaaaaauacaaaaauuagccagguguuguggcacgcgccuguaaucccagcuacucgagaggcugaggcaggagaauugcuugaacccgggagguggaguuugcagugagccaagaucgcgccauugcacuccagccugggcaacgagagcaaaacucugucuuaaaaaaaaaaaaaaaaaaaaaaaaaacugaaaguccaggaacccacucagucccaggcauaucugcaggguuggucaugcuauaacuaaacaaaucaguuuuuagaacuuaagcuccaaaaaaugauuuuugcauuuuuacaggguuaagggcggagggaaaaagaacaaacaagaauaugcagagaccauauguggcccacaacaccucaaauacucaccaucucacuguuuguagaaaaaguuugcuaaucccuaguuuacaccaaccauaaugccccgccuuugacaggacagguuugagaaugaaaaagugacacagcuuugggcuccagguucgaaaccuaagagaaagucggcugggagcuccugaaaagauuuccuuccugauuaaaaauaaugagacucaggggagaaauacuguccucucuuccugccuuucgagguugucauauuacaucaugauauuuagagcuacaguagcccuccugugaccagaaagaaaaagucagguaaucaggaauugcagggauaccaucccucaccagggcauggcuaaacuacugaauuaaucagcccuggaacaguauaaauccaguuaucuucauaaaggguguaauaaaucccuauuguugcaaccacuuuuguuggguguuuguuuacaugcaguggacagaauccuaaucucuuuccauuaucccucacuaaaugaagcaacucucauaucuccaauauaauggagcuugggaaguugcaauaggcauuaaaaauaguuugcuccuagcuggaaaauucuucagaacauuguacccuuaccuccccuccaccaaaaaaaaaaaaaaauaauaauaguaagaaugacucuccaacucuugcuuaggaaagaaagcacuaagucuuugaaauuuagccuauuaaaugcuugagcaauucagugucauaagauuagaccuucuauuuguaaaacgaaaagaacgauguuuguaagcaaaaugccauaagaucccuuuaaaauguuccuaccugcaaaauauuauuauacccauaucuauaucuucaaaugaauuuccacauauuuuuaucaaauaguccuugaauuuaccuuuugaauuguccuauguugccuuaauaacaaaaauuaccuuuagcuuagucaaauagguuaucucuaagaaauaucaucaguuaggcugggcaugguagcccacaccuguaaucccagcaguuuuggaggcagaggcggguggaucaugaggucagggguucaagaccagccuggucaacauagcgaaaccccaucucuacuaaaaaaaaaaaaauacaaaaauuagccgggcauggugaugcgugccuguagucccagcuacucaggaggcugaggcaggagcaucacuugaaccugggagguggagguugcagugagcccagauuguacuacugcacuccagccugggcaacagagcaagacuuggucucagaaaaagaaagaaagaaauaucaucauuuauguaugcacccaugauaauguuagaaggcuaugcccuccggacacagugagaacaucugcccugaucauuuucucugguaagacuggcuucuaggaguaauggcuuaaucacuggaaccuggaagcuuucacaaagcucaaaggcugucaccacacucacugauggaggaagcgcuucuggcuagaaauauagacaucagucaaaucccaauagcuuccugauauuucuuuuauugcuccuaccaaaccacaacaaagaguuuuugaccgugucacuaggaaauacguuuuucugaaaauagccuuuaaaaucugaaaacuccuauguuuguggcuauaacuggagggccauaaagguuaccuacauggguaaauuuccuucuuuauuccagcaucuaaagcaaauguucaggacuuuucuuucuucuuuaaauccaaggacgugauucucagccuuggcugcacauuggaaucccccgggaagcuuuaaaauauaaugaugccugggcuaucccuggaguucugauuaauuguuccaaacucagccugggcauugagaugucuaaaaguuucccagguaauuguaauuuacacccaaggugaauggcaaguagaagaaaauguaacuaagaacuauacccaagacaaaaauugcuaaauugcauuuacaaagggcuaaaagagaggacuagaaaagguuucuccuacuauucaagacuuccaaaaaagaauagaaaauuaucaaucaauaagcaauucaaauauauaugcauacauaugcauucuaaauuacuuaaaaggagagaggugagcaggagaaagaggccaaaauaaaggaaagaaaaugaauguguuugacccccuuaaucaucagucuuacagucgaaccuacaucuccauguccacaccuuccuuuaagugcagcaaaaucauuuuuucaaguacaccuaacagcaagcuacugcccaagggccaaaucuggcccaccaccucuuuugguaaauaaaguuuuauuggaaugcagcacuuggauucauuugccugucaucugccugccuucacagcagcagaguugccacagagacuguauggccugcaaaauuuuaaauauuuacuauguggccuuucacagaaaaaguuuucagaccacugcucuaguucuaucacguaguuugucauaccaggaauuaaugcaucucccuuuuauucuccucccacuagugccuaucccagaaaucugcacuccuguuccugccaaacuccugcucugcgucaucagguaauucccagcaaaaggcaaagugucuccaugagucacuucgucccaacgcuuaaaugguguuggcuucuuagcuaugacagggacaucacagagcaccugguugaggcugucacucuaugcaauaaccagcuuucggccaaaugaaagacagcaccaaagucaucaccaacugacuauaauugaauaugccaauguuaagacgcaaacaaagacauuuuauauuaugcuuugguacgaccuaaauccuuaucgcccuaaucaacuucugcuuuugccuaauuaaauuuaauugucaucaucugcuuugcuacuuugcuaaaaccuaaacaauccauuuuaaaauuauccccauaguucuacuauuucuuugcaaaauuuuuacuaugguagcaaaaaacagaggcuauuguaagagccccucaucugucuuauuauuugcuugcuuucaccuacaccuaucucuguguuuuuaaacagaaaugaaacuccacuuuaaucuucuggaaggaagacagugggaaagacaugugaaucuacuguuaucuagauuucuugaaauuuuccuaugaggcagguagggcuuuaaaaacaaugugauacgcauuugcuuacaagaugaaaggucucuucucuauccaccuguaaauuauuaucuucccuuuagcuaucugguaaugaauuguggauucaauacucagacauccaaggcaggaacagagaagguaggcaucuuauacuuccuuucccuuacuccuaauaucauuagggcagaaugugucaaauucaguacuacugacauuuugagcuugcccauucuuauuguggggaugguccugggcaguaucaaauacucagcagcauccccggccuguacacacuagaugccaguaacacccucccccuaccccaguuaugaaaaccuaaacugcuuccagauguuguaaauguacccuagggguaaccucccacccuccguugagaagcacugcguuaggggaacuuguccauagacucuaccuacacucuuguugccgcauuccuacugccuccauccccaccgcugcuacuuuagcucaggccuucaucaucuucaacauggacuauuacaguacacucccaacagccuccuugccacccaccuccagggaucucauacauucuccagacugccagcggugugcagugcaugcuggagugcaccaccagaaucaccuucagccugaggcacucucuccucuaguugcugagccuucuccaggaacugcccucagggaaagagaaccacuucacuaugguuaugugccccucugcaggggcagccuguauccagucaugcucagcacagggguauaaaggccugaccucucugccucucuggauagggccacuccaccuccaaagcuucccugugggaccaggugaaucuguuacagcugguuccucauucaacuccuccuuugcccaaaccugcuuuguuagcguccccucaaaugcuggucccaagaacacuccccaguaaacuuccuguaugcaaaucuccccucuugggucucuuuccugaagggcaagaccaaaaacagagagcugucuuucuagauuacaaaccugaccauguuucuucccugccaaccuuuccacauucacuucucaucgccugcacugaagaguccuaaaauaauuuuuagagucgcaucaaggggucacaaucagugaucugcugcgaaagcagcucuuugguuugugggguggggagagaaggcccuaauguguagcauuugcugauuuccacggugcaaauauuuccaccacuguugaucuccagcuaccaccggcuugcaaccggcuugcaaaaugacuggcuauuuaauacccaguucccauaagccagacacaagccagcuugagcacaccacugauagccccugaccauucgcuauuguuaacucuaauuguuugccuucgcuucagccaugacaaauucuugcaaaucucagaccuccaggaugcgcugagguucugugcccuuauucacgcuguuuucucugucuagaguauguuuccuuucccugucugacucaugcaaaccuacucaaugcucuggauccagcucacauaaaaucucuuccauaaacauuuucaggauucaccuccacccaucccauuucacucaaaggugaagcagaacccuccuuuuugugugucugcaugugucauaaauacuuucuaucauagugcucuucuuauauuuuauuacauauuucuguuuacaaaacucuacugucuagacuguaacuacucugagggcagggucuuauuuauauuuuuaguaacuggcaaaaaguauacucaugagauguguuuaaugaauaaacuaaaaaaaaaaaaaaauuggccccacuuccuagcucaacuuuaucaugaaguacaagucuuaaaaaugucucaaggaaaagacauuccguugccccaaaugugaaucauaaguuugaccucccacguccuacuuccagauuguuucagagaggcaaagcauggaugaaggcugggacagggcaugaccucuaaggcuucaucccaaacccaagggucucuguaucaaggaaaaaagcacuuguggaaacaggagcaauuuuugcugguccaaggggagggugcaggugcaccaucugguuaccuccuggccaggcaacuuggagaccaaccuuuucggaugcuacugccucagacucagagucaagccgaguacuuuauugugauucauuuuuaaaucaaacuacaugaauucaugcagugccuacugcuuguaaaaugcuguaucuuuaaaauaagaauagaaaggccaggugugguggcuuaggccugcaaucccagcacuuuggcaggccgaggcagguggaucaccugaggucaggaguucaagaccagccuggccaacauggugaaacaccgucuguacuaaaauuauuaaaaaaaaaaaaaaaaaaaaaauuagccaggugugguagugcacaccuguagucccagcuacuuggaaggcugaugcaggagaaucacuugaaccugggaggcggagguugcagugagccaagaucgcgccacugcacuccagccugggugacagagugagacuccaucuugaaagaaagauaaagaaagaaagagagaaagagagaaagaggccgggcgcgguggcucacgccuguaaucccagcacuuugggaagccgaggcgggcggaucacgaggucaggagaucgagaccauccuggcuaacauggugaaaccccgucucuacuaaaaauacaaaaaauuagccgggcgagguggcgggcgccuguagucccagcuacucaggaggcugaggcaggagaauggcgugaaccccagggggcggagccugcagugagccgagaucgcgccacugcacucuagccugggcgacagcgagacuccgucucaaaaaaaaaaaaaaaaaaaaaaagagagagaaagaaagaaaaagaaagaaagaaagaaagaaagaaagaaauaaagaaagaaagaaagaaagaaagaaagacaaagaaagaaagacaaagaaagaaagaaaaaagaaagaaaggacaaccaacaccucagaggacucugaggaguaauaaucaucccugcuuuuaacucaaauauaccuccccacacaaaaaaacuucugcaaaacaaagaaaaauaacaguaaacucuuccacagcaccugcuugcuguauaccacuucuuuuuuaaagccuuuacauauauuaacuaucuauguauaguuuauguacuauauauuauauguaacauuuauaugauguauauuauauagcauauaauacuaguauuaacucuauguccuggauaccaguaucauccccauuuuacagauuaaaaaacagagauguuaaguaauuugccuaagacuacacagcuaguaaguggaagagcagggauuugaacccagguagccuggcuccaaaauccaugcccuucauaaugcuaaaagaaagagaaaaacgcuccuuuacagcuuuucuccacugucaucgaaagaucgguaguaucccuuucaaagacuguaacccgggagugccggccuuugcccuuaaccuuggcacgccacacauggcugaucaccugcaacagcuacacccagccagcccuacaccuacuaacaccuccguugucaaggaagccuuuauuuuuaacaacuucaguguguggaaaugccaugaaucccaaggacagaagaaaagagaggcgaaaaaggaaaggcaacuccaccuccggcaaugaagacaaaucccucugagcaaugcugcaaagcgccaggaugaguuaaagcagcaggaggacauccggccccgcaaacaaucaguucacugaccagggagaaggagccuucucauuaccuggggauggcuaaaagagugagccacagggggucaagaguggagauguggcugagaaaaaaaaaagcagaaagaaaauacaauggagaaugaaaagagcccuggccagggccggcugcaacugggagugaggccaaggcagugaugggcagacucggcagcaagcagcaagacagccaugggggaaccacagaccuccagcuucgggcugggaacagaaagguccgcaccuuagcaaccuuaacggacucuccaugcacugcagacaagcaaaaugacuguguuuccuaaauaaaaaguuagacuacauuuaagugacaagaaaaaaaagacagugauuuuuuagaaagaguccagugaaaaacagagucaaauuaggccucugcacucagaaaacuaaacuugaauuugaaaaaaaaaaaaaacaaaaacaaaaccauauuacaauauuucccuacagggcuagauaauugagccauugcuagugggguaagggguccuggggauauacauuagaaacaacaagacaaauuagggaaacgcuguaacaauauuuaggugagucugucaggguuuauugauagaagaggcauuuaaagaugccucccuguuucagucccaggcuaacgggcugacuucccuucaucucuaccccaagaacggcucaguccucuuucugcuguauuccagaugcagccucucaauuucggguugaaacagcccuguuugccaacugaccucaacagucuggcaguucugcacuccccuggacucagcccagucucuccuucagcaagucuccccagcacaggcuccccgcuaggaauaagcgucccucagcuccugcucacuccuaguacaccuucauuaacugucucuucccuggcccacuaaugcucacccuucugaaugccccaauggcccaaacuaagccauugcucuauuucuuucuuucuucaucuccuuccuccuccaaugccuuuuacucaacugccuuccaugcaaucaucaaauuccaauuccuagccgggcaugguggcucacgccuguaaucccagcacuuugggaggccaagaugggcacaucacuugaggucaggaguucaagaccagccuggucaacaugguaaaaccccgucuccacuaaaaauacaaaaauuagcgaggcaugguggcgggugccuguaauuccagcuacucgggaggcugaggcuggagaaucacuugaaccucggaggcagagguugcaguaaaccaagaucaugccacugcacuccaaucugggcgacagagcaagacuccaucucaaaaauauaaaaaugacauuaaaaaaauccaauucccaaaccuacuucuacaugaaacuguuuuguauguaagaaacaaagguuaggcugggcgugguggcucacaccuguaauuccaacacuuugggaggccgaggcggguggaccaccugaggucaggaguucgaaaccagccuggccaacauagugaaaccccgucucuauuaaaaauacaaaaaauuagccaggcguggugacgcaugccuguaaucccagcuacuagggaggcugaggcaggagaauugcuugaaccugggaggcggagguugcagugugcugagaucaugccauuguacuccagccugggcaacaagagugaaacuccgucucaaaaaaaaaaaaaaaaaagaaacagagguuauaauaaaauacaaaguuauauaaaucauccacaacaucaagugguccaaugaaugaccacuucagauaauugcauaauucaauaccuuuaaaaaaaaaaaaaaccuuauucuuaagucuagcaauuguguuuuccaguacccauucugcaauaagcucaaagcacagcaauuguaaaaggguggaggaggcguucgugcauguacuuuggcgucugugggggguacucaaaugauacccaaaaggcaggguaagcagaagcaaugagacugaguggcucuagagugccccugaucgaaguuggcaucccgacucugcaauuaacuacuucugugacuucagagaaaauuacuuaaccucccugaacuuugguuuccucaccugugaaaggaagaaacaacacauaccuaauagguuaguagugaaggagcaaugagcugauacacaugagagcucuggaauacaguaaauaucuaucaacauugguggagaaacugagguacagaaaauggcuuagcucagccaguccuacuucugauuuagccugaguaacaugauucuuaauccagcaauucaaucucuuaacauuuaguauagcuuaggcuuucugugugucacucaaaaagcuuguugacuaauguaaauccaggcuguauccuuguauuguguucccauucccuagcagaaugcuagaguucuguugcuuaauggaaaacugucaauuauuggcuugauucuugauauucuuaggccaaaugauagauccacccucccccauccuggugucuauuaaucaccagaagagacuacagcaauaaaaguaaauauaacgcuaagguagcagcugguaaaacaacaugcugcauacccaaaauaccuuuauugcaggguaaaaaauaagcacuucuuuucuugcuuaaaacccuuaacuccuuagguguauguguacccauuugauuucuuaugcaguguucaauacauauuuuaauaaauugaaguaaauuggaacuaaaccuaagauugaugcauuugaaacugaagcugauaguauaaauaucucaaaauaagaaaaagagaccugcacaagcuuuacuuuuccaagccagauuagagaaaugcaccauaucucucaucuaaauaacuauuaaugagaaauaaagguaguguguauguccugucaacccaauuauuacacauaaaucaggagcucuuuuaguauucuuaaugacgcaggcuuuagaaacaauucauuguuacccaaagagaauucuuauagggaaauacucaugguucagugagaagaauauuuaaaaaaaaaauggagagauucgguccuagccuuggguucaccaacugguagucauguaagcccaaaacacguuacuuccuuuaaauaugcagaaguuuucccaucuacaaaacaagaaaaauauguauucuucuuuguuaacuuuuuaauaugaaccaaacaacauuuauccaugauuugaucuuugauuucugaaaauuguucacaaaucaaggcagggcuguccacauuuacaauuucacuuuuguuaaaugaaccagaauuagcuuacugacagacagacuuagcuaaggcugagccagcccuuuugcuuuugaggucaggaaguaaucuaagacccaagaguuuucucuccacugcuuaacuucccugagucaaguuuccuuccucuaccucggaguugguaaaauuucuuucugaugaaaauguacuuuggggcuggugugguggcuuaugccuguaaucucagcacuuugggaggccgaggugggcagaucaccugaggucaggaguuugagaccagccuggccaccacggugaaaccccaucucuacugaaaauacaaaaauuagccgggccugguggugcacacuuguaaucucagcuacuugggaggcugaggcaggagaaucucuugaacccggguggcagagguugcugugagccaaaaucgugccaccgcacuccagccugggcaacaagagugagucuucaucucaaaaaauaaaaauaaaaauaaaagaaaaugugcuuuggauuuccaguaagucuccaguaaaugaaaguuaguggcauguaugcaacagccaacuuggagaguucaguggacguuugucaugcauuugccaucuucauucccuuuuauguuuggugacucuuccaccucuugaggcagagucugcuaucccuuauagaagcuuaaagugcuggauacucaucucccagcauucauugcagcuaaagugugggcccugggcaaccacugaaaccucagaaucaguccccagugaugcagacauggagagacugcaaaggauccauuuugggacuugacaaugauagcagcagcuccauccgguuggggaggcuuuauuggcagcaguuuggugaacuggugguagcuguguuauauugcaccagaccccuuccuucgauauguuucggggcuucacuccagcuggauugcuucugauucuaguucucuggcccuguggagugagcuacaccaaauucuuuugauggauucuuuuucuugccaaaauugguaagaauucguuucuuuuaacaaaaaacucauugacccagaaaucauccucaaggccaagaaaucaaccaggaccagcagaguacccugcucuauccuaaaaccucccagugaggugccacuaaaccuccugacuccauucaaccuuuccauucacaauauauaucacacagugaaccacagggaugaaaggggggaaucccaaaaguaaccaaauuguaguucaaugguacagaaagacaaaccuaggagauuagaucaucuaaaauauuuuaggaccaacccuacucagaccuuuuauauggaagcagaaugggauguuagaagaagagcauggacuuuuuagugaaauaaucuuuaaaaaucuaguuuuggucauucccuucaucaucucuuguccuucaauauccuaaggacaauacacccagacacaucccaguuguagcaacaaacugauaccccacacaggacauguuuaugccuccuuugcuuuucccaggccuaucacugugacuaaaaugcauuccucuuucuggagaacucuuauccuucaaaauacagcucaacaaccccuuccuuugugaaucuuucuuaauuccaccucucccccuaccaacuuaucacuacuuucucugcauuaucggaaucucuacuguggccacugugcuucccucgguuuugagagugucagucaaccccuuuacccuaaaccccagugaugagcucccaagacaagugaaagucuuacuagggcaaggauuaggguaagacaaguguggcaccuagggcacaaacuucaugcaaguacauaaaacugguccuuacccaucuuucuuucuucaguaacuaccucagagaacuacuguagaauaaccgcucagauuuuuaucaacugaauggucaauaauauaacaaaguguauaggauucagagaauauuuuauaugacguagagagggcagggucuaacacuaccacaaacaggucggauaaccuuccugaagcuuguaaccuggccaaaugggaagaacuacacagccuccauggcgccuuacacugccauggucuauugcuugguuacuccaaguucaaaggaaguucacagaggaagagaucaggacagaagggaacagccacagaagacuccagcacuugugcugaggccugacaaaugcauggaugggauuugaaggggaaggaggggaaauggacauucuaagaauaaacauaagguaugagagagguacaauaaauucaagguaaauaaagauaagaggcugacuagaggaaagaaugcauguuugggugugaaaaacaagcugaauauaaacuggauggucugggugggaagagacaauaaaacaccuuggaaaaucaagcaggaaaauucugggguuugggacugagcaauaggauggaaaauacuguuuuauauuaauagaagaccaagagcuauaauuauugaaucucuauuagaugccagauauguuuagguauuacauauaaauaaacuuauugcauccuugaaucaaaccucugcaguugcuauuaucaucauccccacuuuacagauggggaaacugagauuacugaaguuaagucaaguauucaagguuacacagcuuacaauuggcagaaccagauuuaacuugugcuuuuugcccuaaauacacaccuuagguaaugcauguugaaagacaaagggacaaagggaacuagguuugucuuucuguaccauugaacugcaauuuaguuacuuuuggauuucccccuuccaucccugugguucacugugugauauauauugugaaugaaaagaaagaaaccagaugauuuaauguccacaggcuuaugaaaacaaugcuauuauggacagagguugggaaauugagaaggaaacaaaauugggauaaagaaagcaaaacaacugcauuuuuuugugauaguuaucaaguaugaagugguggcagaugaagucagaagugucuuucaaggagggagaccaucaggauuaaggauccaaggagaggcaagaucuagggagcaagaucuggaaguugccaucaugagagguaaaauccagaggucuggaaacagugaagugcucuuagagcaacagcauaccucaagagaaaagccacucugggaagcguccacauuuggaagguaaaagaugaagaaggagucgagguaacagaaggaauaaucaaacuaacaggaaaguaagaauagcacuguguuuauaaaaagguaacuaaauggauuuucaauaaguacagauagcacaaaucaaagaaaauguccagaagaaaguuacuuccucuccccacagggagagugucagauaagaccuaguaaaaaaucaagaccucuaccacuguucagugguagcaaaaccacccucucuacagcaucaguggaggccagauggggaguagaaaccaagugccuuucucccucccagccagagaacugucaguggaggccuaggaggaagccugaagcacccccaccuaucaguaacagggagucccuucucuccaggugccaacagaggccccguggagaaucuagaugucuacacccaccuggcaguaaggaggcagcacccccuuucagccaccagguuagugucagaggagaucuucuaaaucauaagguuuagguaagaaucauaagaauuaaguaagaaucggauaucacaaaauguccagauuucaaucaaaagucacuugucauaccaagaaauaggaacaucucaaacugaauaagaaaaacaaucaauauugaaacgacacagaagugagaauuuccugacaagaauuuuaaggcagccaucaacgagcauuugaauaugccugaaacaaaugacaagaggacaucucagcaaagaaaucgcauauacaaagaagaaccaaauggaaaauuuagaacuagaaaaauacaacaaccaaaauucaaaaacucaauggauggucucaagagcagaauggaagauacaaagcagagaaucaauaaauuugaagacauagcaauagaaauuacccaauuugaaaaauagagagaaaauagaccugaaaaaaaaucuucagggacauaugaaacuauaacaacagauauaacauuugaaaucucaaaagaagaagagaaagaauuugaggcugaaaaguauucaaagacauacaaucuucauugguuaauugagggacuaaaaaacaaacaaacaaaaauacagucacaccccacaucaugacauuucuguccuacauacacaaggguggccccauaaaaguauaaugccauauguuuacuauaccuauagucacauaacacacgaauguaauggcugacauuugagaaagguauauauuaucugcacacacacauacacacacacacacauauauacacacucacgcaugugccccuauggauucaugcugugcaaacuccaaauaguuuaaacucaaagaaauuuaaugaaaacauaucauaguaaccagaaaacuaaagaaaacaaucuugaaaguagccagaaagaaacagugcauuauguaucaagagaaaauaaguugaguaacaauagauuucuaaucagaaacaauggaggcuagaaggauucagcacauuuuucaugugaaaaaaaaaaaacaaaacaaaaccugucaacccagaauucuauauccagagaaaauacccuucagaaaugaaggaaaaaucaagaaauuuucagaugaagaacaacucugagaauuuuucaccagcagaucuacuguuuuuuuaaaaaaaauggcuaaaagaaguucucuaaagugaaaagaaaugauaaaagaagucacaggugagcugugaaagcaauguuaguauuaaagagaaaguaaguaucacacuaugagaugcagaacagaaugggugguauugaaaaggaagaagccagaggggaccacuguaagucacaagaggagaugaguuauauugggugaggcugggguagggauagggaaguaaggcauacugauuggaaaguacagaggguucaagucuaggccaggcgugguggcuuaugcuuuuaaucccagcauuuugugaggccaaggcaggcagaucaccuaaggucaggaguuccagaccagccuggcuaacacagugaaacccugucucuacuaaaaacacaaaaauuagccagguguggugguaggugccuguaaucucagcuacucuggaggcugaggcaguagaaucacuugaacccaggagguggaaguugcagugagccgagaucaugccacugcacuccagcaugggugacagagcaagacuucaucucaaaaaaaaagaaaguacagaggguucaagucucuauucagauucuuuccaacuauaugcccuuggauaauuucuuacccuuuccaaggcuugguuucccccuuuuuaaugguaauaauaguagcaacuucguaaaacuauuaugaaauuuaaaugagacaacacuuauacaguauuuagcacagugucuggugugugaauguaauggcucaagaaaugcuauuccuauucuuagcagcuaaaguagcuauuuuagcuagaagacgagcuggccuaagggaauguuguucucaggaggcaaacuuaauaccaaaagaaaugauuagaaaaagaagggaagaaaucaagagggcauacacagaagaacaggguggagugugguguggaggagauggcuuuuggugcacagagagcaaagauaacaucagacaagagaaguaaagucccuuugaucagaaagacguguucaaacucuggcaccacaacuuacuaauugacacaaccuagaaaagcaauuugaccuccucaaccuucaacucccucaccccagaaauggaaauaauaagccugaccuuacauuuaucaucucugaaccuucuucacaacucuguagaaugcuagaaaucucaggcaucuaauaaaugguaauauuguuauuucucagaauagaggaaaucgagaauugaugaaaggacacauacagagagagagaugggaagucagcauauggauguaugacuggagaugaggcaucuauuuuagauagacucaaucuuuuuaagaaaagaggcaaacucaacuguugagaaugagagagggcagggagagauggagaccucauaggaaaacagaagauguaagcaauuuucucugcaauucucagaacauuuaaguugaaagggaccugaggaaugacuuaauucuuucucugccuccauuuuaugaaugauaaccagcaaauauguucuuuaaagggccagauaguaaauauuuagagcuuuugaaccaaagaguuucugugccaauaacucaacucuaucauugcaguacaaacacagagcuaugcaaguagggcuguguuccaauaaaacuuuauuuauagacacugaaacuuaaacuccauguaauuuucagguucauaaaauauucuuuugacucguguaaagcauuuuaaaauguaccagcugggcgcgguggcucaugccugcaaucccagcacuuugggaggcuaagguggaaagaccucuugagccgaggaguucaauaucagccugggcagcauaguaagaccccauuucuacaaaaauaaaauaaaauaaaaauuaguccagugugguggugcaccuguagucccagcuacuugggaggcugaggugguaggauggcuugagccugggaggccaagugagccaagauggugccacugcauuacagccugggugacagagcaaaaccacaucuuaaaaagaaaaaaaauaaaaguaucaacaauuuuagcucagaggauguacaaaaaaaugcagagauucauaguuugccagcuccuaccauauagugauuaugagcucaggcuaaagagagucagauaugaguuugaaucucucccucacaauucacugaaaguaaaacuucagcuauuguauuuagucuucuaugacuuccauauaauuuuuugugaagaauuaaaugagauaaugcauguaaaugagcuuagcagaaggccugauagaaagccaaacccaagguaaccaaaacaacaagcagaaacauuggacccauggaaaugcaggcaacccaauuaguuacaucuaaaccagaaucaaaaccuguguguccaucuacucaaugcaaugcuuuuuccagucccauagcuauugguagacuuagcuuuacaacaagucagccauucauguggcaccagaaagucuccugucccccucggaaagguuuccucaucccugagauuccaccacaggagcaacacacauuccccuggaugaguucucaacucacuuucuauuagcuacacuuacguguaauuuauuggcuacuuuuucagcggcucuccagauacuagguuuucauaggaaauauaaagagaagaaugugguaaagcaaugcaacagaauuauuauucagcuauaaaagggaugaaccacugauacaugcuacaacauggaugaaccuugaagacuuuuugccaaguggcagaagucacacacaaaaggccauacauuguauaauuccauuuauaggaauaucuagaauaggugaauccaaagaggcagaaaguagauuagcggcuuccagggacugcaggaagaaggguugaagagcaacaccuuaauaaguacagggcuuccuucugugaugaugauaguguuuuggaauuagauaguggugaugauugcacaaccuugugaauaaacaaaaggccacugaauuguauacucuaaaaucauuaaaauggugaauuuugcauuauguguguuuaaccacaauaaaaauauauacauauacaguuggcccuugaacaucagggguuugaaccacacaaguccacuuauauguggauuuuuuuucaauaaaaguuucaccaaaugugucugccucuccugccuuccucuccaccccugccaccccaagacagcaaaaccaaccccucuucuuccuccuccuccuuagccuacucaaugugaagacgaugaggaugaaaaccuuuaugaugauccauuuccgcuuaguaaauauauuuucucuuccugaugauuuucuuaauaucauuuucuuugcucuagcuuagguuauuguaauaacauaguauauaauacacauaacauacaaaauauauguuaaucaauuguguauguuauugguaaggcuucuggucaacaguaggcuauugacacuuaaguuuuaggggagccaaaaguuauauacaggcaggcacgguggcucacgccuguaaucccagcacuuugggaggccaaggcgggaggaucgccugaggucagaaguuugagaccagccuggccuacauggugaaaccccgucucuacuaaaaauaaaaauaaauuagccgggccugguggcagcaaccuguagucccagcuacuugggaggcugaggcaggagaaucacuugaaccugggagauggagguuguagugaaccgagaucauaccauuguacuccagcagccugggugacagagugagacagugucuaaaaaaauaaauaaauaaaagaaaagaaaagaaaaaaagaagaaagagagagagaaaaaaauuauaugcaaaguuucagcugcaugggggggucagugucccuaauccuuacauuguucagggucaacuauauagaggacacaugaggauucugcaggugugacaagauauucuccuaugagaagaaggaagaggaaagacuagaaaagggaggaugaauuuagcaaaaaccaacuuaguccacuuuauaaguuugcauaaggcucgcccuggauacugauaaaaauaauuuauuuauucuaaagguacuuguugaccaccuacuacgugccaggcaccgagccugaaucugaggauaaaacauuguaaacaagauagaaaauucuuaaaauucuuaaaauucuuuccaagguuuaaauaaccaaagcacaaacucccauauagguauuuuuguaaaacuauauaaaaaauauuuacuguacaaucacuauuauaaaacaaaaauaauuauaguauuuuuuuuaucaauuuucauuuaacccuaccuauuagcauauccagcagugagcgaaaggaaguaaaaguucuuuggaucaaguaaaucaaagggcugugcucuuggagggugagggauuaggauagcagaagcuccaggaaaaggauggaauuuagaugagaucuguuaauuuacaaacuuguuaucuuuccaaagcuaaaucucuacagaggacagagaagugugacagcuguucacuucuuuuaaaguguuguuugcagucuaacaaucuaaugcuggcagcacauuuguuuuuuuuuuuuuuauuuuaaaucgauuccaaaugauuggaacauauuugaaauuauuguuuuuucggcugggcacaguggcucacgccuguaaucccagcacuuugggaggccacagagggcagaucacccgaagucaaaaguucgagaccagccuagccaacauggcgaaaccccaucucuacuaaaaauauaaaaauuagccaggcaugguggcgggugccuauaaucccagcuacucaggaggcuuaggcgggagaaucacuugaaccugguggagguugcagugagccgagaucacgccacugcacuccagccugggcgacagagcaagacucugucuaaaaaagaaaagaaaauuuuuuuuuuaacuuuuacuaacaucagaucuaaaccaacucacaaagccaaugcuguucuuuccuugaaaacuucacaaccuuucuuaauuuuacauucuaccauuuacaacucuuucuuuucuuuuuuuuuuuuuuuuugagacaggaucucacucugucacccaggcaggagugcaauggcacgaucucggcucaaaaccaccuccaccuccggguucaagcaauucucccgccucagccucucgaguagcugggacuacaggcaugugccaccacaccuggcuaauuuuuguauuuuuaguagagacgggguuucaccauauuggccagguuggucucgaaauccugaccucaugauccgccugccucagacucccaaagugcugggauuacaggcugagccacggcgccuggccgcauuuacaauucuuauucaaaggccauucuuccucuaucuccauuguuuaucuuuuauuccuagcagagugaaaauggaaaaaugcauuuuggaaaacaaacaugggucaguuuuauauauaaauucagguuacuauuagaauaugguuuaagucauuuauuuuuucaagcuucaaccaaaaacaaaagcauggaugauauccuugagcccaacuggagugcaggaaagguaaaauguuugaguuauuucaucugcuagcauucaccugucuuaauuuuacacuuuugcuuuuguacccuaucucuguauucacauuuuuugggcuuaauggauuuucuuaaucaaauuagguaauucuuuaaauaauaguauguagugaccguccaguuacagacaaaaaaacugaggcccaaggcgguuagaggauguggaggagaucacagaucuuguuaaaaauauagauaacuaauuuuuuucucugauuuguugcuaaguuuguugcuaagaacuaugcaaggcuguggauacagacuuuggaaauuucaagauuaaaaaaaagaaaguggaaaaauaaaaaauaaugugaacugcuuaugaaauuuggaagagcccauguuagguguggcuuugcauuuuaucauaaccuuggugcauuuuccugcacuuuuguaagacucuggaacccuggagcacucuccuguuucagagauuaagacugacuuccaaaggcccagaagcuccagcucuagaacacagaggcugaguuuucuguucuguaaaaccuccagaguggcaggcacucaaaugugagugagcagcacucacaugaccucauggaagaggccaauggggagagccagcaagcucccucguucuuggcaggcaggaauguuaaguuacaaaaagcagagggggagacaugucguaugaaugaaaaccguauaaucagaccucaaggcaugcccuguugaacagaggcaagugcaaguuggagaaaugccaacaaaaugucauuaugaguugagucaucaaaugguaguuaaagaaaacuacauucaguacuaaucaacccaugcaaacucucuucucuguaaagguugguaucuuuuagggguagauuugccagaggaaagcucuucaaagccaauuuggcuauccauuccauucugagcucagaauauuaacaaaaaccuguugcuaagggacauagaugcauaguugagucuaaaauacaaaaugaugcuaaucuagcugcuggaagaaacccucucucggcagcacuucauaguauauugaagucaagcaaucaaugccuccucaacugcaaggccuucuguacccuggcuccugucuauuucuccuaucucaucucucacgggucugcuaggugaccccuacaucccaaccauacagaacuuuagaauuuucuagauacucgugucauuucacuugccccacagaccaaagcuguaucugcuuugacuguccacucccaauccuugauucucccauucaccuuucaagauccaagcaguuaauaaucacuuucccuuugagguaucauuacaucacaaacauuggcagagacaucugucccccauuagaaugugaguuucuagaaaguaggaaucaucucucuuuacacucuccaugccuagcagugaaccacacagugaagcagcuaauacauguccaaggaauuaauaaauagaggaauggcuacaugcacgauugaacagacccacucaaucagcagaugaccgacugaauaaacagagguccugauuuccaccaugccugguguucuuguuuguuuuauaucuuuaagccucagcaguuaguuucugucuuuauaggaagacuauaagggcuccccagagagucaaagucugacuuagcuucaagaugcacugagauccuaacaagagcccaggcaugaguuuuacaagaucuguguuccacacuuggcuuaccgcuaccuuggccuuuccaguuacauaaucucucucggucauaauugcugcaucuauaaaaugaggugguugggcuagcugauuuccaaagucccugcuauguguaauauuccaugauucugaagucuugucuuuagauuuugccugauaucucuugcccugacucuuuguaccacauaucauugggcaacugucacaucauuggacaauuaagcuuguacuugucacuuaaccauuagagagcaucaaugugccuuuucugguucucuugguucaagagcauugccucaguuuguucaccagaggguauuguagcccuuuuuacuguuccaguggucuuguuauaaaaguaaucagcaacagaacaaaucauaguguauauggucugagucucuuccccucacaaagaauauaagcaaauccaaggagaugcaucuguaauaaccaagauccuuuuuuuuuuuuuuuuuaauuuuagguuccaggauacaugugcagaacgugcagguuuguuacauagguaaacgugugcaauggugguuugcugcacccaucaacccaucaccuagguauuaagccccacaugcauuagcuauuuguccugaugcucucccucccccaccccucccgauaggccccgauguguguuuuuccucucccuguguccaugcguucucauuguucagcucccacuuauaagugagaacaugugguguuugguuuucuguuucuguguuaguuugcugaggaugaugguuuccggcuucauucaugucccugcaaaggacaugaucucauuccuuuuuauggcugcauaguuauuccaugguguauaugugccacauuuucuuuauccagucuaucauugaugggcauuuggguugguuccaagucuuugcuauugugaauagugcugcaauaaacacacuugugcauguaucuucauaauagagugauuuauauuccuuuggguauauacccaguaaugggaaugcuggguuaaaugauauaucuggaguaaaaaucaaguucuucaugaucaauaguauguaaccuuaugcagaguuuguauuaaaagaaugauguaaaaugccacaugucacaacacuacaaagcuucauuuaaauaucagucuaaccagccauauucguuccuuucauuugcuuaaugcauuuccuuucagucugcguaugacaucagccauuugacuguuccuucugugaccccuacccagauaagcuggaucuacagcaccuccaaguggguagugagccaugggguuaaugccucauaugcacaggggugaacaccugacucagauccagccaauccggcagccacuccucaucacauuaucccauuuuucucuuuuuuucugaaagacagagaaugucaucucagaccagaaaguuuagccaaaauaugguggguacuggaacaacuacacaucauauagaugcaagaaagucacagaaggugagucuuuuaaacuaugugcauguugauugaugagugagcaaaaagccugguccacaagaaaagcagaaagcagagaagacccucagagaaaagccgaaugagggacccugcaaagggaggggauagaccagauaaagaaagagggagggagucagagaaugccuuacuuagcuccuaccaggccuagcuauaccuccugcaacuggacuccaugaaauucuccuuaacgcagacucuuacuuaagguaaaacaaaauacacauaaauacacaaacacaugcacuuauuuguaaucauaguccagauauauuuauauccacuccuccugggucacaggcaucuuuccauuaaugguacugccaucuccucacaaccuauuacaucaagugaguauuugauaacuuaagcuauccccuuacuauuauaauuauuauauauaauuauaagacauaauuauaugcauaauauacaauauaguauaauuguauauuauacaauaaggguguuucuauuuuucacuguuuggacacagcagugguauagaaaagaagcaugaacuuuaguguuuaaauaaacuagauucaaaucccagcucugcacccauuaacgguauaaucugagacaaguuaugcaccaaaguugcaacuuccuccuuuguaaaaagaagauaaauauugccuacugcccagguuuugagaaggauuagaccuaauuagcaaagugcuuaucacaaagacucgcacacaguaagcacucaauaaucacuuuuauagacuagauucucauaaauaaaaaugcuggaucaaaggguacgaaaauuguccagguucuugauacgggccaaaugcuuucccaaagacugagugagucgcucuacaucccccugauacauuguuagaauagaguagcaguauaacccuuccucuagcacuugcguuucuucuauccagcuuugccuugaauguagaaguccagagcucaggguugcuuguucacauuagacugcgugcucccucuaaccugacagagaaaaccaguagcugguuucugucuuaaacgaaguggcuugacaguccagcugauucacugcuuccuguuuuccucugacuccauuggucccacuuagagagcuguguacagguacucagcauggaagauaaguccgggcuuguuugaaacaagccccaaacuaguuucuguugcucuuuuucuguguguccuucuacacccuaccuacucaggcuucuuaugagugcaucuucacauaauagcuagaugaacaaagauugcugcugaagcugaaagaaucagagauguauaaucauuucuuucaggcagaacuaauauggaauaaaagcucacaugauugccuggauucugcagcauaguuucuugaaucucuucaaucucugauuccugguuuccaauuggcuucucuauuuuauucuuucuuuuuuuuucucuuuuugacagagucuugcucuuucacccaggcuggagugcaguggcacgaucuuggcucacugcaaccuccaccucccagguucaagcgauucucaugccucagccucccgaguagcugagauuacaggcaugugccaccacgccuggcuaauuuacuuuuuuaauauguuuguaguagagacgggguuccaccaugguggacaggcuggucucgaacuccugaccucaagugacucacccaccucagccucccaaagugcugggauuacaggcaugagccacugugcccggccuauuuuauuauuucuuucuuccccuuccacauugacucaucuaauucuugacuuucugcugagccucugcugcucaccuguucuuuuguuauucggaucaccugucccacgacuaucccucuaccuagcuccaagggaugcccaggccccacaccccagcuucaccuuccugugacuuucucuggguugcccaccuggcccccacacuugaagccugcugccaucaacaccccagcaggauaaucugauggaugauggacaucagcucucagcuggaaaaguuccuuuccacugaccugacccccaaccaccucacacaacaugccuaacaauuucuuuccuuagugcccuuucuuacugaaacagcuucugauauuuuacucauaauuuuauacuaaagguacccagaucacauaaagaaaauaaagcugcauauuagcucuaggaaauauacacauaguugaaaagaccuuuguuaauaaucaauauugcaagagcuugguaacacaugaauacuuuuuuuuuuaagacuuacaggccuuaucuaaaaaucagcuuugccauggcuugguucuuacucucucucucucacucuccuuuuagaggcaaggucuuacccuguugcccaggcuggagugcaguggaaugaucacugcaaacuugaacuccugggcccaagugauccucccaccuuagccucccaagcaucuagggcuauaggcaugcaccaccaugcccggcuaauuuuuuuuuuuuuuuuucacuuuuuguagagacagagucucacuauguugcccaggcuggucucaaaacuccuagccucaagugauccuucugucucagccuccagccugacugggguuuacaggcaugagccaccagcccagcccacucucucccucugaaacuuugucccaguaggacuaggaccauuuguuacaaugggaaggaugauccuuucucccaaccaccaaguccugucccuguaucuguacaucaaagcugccugugacaaccacagggaguguuguguaggucucauuaccacuaaacacaaauucaguuuugggaaucaauacaacaacguguguguguguguguguguguguguguucucuaauuuaacacaccccaguuuagaaccauccagucugucauuaacaauuaaaaaaaaaaaaaacaaaaacaaaaacagaagaaagggcagguagucuguccguucaaggaccagaugggaagucucuuguuuuacuuccuuauucuccugagaaccacacugcaaguucugcuauaccaacuuaagguccuuccucuaccaacagacuccugaucuucccaggcugaguuaugcacccaccuucuuugguauccuacucguaucuuauaccagaacuuacgugcauuucacacagaguaucauuaguuugcugaccauguuugccugccauguuauggguugaacuauguccuccuaaaauuaauauacugaaguccuaacccucagcuaacccucagcaucucugaaugggaucuuacuugaugacagaugaugucauacuggaguagggcgggcccuaacuuuaauaugacuggcuuccuuauaaaaaggggaaauuuggauacagacacagacaggcagaaugccaugugaacaugaaggcaaagucugggcuaugaguauacaggggaagaaaugcagagauugccagcaaacaccagaagccagggaagaagcacaaaacagauuuuuccuuauggccuucagaaggagccagcccugccgccaacuugaucuuggaccucuggccuccagaacugcgagacaauuaauuuccgugguuuaagccacccaauuugugguacuuuguuacaguagcucuagcaaacauagacaucccacuagaauaugagcuucuugaggguaguaagaggauucuguucauuuuuguaucagucuagcacagagugagguacagauaauuuauuugguuguucuauaaugcuuguuaaaugcaauccagagacagcuaguccucuaccugccaugucuugcucaacacugacuagcuauccuguccuuagauaggguuacaucaaaaagaaagaaugaaacucgggauggaaaacaauuauuccagacugaauauaucaaaauuucucaaucccauucuuaaaccaauuucagaauuaaaucugcauuguuuuccucuacuuuccuuacaaaaauagaggcucauucaggaacaaagucccaagcaagaagacuuugcaggccacuugaaugagaugauauggcugacaggucuucuaccuggcugggucauauguuaucuuuaaccacacagcaaagugaggccaaaacugcccuguggcuuacaugaaucugaggaggggugacucaauucaccuccuucacacuguacugacucuguuuaaauggaguuauugagggaaagaaggugauuaaaugcuagguucacagagaaacagcccacugugagccccagagcuauacgucacucuguuuuugaaaccaaaauaauaaaagaaaaaauguauuuaaucuauuaauuguauuaaauauuuuaucuuuuauccuguauuuuuaucuuccuuuuuauuuuuauauguuuaucuuuuuaucucuuagaacuguauuuuucugaaauuaaaaauagaaaauaaauuaugaacucccuugcuaauauccaguaucaugcuugagaaagucaauuugguaauacgaagaacuuuccagaacacuauuuuacuugagguaaauaaaaugagaauucaaaaguacauugaacagguuuccuucucuuacacugauuucagaugauucgagaaaaacaaaaagaaauggaaaaggcagguuggcauguuagcagguuauaaaaaaugaaaauuacagccguggccaagcucuggaaaauauucccugacccagcuagacguugauuauugaaccaacagcuugcuuauauaauuacagugugucuauaaaccugguugauaugauauacuuguuuaacuauuaaccucuagauuuccuggaguuuccacaauccaaaaaacaccuaaaaguaugagauaugauauauuccauuuauucaccuauugcaaucacaagcaauagcuacaguauuaaucuugguaagaaaaaggaaguucuuagaaaacacaaguaaggucucuuaagcuucagauacuuugcuggggcauuuucuuuucuuuuuuuuuuuuuaaauccuucuaaagaauugcucuauuuuauuguucuauugugccacuggauacuagaagucaagaguccuucccguaccuauguuggaucuaauuuccucauugauucuaaaaaucacauugauaccuccacaccugucaacacuuuccugaucucucucuuauucauaggacuuucccacucaauaguaccucuuuuaagcuaaucuaggauuccaguuuagauucuacacauuuuuaugcuuuucuuaccuccuccuagacaauaaccuccuuaagggcuggaaggaaaggaagagugaagcaaauguauguuuauagagagaguacuauagcaaaguaccucaaauauaaagugcacucauaaauauuuguugaauaaaugaaugccaagcacuggccaaagcauguuacauauaugaccuugcuuaaucuucauaaagaccucgugaaugagugucagucuuuuuauuuagaaggugaagaaaccgaagcuagagguuaaguagauuuuccaaggccacauggcuaaucacuggaagaguaaagucaaaugcauuucugccuauuucuacccagcaugaugucuuaaacauaacaauagaucaaaaauguauuauuugagccgggaacaguggcacuggcuguaaucccagcuacacaggaggauguuugagcccaagaguugaggccagacugggccacauagaagacccugaaugaaaaaagcaaacaaacaaacaaaaaccuuuguugaauugaucuaaacaaacuccuuauccaaguccucuuuuuagguauaugcagaguuugugauuuuuuuuuuucaaauggcaaagguguuucggguacaggaagggguaaauaaacugugaagacugccucgcaagguuuacaaauaucacaaaaagguuaucucuacauuuacuucaaacuaauuuccauacucugaacuauucuguucccacugauucuucagauucuagcccuacgcuuacagcuaucuccucucaucccauuugaaauuggaggagggagaauaaaggaagggaauaaauaacuugucacucaacaaccagaccaucuauuuccgcagcuucgacaugggaucaugaaaaacaacugaggcauagguauagcuguucugcuuuggcuggagagaaagccgagaaagaauucauugguuuaggccgggugcgguggcucaugcuuguaagcccagaacuuugggaggccgaggcgggcgaaucaugaggucaggaguucaacaccagccuggccaacacagugaagccccaucucuacuaaaaauacaaaaaguagcugggugugguggugggcgccuguaaucccagcuacuugggaggcugaggcaggagaaucacuugaacccgggaggcggagguugcagugagcugagauagcaccacuguacuccagccugggugacagagcuauacgccaucucagaaaaaaacaaaaaaaaaaagaauucauugcuuuaaaaggaaauucauuuccauccccaucuaccuccucugccacaaaaacaggcaauuccaguuuccuccacucuguccaguacaagaggaaaacacuggagauguggguucauucaucauuucaaggaaauuguuacauuuacauagaaacaaccaggaagaaaaaaagucacuaagccaaaaaggggcugcaaaauccccacacuuagguaugcugccacacuggccacguucuuguuaguuuuaauacaauuuaacuuagauguguaaggaaacacacaagguuugagucggcuuaguuucugugugauacaaccuacagaacagcaaauggaagcaauauuuguuaccuacauuuuaacauaacauuccuguauauccagaccaguaacuaucagugggccaauuguaaucagccuccuucaaccaaugggcaguuucuauuuggaacucaaccuuaagagucaaaaugagucagacucuguacucugugaucaaaagacauauaaagggacaugucaaaaagaaccuauaaauagcuagacacaggucagcccuucuuaauuaccauacuuggcccugguaugcccaaaucuauccaaauuccuacagaauacacucguuuuucauucuucgaccaugucuuugguguaauggauuucauaccuuuauuuuggagugacgucucaaguggagucgccaggagcucagauucugaggucagacagaccuuggcuaaaaccucugcucugccacuaucgguuugguaacugaggcaaguucuuaaccucuccggccucaguuugcugaucuacaaaaugggauaucaccucacugauccauagugagaguaaaugauagaauucacauucaucacuaagcacaguaucuggagcacagaaagaaucacagcagugauaccaucugggaugguagaaauuagcacuucuuuguacgugacuuaaauuuacaucauucuggauguggugaacaaaucugggcucauucuaccaaagcuccucugucuacauguagcuuucaccucccuucauuuucagacccucuaucaaaaccuucucuccuaaauauacccaauauccacgauguaagcgacucugugagcacaaagaauauucguccucaaaagaaaauugcccacccgggguuaggggguuaauguaagaaaacagcucuaaacuuugcaggagaugauaacuggaaaccucucuggucccaugcagggaggcuuucacguugacacaaaagaaaugauggaaccucugagcugggucaugaugauaaccaacaagccaggcaauggugguagcaggagaguuauuuuugauuucuuacgucggugcaaaaguaauugugguuuuugccaugaaaagugaugauaaaaaacaauauuacuuuugcaccaaccuaauacuuucuaaagaaaugugggaucaauaaggggaggaugaagagucucagggaagaauuaauaagcagcuucucaucgaagggaagaaaaaaaggaaagaaauauaaagcaaacaggaagaacacaacuaaggggaaaagaccccaggacgggcaaaaggagacggguaacuuaguucagaggaaaugagcaaugaccuacaauucuuauaacuaggagagacaccacucagacguuuccugugggcugggcccaagaggucucuggcugagcagcagagcaguaguuauccagguuaacaacuuccaauuaaagccagagaggaauguuucugggagcucugucaugaagagaccccaguauucgauggaauaaagucauaaaggaaagggucaacaaacauuuucugcaagggaccagauagcaaauauuuuuggcuuugugggacauaggggcucuggcgcaacuacucaacucgacagcugucgagcaaagagcagccauggaaaacauauaaaugaaugaccauagcuguguuccaauaaaacuuuguuugucgaugcugaauuugaauuucguaucauuuucaugugucaugaaacauugauuuugauuuuuuuucaaucauuuaaaaaugggaaaaccaucuucgcucacgggcuauacuuaaaaacagcugaggcuuggccgggcacgauggcucacgccuguaaucccagcacuuugggaggccgaggaggacggaucacaaggucaagagaucgagaucauccuggccaacauggugaaaccccgucucuacuaaaaauacaaaaaauuagcugggcgugguggugcacaccuguaaucccagcuacucgggaggcugaggcaggaggaucgcuugaacccaggagguggcgauugcagugagccaagaucgcgccauugcacucccaguugggcaacaagagcgcaacuccaucucaaacaaacaaacaaacaaacaaacaaaaacaacagcugaagcuagauuuggcccaggagcugcaguuugcugcacaggcccaccagucagacauccauccugccucugccacugacucgcuauccagccaugggcaaauugguuaacaacaauugauuuccucacucguaaauuaaggauaauaacaccaacuuuguccauaguguuuaugggacauccuaaagcauacuauaugaaaaguaacuggcuuaggguaagugaugaugacaacagccuugggagugguacagggagggguugugaucagcagcuccaccuggggcuaauggucuguccaaagaagacuaaucucaagaaucugacuuaagaagggauguacagaccagaaaguaaaacagaugacagggaugcugcaaaugcuuauuuaaugcuucaacucagacuggaguugacuaaauuacgaugauuuggccaggcgugguggcucauaccuguaaucccagugcuucgggaggccgagguggguggaucaccugaggucaggaguuugagaccagccuggccaacaugaugaaucccugucucuacuaaaaauacaaaaauuagccugguaugguggcaggcaccuguaaucccagcuacucgggaggcugaggcaggagaauugcuugaaacugggaaucagagguuucagugagcugagguugcaccacugcacuccagucugggugacagagcaagaccccaucucaaaaaaaaaaaaaaaaaaaaaaaaauuacgaugauuucugauagacuucauuguauggggauuauaaccugaauauccuccucaacucagaaagagggagauuauggacuacauacugaaccgcaugggccaacucaggaagaccaucaaaggagacagagugggguacaagccagggaggaaggggcugggcagaggcaguggagguggucaaggaggaagugaagaaucauuucacugggaggugauccuugcgaaguucccuguuuuguuagagggcagccagcuguuaaaaacacugucucugggccgggcgugguggcucacaccuguaaucccagcacuuugggaggccgaggcggguggaucacgaggucaggagaucgagaccauccuggcuaacacggugaaaucccaucucuacuaaaaauacaaaaaaaauuagccgggcaugguggcggcaggcaccuguaaucccagcuacuccggaggcugaggcaggagaauggcgugaacccaggaggcggagguugcaguaagcugagaucgcaccacugcacuccagccugggugacagagcgagacucugucucaaaaaaaaaaaacaaaaaacaacaacaaaaaaaggauugucucugacaauccuucagaagccucauagacuuaaaaaccagcuccuaaaaccagcacaggaugcagaaaucacuucaauucuauuggaugggauucuucggacaauucaucuucucauauuuuuuaaaaagaaaguuagcagagaauugugcaaccuuuaaaucuguucagaaggcuuagguaggagaaaugacacuucgccagccauuauaaguugcuuuucaugcuguucuugcaacuuccaaauaauuaagcaaauacauaaugggaauaucagugcaaacaaagaagaagcacaagaagaaaauugcauuguaauuuaauuacccgaaaucuuucauaaaacuuaggagcaaaugagagcuuaucccuacugaugaaaaauacuuucauugucagacauuuuuugagcaccuauuauuuauaaggacaaugcuauaagagucagagauguaaagauauauaagaaaagguuuaguuacccagcaagggcuuucaaacaagacaguccauaaaaggcaaacaaccauuacagugguuaaaacuugcagcuguacuauguaggcacugggaaucaaaaugagagcauuugcaaaauauccuuuggcagagaacugguaagaaaccccaccaccaugauucacaugucaccauuucuuggacacagaaaaauaaccccugcucauuauaccaucagcucccccuugccagacugcucccaacaaaaacaagcaaagcuaaaaaugugaaauauacuaaagauucugaagaaaaaaaaauuuuauaaauguggauuauuaguguucacgugugguuuagugaaaagaacuuacggacagagaaucuguagaucugacuucucccugugacuccacucuacugucuucaggaaagucacucacuuccaaggccucaguuagcuuauguguaaaaugaagugauuggacuauaaaacuuucauagcucuaaauucuaucacuuaauaucaggaugcauaaauaggcgcauuuauuaaggcuauguuaaggauauguuaaaucugauugacuuauaugacuugugaggucauuaaaauugauucuuaacaagaaucuuaaagauucuagacuuaauuauuuuaacaaauguaggaaauuuaagucaaccaccuuuugugauuaggcauugcacaggaagcuaaaaaaaauuagauuaaauuucucugcaacaaugcauauaacacaaccaggugcuauguaagaauuauuuauaaaccuaaagaaaaacuaauuuugccugaaaagauaacugaaaaugcaggaaugcccaaaaguaagcuauuucucagacuggaauuuaaucagaucacuacauuuuucuuauuauuuucauauaggucuggauagcuauagacuauauaaauaaaaugaguuuauaaaauaugugauagcagcuuaagacauuagguuaaaauuaaaauuagaacucaucaaggaauuaaauuguuuagauacacagaacccaacuaucaauccaggauuaccuaaccucuacaauauugcuauuuucuggcuaacuuugaaaauaauuugauccccaaauuaauuaauuuuuuuuuuuuuuugagaugaagucuggcucugucacccaggcuacagugcaguggcacaaucucugcucauugcaaccuccaccucccagguucaagcgauucucccaagaagcugggauuacaggugugcaccaccacgccugacuaauuuuuguauuuuuaguggaggcaggguuucacuauguuggccaggcuggucuugaacuccugaccucaggugauccacuugccucggccucccaaagugggguuacaggcaugagccaccaugccuggccacccaaauuaaaauuuuaaggauauauuucaugagaaaaaaagaaauuugggcacaugaaacacaaaugucaaaaaaacugaaaaaugcaacugccuuaucacuaauaauauuagaguagaauauuaauagcuuucaucaaacugccaaagauuuuuucaaauuguuauacccaggaugaagaaagguaccaucuuccugaagagcaauuuacuuggcaauauguaccauuaugcuugaaaggacagaaugggcacgucuaaauauuauugguagaaaugagaauuaguguuaccucuaugaagggcaauuuagcaauauaucuauacaugcccuuugacccaggacuuccaccucuaggaaucauccuaaagaaauaauugggcaaauguauaaagauguauguuccagguauuccuuacaguacuguguauagcugugcaaaaaaauggaaacuguuugaaaacucaauaugacauuaaguaaauggcuacauucuuacaaauuaaaauucacgguuguuaaaaaauagguaaccuuauguguacuacuacagaaagauauccaagauauaugguagaguauaaaaaagcaaguuacaaaauacaauauauaguguguaaaauaacauguacauacaaauauggagauaguacccaaaaaacuaacaguaauuagcucugggugguaugacuuugagugaguuuuauauucuuauugugaauuuaucuuugguuugaauuuuuugauuagcauaugucauuuuuuuuuugcaauaauaaaaagcuauuuucagaaggaagaaaagagaauggagagugaagaagaacuggacauucaaagccugugguuuugcucccuggaauuuaaucuaagggcauaguaugcaugauaauguaggaacugguaugaucaucacggaaauauucacaauagugaaaguuaauaaacauuaagauucuauuuaaauaaauacaauggaagaggauacuaugaauguagaaauauauaaacuugggaauauuuugccauauauugguaagugaaacaagagggaacgaaauagacuuaguuuuacacacauuuuggaugcuucauacacauagauagaaaaaaaaaguccaagagaauaaaugccaaaguguagacugcaguaacuagucauucuuauuuuuccuuuucuaugaaauguuucuauaaugaacaaggguuauuuaugaaauuucuuuuaaguuuuaaaaauauuccuuguagaucuuucagauuuuaaaauacuggggagucauuaaaguaacacuaaucugaaaaacaaagacaagagaaucucaacucuuuucuccaacauuaaauuuaccaaccagagaccccugaagcccccuacaguuaacaggccgcaugcucuaaagaacugaaugcaaugcuaauacaaagcaagcucaggaaacccaagcuaccuauucugauuuuguguccugagauguacgggguuauaaaacauacuggcucagauuacaggcuaagcaugacaaguccgucugguacaaccuaacaaaggaauuuauagagaacaagaaauuuacacauuucauuucccaaggguggaaugaauuacagaagcaaagaaccccaguagaguuaagaccuuuccuaccacucugcuauaugcuucugaauugugccucauaggcauuucuuacaugauuuacuuauugcucucuaaaacuaaaauaaacuaauauuuuuuaaaggugaauaggaggagaagugagaaaaguguauuuuaacagggucaaacuuuuuguguauuuucaggugaacugggggaugccagaucucccuaccucccucuuucucucccucccuccggagaucauuauggcugauaacaauaguuuuucucucccggguaguguagaugacacauuuuuccuguagcuugucuuccuguagugugcaggaauuccugcacuuucugggugcccuuccuguuaacuuacauuucagauuuccucaaaaggcauucuacugcuuuaauauuugaaaaaugucaacucaaccccagacagcuaauauaaacaagcugaaaagcauaccaccuaaaguuacaacuguggaaaacaaaauuucuuuuuaagaaauucuuucucggaaucucacuguugguaaggcuguagagcaguaacccaguccuuccagcuuccagagagucuguaauuccuuugccucugcugugccuuaaauuagaggucuguuaaaccgaauuauagugaucuagaaaguucguaaagguccuugaauugaacauauuguuaaauucuucaauacuaugagauuguauccacuuuucacuuuuccucccauuucuuggguuagaauauuaaaaaagaaguuugguacugcaaaaaguauuuuggccauuugagaauagcguagcugaauaaggccaauuccacauuuaaaguccaggccaaggcggcuggcucuuuugccauuucuaaaaugaucacccacuucuuucuaccaauaauuuuccuuucggacaagaaccccauguucauuccagauguacuuuccaagcagaauccaauuaagaaaacucaucuggguaaaugggaauugauuugaaggaccaccaguaccugauccauuguaaacacauccauagggaagagugcagugcuaauaucuccuuuggcuucucaacucaaaaacuggcucuacuaagagggagccacguucauagugagcccaaaaauaugcaaaaaggagccugauuuaguuuagacccuaaaguccaaagauaagaucacaguaaacaccacccucuucauaaaccuuccugacuaucccccaaauagauaaaucacuuccauuuuuaaacuccaauagcaccauuucucuucaauaccuguccuauuaucuuguauuauaaugauuuccuuacauucuuguuuucaccaacccgaaggaaaaacuucauuuuaaauauuuuugugugucccuaaaucaugugcacacauacacacacaauacauacauauacaugcauauauauacacacauacauauguauauacaugcauaucacaauauauuacacauauauuaaacugaauugaaugaaugagcgaauguuuaccaaauacaaaguaacuaaaugccaucucuuuaauacaucaaagcauggacugccucuucugaacuauuauuucucuacucaauaaggagauuuuuagguuuuccccacuugaggaacaucuccaccugauaugucaauuccuagguucuucagcacucuuaacuuuucagauuuccauucuccccuaauacucaaagaaaagcagagugcuacuuugaaugcuugagauuacuacuuccuucuugggcugcugagauauaugacucccaucagguagaauuaaaaagcggugcaacaacuccccacacucccucccaaaaaaguagcaaaaagcuuguuagacccuuuaauuucaccaugucuuacucaaagagugccccggguagccuaauucaauaguaucuaacaccucucuucaucaucccauacuucucauauggcauaugcuuucucuaugguaaagaaacaauuguucugaaacaagugacuuggggucccaggggcaccugacagcaccuagucugcucuuugaugucauaucaggaauuuuuuaaauccccuucccagggugacauuaagccugcaaaauacaacuguguuuaaaaacaaaaauuaagaaaagaaaauaaaagaacauaaagaaaacaaccauaacgugaacuuccaaccuauuacagcugacuaaauacacgcaguuacacacuuaaaauauuucauuaugcuugucaaugaaacagugcagucccuucacacuacuguaaugcuuaaaaguacaguuuuacccccaauauuuucccccaagaugcaaagcaucccccaaaugggcagacauaaaacauuaggucuucacugcugcuucuaaauuuugcgagccaauaagcaauugguguaaagugcaaaaucucagaagagcaagacucgucugcuuuuuugugauaugcuguuauucacccuucaccuuuacuuccuuuaaaaaucaaaaguuaccuaauguucaaggcgauaucaauggaaauuuagcuaaauacuggcaccgcaacggucuauuucccccaaagaauauaagauuacauuaauuuccuaguaguuuaacucaaguuuuaccuuucaucuucaccuauagaguuuuuaaaaguuucuauuccuguugcauacaaaauuacuuacaauaucugugcauaguaaagaauuuuacaauuauauaaagccuugcacauuuagacgcuaccaaccugcucugucucuccugacugugcaaaaggcaaaaagagcucaguaauccuagcagaagaaugcaaauaacgucaaugcacagcugaacugcaagcccugccuuacaggaacucucugugucugcaaaaaaagacacauacuaaacaggaaaugcaacugagcuguggaaaaccucaaacuuaaaaaugcacucgccaggcgaaaauugcauccaugcauucauaaaugcaugcacaacccuuugcauuuuugcaacuaaugcaaacagccucuuaccuuucgacugagacauuuuccccuuuccuuugaugggggaggggagcacaaaagacuuugccuugcuucucuucuguagcuaguuuugcaacaaagaugcaagcugcaggcgugcaaucuucaugcaaguggaguuucucuugaccgaugcagcagauggacuuucagggaaucaagauggaaaugcacaccuugcaaaacagacuggaaagugauuuuucccccaguugcaacguuagggaaggcugugcugcagcuacaugaugggccagggcuggcagcuaaaagcuccaaacuuggaacu

SEQ ID NO: 192320 - RNA, 8577 nt, Homo sapiens
gcauggcggccaccaggugccugcgcuggggccugagccgagccggagucuggcugcucccaccgcccgcacggugcccacgccgggcgcugcacaagcagaaagacggcacugaguucaagagcaucuacagccuggacaagcucuaccccgaaucucagggcucggacaccgccuggagggucccggugagccgggaaggacuggacggaaggggcguuuugucaggcugcugggugacguuaggaaccccaggcccauuggccggauguggagcuacgucggggggcuacgugauggucgccgcgggagggggcuggcugucugcgcuaaccuggccgggaguggggugcucgcuguagcgcgagaugugcaggagcccggaaggccggcuggguaugcuucuuucaaggcugccagcuuuucuacguucguguccuuggcccucaagaccaaauuccagucccaaggggaaauacgggcauucuggcccuccaaggcggacaauaaaggcaagaggcugccaaguuguuugcuacccuuugggacguuacaguguccauugucucuaguaaccccaggacgcgcgaauaaaacagcuucucugucguuccuucaggaugcauuuauuuagccagcugugugcaggcauugaaucaagccccggagcaagagagauaagacccacccaaacccauugagcuuccacuuacaggacuggaaaagaauauccauucauuuguucauuaauucacucacucacucaacaaaagcugugcuaggcuaggggauggaguagcaaacaaaauugaaauucuaaagcuuguggagcuuauguucuaguggagggagacaagcaguaaguaaaugacuaauauagaaugugugagguaguacuuugcagaaaauaaagccaagaaggaagaaguagugccagagguaggaaguaggguugcaauuuuaaguaggauugucuaggaacgcugucaaugagguggcauuugaauaacgaccuggaagaagccagacagcaagucaugagaauagggggcggaugagcauccuaggcagagggaagagaaagugcaauaaccugaaggcaguagcaauccccagguguggcucagcaggggucaggagacaaagccaaagagagggauggcuggggaaaggccuguuacuaggacuuaauggccuccagccuuuccucugaacgcaagggagaccuauuggagagcuugaagcagaauggaauuaucuuaguuuuacaaggaucacucagagagccuuacagagaacagauagaggaugccaagaucagggagacaaguaaggagauugcaauguagggcaagagaugauaagcaggguggaagcaguaggagucaugagaauuggucagauccuagacguauuuuggaaagaaagccugcaagauuugcuaauugauuggaugugagaagugagaauaaaagaggaauugaagucuggggccuuuuuuuuuuuuuuuuuuuuuuuugagacggagucucacucugucgcccaggcuggagugcagugaugcaaucucuguucacugcaagcuccgccucccggguucacgccauucuccugccucagucuccugaguagcugggacuacaggcgcccaccacuacaaccggcuaauuuuuuuuuuuuuuuuuuuuaguagagaggggguuucaccguauuagccagguuggucuugaucacgggcgugagccaccgcgccaggcuuuuuuuuuuuuuuuuuuuugagacagggucuuacucugucauccaggcuggagugcaguggcgugaucucagcccacugcaaccuccgccuccuggguucaagugauucuugugccucagccucccgaguagcugggauuacaggcaugcaccaccaugcccgacucauauuuuugcauuuuuaguagagacaggguuuucaccauguuggccaggcuagucucaaacuccugaccucaaaugaucugcucgccucagccucccaaagugcugggauuacaggcgugagccaccaugcccagccaagucuggggccuugagcagugaaaggauugaguugcuauuaacugagaugagagaguggcaauagcauucauuuguucauucauucaauaaaauguuuauuguauaucuacugugucuacuacuacuugagucuagcauauacagccaugauaaacaaaauacaggaucucucuccuucauggagcuuaauucuaauggaaggagcagacaguaaacaaauagggaaaauaucagguagugagaaguaguguaaugaauaggccagggugcugcaacaaagugcugaggcuaccucagauuauuaguaagggaaguccucugaggcggcuuaagguuuggguccauuagacaucugagaagagacguugaguagcaguuggguauauggguguggaguugagaagaaagguuugaguuugagccagaaaguugggugucaaaaacaggcuauuuucuggccaggcgcaguggcucaugccuauaaucccagcacuuugagaggccaaggguagaucacuugaggucaggaguucgagaccagccuggccaacauggcaaaaccccgucucuacuaaaaauacaaaaauuagucgggcgugguggcacacgccuguagucccagcuacucaggaggcugaggcaggagaaucgcuugaacccaggaggcagagguugcagugagccgagauugcaccacugcacuccaaccugggcgacaaccuuaagacuccaucucaaaacaaaaacgaaaaacuggcuauuuucaucagcauagaugaaguauucuagagaaagaaagaggagagagagagaaguauuucaagggcaugucaguguuuaaaaguugcuaagagcuagcaaaggagagugagaaagaguccuaggaagguaagaggaaaauuucagaaggaacagaaggaacaugcuucaggaaggaggguguggcccaugaucuucagugcugcagacagguggaguaggauaaggguuucauccccaaauaauucuuuuucuuuuucuuuuuucuuuuuuucugagacaaagucucguuagcugucacccaggcuggagugcagugucccaggcaggagugcaguguccugaucucagcucacugcaaccuccaucuccuggguucaagcaauccugccucagccucccccaguagcuaggauuacaggugugugccaccaugccuagcuaauuuuguauuuuuaguagaggggagguuucaccauguuguccaggcuggucuccaacuccugacuugaagugauccacccgucucggccucccaaagugcugggauuacggcgugagccacugcacccggccaacucccaaauaauucuaagauaaaagaaaugaagacaggcugggcgugguggcucacgccuguaaucuuagcacuuugggaggccaaggcgggcagcucucuugaggucaggagcucgaaaccagucuggccaacauggugaaaccccaucucuacuaaaaauacaaaaaaaaaaaacaacaauagcuaggcaugguggcaugcgccuguaaucccagcuacucaggaggcugaggcaggagaaucacuugaacccaagaggcggagguugcagugagcugagaucgcacuauuguacuccagccugggcuacagagcgagacuccaucucaaaaaaaaaagaaaugaaggcagucgggagugcaccugaggauacugaugcuuugagccuggagggccagaaaagccucggaguggguggcguuugcacugggccuuguggauacaaagauuuaaggcugaagggcguugcugcuugaggaacagcaagagagagagagacauggaggugagaaguccuggagugaguaguuaguuugacagaaacccucagggugcaauuauagucacuguccaagguggacugccuugugugggagucuccuguggccccggaaagaacaggguggcccaccaggcuuguugcuccagguugacagaggguguugcuuuuggagguucccugaugcaugugcacuguggcucccccucccgcuggagccaggccucugauggugccugacacuagcuaaggcuagggcagggaaggcuggagacaucagauccauuuucguagaggaguguuucugaggugguaccucuggagucugaggaugcuuuuucugucaucgugauaucauuuugcaggggaccugaaaauacuaauguacaauguuuguguuguggcuuuacaucauuucuuuguugccuugaaccaguuaggagucacccagcagguaauauuuauuugacacuguguacauuacauuacagaauggugcaaagcaagccgacagugacaucccucuagguaaguaauuuuguuuucuuaaaaaucaguuggcugcgugguggcaugugccuguaaucccaguuacuugggaggcugaggcaggagaaucgcuugaacccaggagguggagguugcagugggccgaguuugugccauugcacuccagccugggcaacgagagcaaaacucuaucuggaaaaaauuaaaaauuaaaaaaaaaaaaucaugccuguuggccgggcauggugucucauaccuguaaucccaacaauaugggaggccaagguggguagaucacuugaggccaggaguuugagaccagcauggccaacauggugaaaccccaucucuacuaaaaauacaaaaauuaggccaggcgcaguggcucacgccuauaauuccaacauuuugggaggccaaggcagcuggaucauccgaggucaggaguucaagacuagccuggccaacauggcaaagccccaucucuacuaaaaauacaaaauuagccgggugugguggcgagggccuguaaucccagcuacuugggaggcugaggcagaagaauugcuugaacccggaaggcagagguugcagugagcugagauccugccauugcacuccagccugggcaacagaguaagacucugucucaaaaauaaauaaauaaaaauacaaaaauuagccgggugugguggugggcgccugugaucccagcuacucggaaggcugaggcacaagaaucacuugagccugggaagcagagguuguggugaguugagaucgcaccacugcacuccagccugggcgacacagcgagacucugucucagacgaaaaaaaaaaaaucagucauuucucuaauccuucacacauuccuuccagaucucuccagcccaauuaaaguaaagagacuaucucgggugugcagaaguagaaucuuugcagcauuauuuagaauagcaaauaaaugaugguguggccagucgcaucguacugugccgugugccacgugaguguagagcucuugacauucucaugacguggagcacucuuuacaauagaugaauugaaagaggaagacacaggagaguuuauaagcuaccauuuguuuuuuacauaucuauaucucugaaauaucuuuuuuuuuuuucuuugagauggagucucgcucugucacccaggcuggagugcaguggcccgaucucggcucacugcaaguuccgccucccagguucacaccauucuccugccucagccucccgaguagcugggacuacagguucccaccaccacgcccggcuaauuuuuuguauuuuuuaguagagacgggguuucaccauguuagccaggauggucucgaucuccugaccucaugaucugcacaccucagccucccaaagugcugggauuacaggugugagccaccgugcccagccugaaauaucuauuucugaauaucuguaucuauauuuauaucccuaucuguguagagagauaucuauaucugaaaggaacacccuggauacagugacugccuggaggaauagagagauaagacaaacuugguggcugagagacaagagugaaagacauuuccauguaaauaaaccauuuacauaacuguaaaauuuuuuaccugucaagcauaagcaaggccuaacaguuacagccuguaaagaaacaaugagccuuuuuuagauucggagaguguaugacuuccauagacagugcgaggaagagcagccaaagaugcuggcucccuguggcccuugcucaagaugacucaaacagaggccagaugaccacaacccaagggacaggacacccuguggcugaggagcgaauaccaugcugcagugaagcaguuuuguagcuugaagcugugcccgccuguagucucagcuacuugagaggcugagguggaaggaucccuugagcccgggauguucgcuucagccugggauguugaggcugcagugagccgucauugugccacuggacuccagccugggugccagagugagacccugucucaaaaaaaaaaaaaaugaagcugugcccuaaggggugcauguguguaggggaggaggcagaaagccuccuaucucaucagaacuggaggcgaagagaagugucuugugacagccuccuagggggagacaggcaggcaagugggcaguagcucgguaguagcuccucaccagccucccacacucucauggaucccgaagcguuccauuccuaugaagacuuuggucagcugcagcucaagcuuuggccaugugcaagguugccagcaaucaccauggcagaacuguuccccugcaguggcacguguacuuguuaccuagucagaaaguggauuuaauuugauuuuuccaaaggaggaaauccucuuaaaagcagucccaagaugagucacuacugcucacugggaccagcucucugccaccguggugccacaguuccuugccacccaaacuucuugcaguuuuugaaauuuucccaauauaauaccuucccuacauuccucagacacaacaagacugcuuuucaugccaugagguaaucaguuuuguguguguacuuucuucuguuuuacagaucgcuugacaauaucuuauugucggaguagugguccuggggggcagaaugugaacaaagguacggggugccuuguugcuuucuuuugcuuuaaaauguagcugggagaugggcuugaggagcucuguguuuguguucauauggaauaaagggauuuuucagcagaagcuuuaauacugccagcuuauaauaauccucuuuauucuuuugaauguggucugauucucagacauucagcuguggguugcuaggacuaggaucggcuugugagucuaaacaaagagaaaucacaguugugagguggcagccagcuccaagaacagguuucuuucauucuggugcaacccauucccuccauuuuuuuuuuuuuuuuuuuugaacccaguaaaacuguaagagaaggacugggugcuuaguuacuggaagucuauuuuugcccaaaagugccucacugucuuugcgggcuuguucauagccaacuuggacauaggcuacaauguacaugguuaggugucuggccucccuuuauuucagaauggucacuggucacccagggguugauccuuccuggaagucucaggcacccaugcucccuucucccuuuccuccacagugaauuccaaggcagaagucagguuccauuuggcaacugccgaguggaucgcggagcccgugcggcagaagauagccaucacgguaaccaccaucccuuucuuucccuagaaaucccucaguggcuuuuaaaccuuuacucuguaggacuccaguuuuucauuuguucucugcagcauaaaaacaagaucaacagguuaggagaguugauccucaccucugagagcagccgcuaucaguuccggaaucuggcagauugccugcagaaaauucgagacaugaucacugaggccagccagacaccgaaggagccaacaaaagaagauguuaaacuucauagaaucagguaccaggaaaugcccuaagaugcuauaaacugauuuguguggacaagagucuacacagguaaggaaggggcaggggagaguccaaggccggccuugggagaaacucuaggaagaggagaggaugcugaccugggaccgaggccugcgggcuagugccugcugguguaacugcucggcuucccguugagcucccaacuccucucaccacuuugaaaagcacugauugggcaucuggggcuaauugcagucuuuuuguuuucaggauagaaaacaugaaucgggaaaggcugagacaaaagagaauucauucugcuguaaagacaagcaggagggucgacauggacugaaaucacccucugcagcugggagggcucuucugggcguccgggcagcugcagcugagaggacuuucacaccauaaggagauuucuguuuuucuuuuuggcuguuaaugcuugucuauaacauuggagccaucacaagaauguucauuuggaaugaaggcugcaggcacugguugcagacgucuuuauaggcagucaccauguugucaaaccuuaauaaugcaccucauguauuagucacaauaaaaaucagaacuca

SEQ ID NO: 192321 - RNA, 30258 nt, Homo sapiens
cgguacucugagugcagucaguccucggcgcuguuuucccugauuugcugucgacgccaggaaggaaggacgcgugcagaggaccgcagagggguggccguggcugagaggagacagcgccgcagcacugaggguuugggcuugcaggcgcugcaggagacgcccaggcggagucuugucucgcagccagcucugagcgggaggccugagcgggaagcauuggcguccgagcgacuucuaggagccugggguucggcgcuauggaggagcucgauggcgagccaacagucacuguaaggguaccccgaacaggcuugcucguccuugcggguugagaacugcgucugcuuaguuacuucaggcuugucugcuucccuaguggucgcgaggcgcucguccccuucccucgacucaguugccacuuuuccggaggucgcaguguuaacgaggugcccgcccuagggucgcaguggucgcgggguuucugccaccagucacaaaccccggccucgaaggucccacuccgucccuuuccuuccuuuguguuccuggccuuuuuacuucccuugcuuuuccucuugggcauuagaguggguucagcccaagcagaggaauuuauauuuuuauuccagccguauuaagcucugcaucgcggcacauugagcuucugccuguguggccuaagguuuauucaacguauuaucucaggagacuauuccuguuuuaucgcugugcauucaauuccauuugaacuuugaagacaguaugucaacuguggaugaucugugauguguauaaaaaaaauucacgcgcuuuauguacgagauaccuaccguuucugcuaguuggauugcucuuguuuucccucuuguuaaccagaagugacugaggcaggucucaaccgauaaagguuuaauuagcuaagguugaggauccaaccgggaaaaagcacaggucacaggaggaucugagaccugugcuuuuuccaaagaugguuuugggaacaucacuaguuaaagaggaaggagcuagcaggaggggcaaaaaagggagguuaggcagugaggaggcaaaugauuacauucuugugagucggugauuagccucaguaaaucugcauuuuaccugugaaaagagggagcagaggaaaauuuuauguaugcauucaucucaggguagguagagggauuaugguuauuauuacuguuauuuuuuagacggagucucgcucugucucccaggcuggagugcaguggcgcggucucggcucacuguaaccuccgccucccggguucacaccauucuccugccucagccuccugaguagcugggacuacaggugcccgccaccacgcccggcuaauuuuuuguacuuuuuuguauuuuuaguagagacgggguuucaccguguuggccaggauggucucaaucuccugaccucgugauccgcccaccucggccucccaaagugcugggauuacaggcgugagccaccgcacccggccgauuucuggucuuuuacuugugaagauaagcugguaguugacauugucagaaucaacagaucuugauuuuaggacuaguuuauaggggcgauguguauccugaaaauuuuagaggcucacaaggaauuuccuugugagcaauuugugagggaagcucucuggggagauauguggccuucuuuuuuuuuucucuugaggcggaguuucccucuugucgcccaggcuagagugcaguggugcggucucggcucucugcaaccuccgccucccagguucaagcaauucuccugccucagccuccugaguagcugggauugcaggcaugugccaccaugcccggcuaauuuuguauuuuuuuaguagagacgagguuucuccauguuggucaggcuggucuggaacuccugaccucaggugaucugccggccucagucucccaaagugcugggauuacaagugugagccacugcgccuggccucauucuuuuuuugagacggauucucacucugucacccagaguggagugcaguggcgugaucucagcucacugcaaccucuggcuccuggguucaagcgauucuucugccucagucuccugaguagcugagauuacaggugcgugccaccacacccagcuaauuuuuguauuuuugguagagaugggguuucaccaucuuggucaggcuggucuccaaagccugaccucgugaucagccugccucggccucccaaagugcugggauuacaggcaugagccaccgcgcuuggcuaggaguucgagaucaaccuggccaacauggugaaaccccaucucuacuaaaaaaauacaaaaauuagccugguuugguggcgcgugccuguaaucccaccuacucaagaagcugaggcaggagaaucacuugaacccagcaggcagagguugcagugagucgagauugcgucacugcaguccagccugggcaacaagaguucgaacuccugaccucagaugaucugcccgccuuagccucccaaagugcuggcaggagccaccccgcugccggcccaaaaugaauuuuucuuaccaguguuauaaggaaauguuauugaaggauacaguguuauuagaggaccagcugugcucuucacuuaaaguguuuuucagcagggcgggcacgguggcucgcgccuguaguccuagcacuuugggaggcugaggcggacggaucaccugaacucaggaguuugugaccagccugggcaauauggugaaacucuaucucuacuaaaaaugaaaaaaaaaaaaaaaauagccgggugugguugcacacaccuguagucccagcuacucaggagguugaggcaggagaagccuuugaacccaggaggcggcgauuggagcaagcugagauuacaccacuguacaccagccuguuagagugagucuuugucucaaaaaaaaaaaaaaaaaaaaaagaauggaacaacuucaguaagaagaacauuuuucauuuuagauuucuaugccuuauuuuacuaguugauuccaggcgugaauuccaagaagaaccaaauguauuuugacugggguccaggggagaugcugguaugugaaaccuccuucaacaaaaaagguaggguuuuuuuucuuccaaauuauccaucuuggcacauuugguuguuuuucuguuuauuaccucagauuuuacuaguuguggacugaaacaguugaauuuauuuuguacuauuuuaauuuucucuauuuuguuuucaagauacaacaggguuuuguugugucaccugggcuggaguacagugugaucauggcucacugcagccucuaccucuugggcucaagugauccucugccucagucuuccuaguagcugagacuacaggucaccaugccaccacgcccagcuaauuuuuuuuucuuuguagagaugggagucucauuuuguugccuaggcuggucucgcacuccuggccucaagcgauccuguugcauuuuggcauuuuuauuuuugaaauguuagcuauuuuagauuuucauugauuuuugagaucuugaagauguugaaucccggaaaaaaauuaauaguuuucaugaaaaauuuucuucauauuuaaaaugucaagcuuuuuaucccuuuuucuuuguccaaagugaccaaauuccuaucaguagcucccuuauugugaaccuugcagaugcuuggccgucacuuuuguguccacagcauggauucagcugaauaauaguucuguaggcugagcugagccguagcauccaaggcacagauggagcuggagagugacauagcuuguccuuggcuugauuuuccugaguuccaucagcuauuggauaggaugugaaucuuuuucuuuuccugauacagugauacagucuccuuccaguagaaggauaaaacuggaaucuugacauuugauuugcuuucuuuuuuuuuuuuuuuuuuugagacggagucucgcucuguccaggcuggaaugcaguggugugaucucggcucacugccaccuccgccucccgguuugaagcaauucuccugccucagucuccugaguagcugggaaugaaggcaugugccaccacgcccagcuaauuuuuguauuuuuaguagagacaggguuuugcuauguuggccagccuggucucgaauuccugaccucgugaucugccugccuuggccucccaaagugcugggauuauaggcaagagccaccaugcccggccacagaaaauuuuuuuagaguagauucacuuuuggagaugaucauaauagauguuaaauuuuuuuuuucuguuugguuucagaaaaaucagagauggugccaaguugccccuuuaucuauaucauccguaaggauguagauguuuacucucaaaucuugagaaaacucuucaaugaaucccauggaaucuuucugggccuccagagaauugacgaagaguugacuggaaaauccagaaaaucucaguaaguugguugcuguuugguguugaagcccacacuacacuguggaaagccaaaugaaguacauuguugucuuuuuguguguuuuauggguugcguaaagaaauaagagacuccugguucuaguugaggcaugaguacuggacaguguacauuagcagugaugggaagacuuagcgggaauaugcaaaugcuauugaugggcuggcuugacaagcuuuauuuauauucauauuuuacuuagccucuaaagaagaaaauuuaggccacacaagcaugugagagucguugaaugaggucacauuguugggagauuugaaaauuaauauaaaccuaacaguuuugucucuaaaaaauuaugguucagacguuauuugacaacagaccagaaaacucucguacuauuuauagauuaggauuuucuugaauuguaguucauaacuucaucauuaucagagugguacuuguuaauuguagacuuuugggacccaccucagaucaucaaaaucaaaaucuccgugguuggaucuuaaaaucuccagcacacugaaguuuaagaacuccuguguuagauuuuugucagcgucccuucacauggauggcuagggaaugggcaguguugguauguuacuucuuugauaagcuuuucacaaaugaaucauucuggacaagacucaggucagcuucugugugagugugugcaagagugauuauugguuguuuuucuguuuuuuuucgaggcagaguuucgcucugucacccaggcuggagugcagugacgcguucuccgcucacuguaagcucugccuccuggauucacgccauucuccugccucagccucccgaguagcugggacuacaggcgccugccaccacauccggcuaauuuuuuguauuuuuaguagagacgggguuucaccguguuagccaggauggucucgaucucgugaccucgugauccaccugcuucggccucccaaagugcugggauuacagacgugagccacugugccuggcccuguuuuuuuuuuuuuuuuugagacagaguuucacucugucacccaggcuggagugcaguggcgcaaucuuggcccacugcagccucugccuccuggguugaagccauucuccugccucagccuccugaguagcugggauuacaggugcgugccaccacgccuggcuaauuuuugcauuuuuaguagagaugggguuucaucauuuuggcugggcuggucuugaacuccugaccucaagugaucugcccaccucagcgucccaaagugcugggauuauaggagugagccacugcaccuggccugauuauuggauuuaagggacucuaguggagaauauuggugaguuugagaaaucuauugucacuucuaggaaaaaaacaugucaaaaguccuguaauuccuugcuggcaggggacccugucuuauucuuuuuuuuuuuuuuucagauggagucucacucugucgcccaggcuggagugcaauggcaugaucuuggcucacugcaaccuccgccugccggguucaagagauucuccugccucagccuccugaguagcugggauuuuuguauuuuuaguagagacaggguuucaccagguuggccaggcuggucucaaacaccugaccucaggugaucugcccacuuucaccucccaaagugcugggauuacacgccugagccaccgggccuggccaguaaauacauuuauguaucuuuuuuauuuuuuugagacaaggucugaccaguagauuucaucugcaacaauuaauggcaguauggguuuguggauauuaacuuuagcccauggguuguuuuguggcguuuuauuuuguuguccaaguuguuccagcuucagaagguuaggagcuccuucacaacggcucuccucuuucuuucagcaaauuucugcauuuauuugaguguuuccuuccuuuguggcacuacaagauguuccaggcucaucuuguguguuauuucauuuuuuguagauugguucgagugaguaaaaacuaccgaucagucaucagagcauguauggaggaaaugcaccagguugcaaguaaggacugugugcgcgugcgcgcguguguguguguguguguguguggguauuuugaguauuuaucuaugcauaaauacugugagguaaaguuugauugauauuccaguccaaaacuuauuuuuccaucuuucauaauccuuacuuuuuugguaaucauuuagagguuuuuuuuuuuguuguuguuuuuuuuuuuuuuuuuuuuuuuuuuuuuuuuuuuuuuugagaccgaguguugcucugucgcccaggcugaggugcuguggcaugaacucaggucacugcaaccuccaccucccagguucaaacgauucucuagccucagccuccugaguagcugggacuacaguuguacaccaccaagcccagaguucugggauuacaggagucagccacugugccuggaguuuuuuuuuuuuuuuuuuuuuuuuuuugagacaagguugcccaggcuggagugcaaagaaacauuauggcucacugcagucaugagcucaccgccugggcucaagugaucuuccuaccucauccuuccaaguaguugggacugcagguguguacuaccaugcccagcuaauuuaaacaguuuuuguccaguuuuccucagagaacuuuguucugauaauuuuuaaauuauuuguagaaacggggucucccuaauuuuuccaggcuguucuugaacuccugggcucaagcaguccuuugacaucagccucccaaagugucgggauuacaggugugagccacugugcuuggcaugucagagaccuuuaugguagcuguguugcaguugaaagugccauuuuguaacuugagggcuuuugguuugagaauugaagggauaugaagcauuaacagcaacaaaaaaauccauaauuaaaagagauuauaaugucuuuuaauuuuucucauuaaaauaaacagaggcucaagccauagacccuggaauauucagcuaugacaauaagccuaagaguuccauugcucacuuaaaauguuuuguguuuuguuaguugcugcuaaagauccagccaauggccgccaguucagcagccagguaaggggagucaccuuuauuguuuuagcaccacuguguccuguguccugggcacccaccugggguggcuuugcaguuccuguuauggcagaagucucuucuuuucagguagauaggcagcuccuuugggugacagugauugucuugcccccuucaagguguagcucacaaggaagugcuuguuaaauacuugagugaauguucgguuccuuuuuuuuuuuuuugagauggagucuugcucugucacccaggcuggagugcccuggguucaagcauuucuccugucucagccucccgaguagcugggauuauaggugcaugccacaccaagcccagcuacuuuuugcauuuuuaguagagaugggguuucaccauguuggccaggcuggucuugaacuuuugaccucaagugauccacccgccucgaccucccaaaguggugggauuacagguguaagccaccgugcuggcccugaauguuccguucuuauggaacauauauguccugaccaaauuguguugagggguugucaccugaaauggagaaguaaucuugugagaucacugcucggucucauaaacacuccucacuucuugaacucaacauuuuuuuuuugaaagacagggucucucuguguugucaaagcuggucucgaacucuugggcucaagugauccuccugccuuggccucccaaagugcugggauuauaggugugagcugccacaccuggcaaaacucaaguuuuuuuuuuuuuuuuuuuuuuuuuuugagacggagucucucucugucgcccaggcuggaaugcaguggcgcgaucucggcucacugcaagcuccgccucccagguucaugccauucuccugccucagccucccgaguagcugggcuaauuuuuuguauuuuuaguagagaggggguuucaccguguuagccaggaugcucucgaucuccugaccucgugaucugccugccucagccucccaaagugcugggauuacaagugugagccacugcgcccggcuaaacucaacauuuuuacugaguugcaaguggcucuacuuuacuuggagcuggaagaugacuuacaguaucuuuuuccucaguagaugcuucauauuagauacuuuucaaagucaguagugacuagguaguaauucacugucucugaaguacccuuaugaacaagucaucauggugucuguggacugaaggauggugaggaagggaagccugcguauuccuaagggcaagguccaggucugauuuauuucggggucuuauauugggcuuucccguuaauagacuguuccccuaaacuucaguccuuugaauaccagcuucacaauucuugcucugucuacguguuucaugucaucuacugaauauucuucuaaauauugucucuucuuuuuacucaaaugaagcaccuugcuaaagcaucaguucaucaagauaggcugggcgcaguggcucacgccuguaaucccagcacuuugagaggccgagguggguggaucucuugagguuaggaguucgaaacuagccuggccaacacggaaacuccaucucuacuaaaaauacaauauuuagcuaggcgugguggugugcgccuguaaucccagccacuugggaggcugaggcaggagaauugcuugaacccuggaggcagagguugcagugagccgagaucaugccacugcacuccagccugacugacagagugagacucugucucaaaaaaaaaaacaaaaaacaaaaacugaguguuggcagggcacgguggcucaagccuguaaucccagcacuuugggaggccgaggcagguguaucacgaggucaggagaucgagaccuuccuggcuaacaaggugaaaccucgucucuacuaaaaauacaaaaaauuagcugggcaugguggcaggcgccuguaaucccagcuacuggggaggcugaggcaggagaaucacuugaacccgggaggcggaaguugcagugagccaagauuaugccacugcacucuagcuugggcagcaagagccaaacuccaucucaaaagauaaauaaauaauaacuggugacaugcaaguuauauuuuuucuuuuuuuaaauuuugagacaaggucucgcucuugcccaggcuggaauaguggcacgauuauggcucacucagacucaacuuccugggcucaagugaugcucccaccucagccuccugaguagcugagacugcggggauaugucacuacacuuggccaauuuuuauauuuuuuguugagacaggaucuugccauguugcucaagcuggucucaaacuccuagacucaagcauuccaccugccuuggccucccaaagugcugggauuacaggaaugagccacugcaccuggccaaguuauuuuuguaaugcacaguaaaauaaaaucacaaccacuaaaacaaaauaguguuggucuccaucccaccaccuaacauccucacgcuggcuccccugugggaaauccuccaguaggauugcaguaaccuuuggguuaaggaaugacugucauaugagucaaagucugcuuuaucccuuggcucugagagcaaagcucaggaaucauuucaggugaaaccuguccccauuucuuccuuaggucuccauuuugucagcaauggagcucaucuggaaccugugugagauucuuuuuauugaaguggccccagguaggcauggaauaucucaccauaaucucauagguguccccuuccaucuucugcucuuuccucaucuuuccugugcauggugaugaguguuuuauuccugagaauguucuuuccaucauuauaaccacgggaagucguuagaaaacacccaaagaaaccugaccguuuugucaggugcugcaaaaagaaucaugcagagugccuccaagaaaccuaaacccugacaaguacugagaaauauuaaacuagugugugaaagggggugucaguguuaacaucauggacuggccaagcuuaagaaaguuuuaugaaugugggguaggauuagguggugagaggcaaagucacauugggaauucugucaugaaucauugggacagggcaacucuguguguuaacucugccaauggguaugaacucugccaaugggaauuuuucuguugaucuuuuuuuuuuuuugagacagaguuucacucuuguugcccaggcuggagugcaauggcgugaucucagcucaccgcaaccuccaccuccuggguucaagcgauucuccugccucaaccuccugaguagcugggauuacagacaugcgcugccacgccuggcuaauuuuguauuuuuaguggagaugagguuucuccauguuggucaggcuggucucgaacucccaaccucagguaaucugccugccucggucucccaaagugcagggauuccaggugugagccaccgugcccagccuucuguugaucuugaauuaaacuguggucaguauagugucauggccuguaugagcucucuguggaucugcugcagcuuuuuugcauuucuuuuaaggauuuauguuugcuauuuuccauaaaugaguaguaaccucuguguagcccuagcauuuuauucauacucucacuaaagaagugaggaacuugaaauuagaguugguuguucagaggccucccuucuccaguggauuuuugaggagguuacaguuggcucuuuguaucugcagguucuacaucauggauacggagugcuggcuguacucugccauuuuauuucauuuuauuuuuauugauugauugagacaaguucucacucugucacuuaggcuggaguguggugguacaaucacagcuauugcagucuggaccucccaggcucaagcgauccuccugucucagccuccugaguagcugggacuacaggcacgugccaccaugcuaggcuaauuuuuuguguguauaugcugggggaggggagacagggucuugcucugucacccaugcuggaguacaguggcgugaucacagcucagaagccucgacuuccugggcucaagcaauccuccugcccagccucccaaguagcugggaccacaggccugcaccaccacgcccggcuaauuuuuguauuuuuuguggagaggaaauuucgcuauguugcccgggcuguucuugaacucuugggcucaagcagucugcccaucuuggccucgcaaaaugcugggauuauaggcgugagccaccauuccuggcucggcuaauuuuuuauuuuuuuuuguagagauggggucucccuauguugcccagccuagugucaaacuccugggcucaagcgaucugccugccucagccucccaaagugcugggauuacagacaugaacuaccaugcccggccauauguuuuguuuuguuuuguuuuuugagacagagucucacuccgucacccaggcuggagugcaguugugcgaucuuggcucacugcaaccucugccuccuggguucaagcaauucugccuuagccaccugaguagcuggaauuacaggcaugcgccaccacgcccggcuaauuuuuguauuuuuaguagagacaggguuucaccauguuguccaggcuggucuugaacuccugagcuuagaugauccaccugccuuagccuccgaaagugcugggauuccaggugugcaccaccagcccccuggcccuauguuuuuaucaucauugcauaccuggcugcuugcuaucuagucauuguugguuccuaaacggccauuacuuauguagcuauuaaguauuugugaagaaucuggagugugggguagugaggucugcauuccauguucaccccuuucuggggucaguuaaagauggagcugccuggcacagaaguaauauuuggugaaagugcauuugcuuuuuccuagcacagucugucauucaggaccaugugugugacugcuuaaaagggauaaaccuauguagucagcuugucugccuuaaaguucucuguuccuuggauaaaggaacuugcugcagaugaagcugaggcuuuugugugugaugagagucucuccucccagcuggcccucuccuccuccaucuccuugacuggguccggcuccaugugugcgagguggacaguuugucggcagauguucugggcagugagaauccaagcaaacaugacagcuucuggaacuugguaagacaggccgggcccccaccucccaccauguguccuacugucccuggugcugccgggugggucugaggacacccacugagccuccagcaguaggcuggcuuuuggagucuguuacuauggagacucuuuuggaucuuuucuucccugcucuaugggagagucuaaaaccgagguaccauguaagaaaaauaaugcuuugaagacuuuuccaggguaaaaggaaauuugauuucuuuguggaucuaaggaagagaagacacaaaaaggaauacaaaaccguuuuuuuuuuuuuuuuuuugagacagggucucggcugggugcgguggcucaugccuguaauuccagccagcacuuugggaggccaagucaggaaucucuugagcccaggaguuugagauuagccugggcaacaaagugagacccuccaucucaaaacaaauuaauaaauaaaaauauaaaagagaaaagauaguccgacucuguuccccaggcuguugugcaguggccugaucuugcucacugcaaccuccgccuccugugcgguccuaccaccucagccucucaaguagcugggaccacaagugccaaccaccaugccuggguaaugauauaaaaccaauugacaggggcuggggugcauacaggguuggauguaaaugagcuugcacauuacuuuggaucaucaguuucgaagucagcaugucguauauguguauauggauguauuuucuauguguuagguauuuccauucaccucugcugacugacccaauugggagguggcagggaggagaucgcuaguugacugggcuaauggaaagucaacuaaacuuauaaagccugaaauugggaacagauugugaggacaaaaaaaaagaaaagaaaagaaaaccuggaauucggcccggcacgguggcucacaggaaguagugggccaaauguuugagucucugauugauucgcuaagguuuguuguugucguuuagagacaggguuucgcuuugcggccugggcgggagugcagugaugcgaucauggcacaaugcaccuuugauuuccugggcucaagcaauccucccaccucagccuccugaguggcugggacuacaggcgcacaccacuacgccuggcuaguuuuauuuuuuguagaggugagguuucacuguauuacccaggcuggucuugaacuccugggcucaagcaauccuuccaccuuggccucccaaaguguuggaacugcaagugugagccaccauuccuggucauucacugaguauuuauugagucccuacuauuugcaaggcaccaaggagacaccaugacuaaaacaggcaaagauuccugccuuuauggaguuuauauccuguguguggagaaagaacagcaacacauaggcuaguaccauguauccuggcacauagugaaaugcucugccaaggugccaagaagggagggaggcugcaagugcuggaggggcaucgaagaaggccucccucaugagagauuggaggugagaccugaaggaggugaggagagcuaggcugaagaaagcauuccagauagcagggccuguagaugcuguguucuagagccaggguggggcaggaggggcugugcuauguagggguaggugggagggaugagcuggggagauaaagacagagcgauaccaggccaggucugagacagcccccugggcugucacugagacuuuagcuuuuugcagccuacauagcagggugacuaacaacauggucuguggugccacacugccuggguuagcauuccagcucugccuuuuacuagcugugagguggguuuuuuuccuuuuuugagacagagucucucucugucaccuaggcuggagugcaguggcgccaucucagcucacugcgaccucugccuccgggguucaagugauucuucugccucagccuccugaguagcugggacuacaggcgcgcgucaccaugcccagcuaauuuuuguauuuuuaguagggaugggguuuuaccauauuggccaggcuggucucaaacuccugaccuugugauucacccaccuuggccucccaaagugcugggauuaccagcaugagccaccaugccuggccuuuuuuuuuuuuuuuaaauacaguuucacuguguuccccaggcugcagugcacaaucaccagucacuguagccuuggccuccaggucuccagugguccuccuacuuuagccucccaaguagcugggaccacagacauguguuaccaccaccagcuaaaguuuuuauuuauuuauuuauuuuuugagauggcgucuuucucuguugcccaggcuggagugcaguggcgcuaucucaguucacugcaaccucugccucccugguucaagcaguucugucucagucuaccaaguagcugggauuauagguauacgccaugaugcccagcugguuuuuguuuuguuuuguuuuguuuuuuguauuuuuaguagagaugggguuucaucauguuggucaggcuggucuugaacuccugaccucaagugauuugccugccucccuccaucccaccaucccaauuuuuuuuuuuuuuuuuuuuuuagcuggagucucgcucuauugcccaggcuggagugcaguggcacgaucucggcucgcugcaagcuccgccucccggguucaugccauucuccugccucagccucccgaguagcugggaccacgggcgccugccaccacgccuggcuaauuuuuuaauuuuguuuaguagagacgggauuucaccauguuagccaggauggucucgaucugaccuugugaucugccugccuuggccucccaaagugguggguuuacaggcgugagccgccacgcccggcuaacccaauuauuuuuuauuuuuauuuauuuauuuuuugaggcagagucucacucuguugcccaggccagagugcaguggggcgaucucagcugggauuauaggcucucgccauccugccuggcucauuuuuuuauuuuuaguagagaugggguuuugcuguuuuggccaggcuggucucgaacuccugaccucaagugauccgccugccucagccucccaaagugcugggauuacaggcuugagccaccaugcccagccaaauuuuuuuauuuuuugaacuccuggccucaagcaguccuguugccuuggccucccaaaguauugggauuacaggugugagccacugugcccggucacuaggugugagaucuugagugagcuacuuaacggccuuaaggguccucaucuguccaguggagauaauaauaccugucccauggggcuguugugaucauuaaauuaguuaaaggacauaaaugugggugaaguaguugacacgguugaugcacaguaaaagcuagucuuuuacuucuaagccauauggggugagggggcauuggagagcugagcagaggaagccugagaucuuacuuagguucccaaaggcuguccuggcugccauguugagacuacagcaaggauggaaacaggccagucuggauucugcuguacuaagccagguaaaagaugguggugguguaggcuagauauguuugaagagaguugaugggguuugcugauggauugauuugaugugggcaugcaagaaauagaagaaugugggaggauaagguuggugaauuggaggcaaacugguauuuaauuuuagacauguuucucucguguguguguguguuuuguuuuguuuguuuguuuguuuguuuugagacaaagucucuguugcccauguuggagugcaguggucagauuacagcucacugcagccuugaccgccuaagcucaggugauccuccccuccuaagccucccaaguagccaggacuacaaaggcgugccaccauguccaacuaauuuuuguauuuguaguggagacgggguuuugccauguuguccaggcuggucucaaacuccugggcccaagcaauccacccuccuuggcuucccaaaguguugggauuacaggcgugaggcaccaugccuguccgacauguuacguuuuaagaugccuauucaagaucuaaguggagauguugacuaggcacuuggauauacaaagcuggaauucagacaaggaaguuugggcuagagaggaaaaguugggaguuaucaguauguauauguuuauauauuugugauuuuuuuuuuuuuuuuuuuuuuuuuuuuugagauagaguuuugcucuuguugcccaggcuggagugcagugccuugaauacugaauuagugaauauugaaccauugcuccuaggggaaauacaggguuagguuccugcaagccucuggucauauuuuguucaaccaaucaauauauaaccgaucacuuguuuuauguguguaucuguuuggagacaacuuacuugacauaauauuguugaaucauuaacagugaagucagccaggcgcaguggcucacgccuguaaucccagcacuuugggaggccgaggcgggcggaucaugaagucaggagaucaagaccauccuggcuaacacagugaaaccccgucucuacuaaaaauacaaaaaauuagccaggcaugguggcaggcgccuguagucccagcuacucgggaggcugaggcaggagaauggcgugaaccugggaaguggagcuugcagugagccgagaucgcgccacugcacuccagccugggcgacagcaagacucugucucaaaaaaaaaaaaaaaaaaaaaacucagggccaacagcacuauaauucgugucugaaugaagcuuaucuaacaccucccauaguucuugcacuuagcaacacuagaaagcacuucaguacuacacguggggacccaagaaaauguacaaaaaugaaaaaaauguggcacuaacugcaucacgagaaagccuuguuuagugugugucaagcaacucaauauucuugccacucuuaauuuugauuugaaaguaccacaaauacugauuuggggguuacagauaaauuuuagugaguaggcagauucacagauaaagacugaacagugaagacuauuugcauugaguguauauuuuauguuauguuauguuauuuuugagauggagucucacucugucacccaggcuggggugcaguggcgugaucuuggcucacugcaaccucugccucccggguucaaaugauucuuguuccucagccucccgaguagcugggacuacaggcaugcaccaucacgcccggcuaauuuuuguauuuuuaguagaaacaggguuucaccauguugaccaggcuggucuugaacuccugaccucaggugauccacccgucucggccucccaaagugcuggaauuacagacgugagccaccacgccuggccugaguguauuuauuuuacauauuuauauuugaacugaaacuuuuaugaaccauuuuauuuaaugcauucugauauuuuauauuauuucauuuuaauuuuuuuccaaacaaaacuucucacauauuuauuauugaaccaaccuacuauuguagagcuuauaaucagagaaaaaccauuuucucaacaaaguauguccaccuuuccagauaguggugacaguuucagcuugaugugauaagaugauagucuuacguguagacucaucucauguguaauuccuggcagacccagcuugguucuucuccagucccuccucuugggguuguagcuaacuguauuagcaauuuuguuuuauuuuguuuuguuuuguuuuuuugagauggagucucacucugucauccaggcuggagugcaguggcacaaucucagcucacugcaaccuccgccgcccagauucaagcgauucuccugccuuagccucccaaguagcugggacuacaggcgccugccaccacgccuggcuaauuuuuuguauuuuuaguagagaugggguuucaccauguuaaccaggauggucucgaucuucugacuuugugaucugcccgucuuggccucccaaagugcugggauuacagcugugagccaccacgcccagcccuguauuaccaguuuuaaucugaauccacuggugaaugggacgauuuugcuuuuguuucuuggccaggaauugcaugauccuggacauuuugugagaagauggugggagaaauaaucaacagcacacaccaugaugguggagaagggguggggggaagcagguagaggaacauguuuuucuguuucuuucauuuuugaaaagcuggggcugagcgugguggcucacgccuguaaucccaacacuuugggaggccgaggcggggaaucacuugaggucaggaguucgagaccagccuggccaauauggugaaaccccaucuuuacuaaaaacacaaaaauuagcugggcgugauggcaugcgccuguaaucucagcuacucgggagguugagacaggagaaucgcuugaacccgggaaguggagguugcagugagccgagauuaugccauugcacuccagccugggcaacaagaggggaacucuggaaaaaaaaaaaaaaaagguggucacaggcuauaauggacuacagcuggcuguuugaaaaacauaguggaggugacaaagccaugagauuggaugugauagauuacuucuggagggaaagagccaucauucuucccagggcagacucaggugcagaaagaagccugugugugaagaguuaaaaagccaaaguguggggugaggggacuggccuccucacgccucggcagggccaggccuccugccaaugcuuaugggcccggaucuccucccaggugaccaucuuggugcugcagggccggcuggaugaggcccgacagaugcucuccaaggaagccgaugccagccccgccucugcaggcauaugccgaaucaugggggaccugaugaggacaaugcccauucuuaguguacguggggguagcuuugcucugcugggucacaggagaugcgugauucacuaaauauaaaggguguggaugggaugacgucucauggcuggucucucccuuagcccgggaacacccagacacugacagagcuggagcugaaguggcagcacuggcacgaggaaugugagcgguaccuccaggacagcacauucgccaccagcccucaccuggagucucucuugaaggucugggaagcaguucagauugcauccauguuggcuuccuaugggggcuguggcauccagugcagcaguggcaggagcuugguccuccuuggauagggcugucugucgcucugccgugauggcgagagcuuucagacuaguugaaauccggugcccuuagcugagagcaggagcauuauggagaagguaccccugagaggaggacagaguucagcacaaaugucucuccucagauuaugcugggagacgaagcugccuuguuagagcagaaggaacuucugaguaauugguaucauuuccuagugacucggcucuuguacuccaaucccacaguaaaacccauugaucugcacuacuaugcccaggugagugagcucggggugggcaaggguggggguaggaguccugggggcgcccugaugggucauucucuuugaauuccucccugaggaacaggaagacccuuuccuuuggcccuuagugaaagaacaaggcaccuucucugggguucguuauacagcagcccugccugccccgagucucugcuuccguccucaggauugagugucucaucaccuuuccacaguccagccuggaccuguuucugggaggugagagcagcccagaaccccuggacaacaucuuguuggcagccuuugaguuugacauccaucaaguaaucaaagagugcagguaggaucucucccaccccccacuguaaccauuuuuagguguacaaauaucaccaccuugcguuucuagaguggccuguuccuuccuuacccuucuucccucagaccugcuaucuuaguccaucucacgcugauauuacagaauaccugagaccagauaauuuauaaagaaaaagauuauuuucucaccguucuggaggcuaggaaguccaggaucagggcacuggcaauguugcuggugagggcugcucucugcuuccaacauggcaccuugaacacuguguucucaugugguggaagggcaagaaggacaaacucccuucaucaagucgcuuuauaagggcacccaaucacauucaugagggaggauguggccuaaucaccuccuggccuaaucaccucuuagaggcccuaccucuuaauacuaucacauuggcaaaacugggguuuuagaggggaucccuucaaaccauagcaucugcuccccugcuugacuugccacagguagauaauggcuuuucucugggugagcuuagggacuuccuggaggcuugagggcuaccauauacauaacuguuuccauuucagggauguucauuuaaaauaacaucgcgggaaacuacuuugacauuuaaaaucuagaaaaagccagcaagccuguuucuuggcaccuaauggacaccuuaugggauggcguguuccaagagucucacuccagugacgugagcuaccgaaccacugggcuucaggcuggguauuauucagaauuuccagcccucuauccaaaagaggguguucuaugauugcacugaaucuuuagcaaggcaggaaagggagugccaaacauaaucaaucaaagguaaaccuuuccagaacucuccauauaugguaagucagaaagaagguccccuuccuuguugugcacccuggauggugggcauugcacugaagacgugcugggaagggaggaaguggguaauggcagaagauggccuugaucaggugucagauucacugaccucaacuggcuguuuguagaucugggcaugggaagaguuuccuucgcccuaccugcuuuucuuguuuuggccaaaagaaugccagggcuucaagaaaaugauacuagauuuggggaaugaaaaacaaguuuuuuguguguuuguuucuggguuuuuuuuuuuuuuuuuuuuuuuuuugagacagaguuuugcucuugucacccagacuggagugcaguggcgugaucuuggcucacugcaaccuccaccuacuggguuccagcaauucuacugccucagucucccaaguagcugggauuacagguguccgucaccacgcccagcaaauuuuuguguuuuucaauagagacaggguuucaccauguugccuaggcaggcuggucuggaacuccugaccucaggucaucugcccaucucggccucccaaagugcugggauuacaggcgugagccaccgcgcccugccaaguuuuuuuuuuuugaaacagggucucacuuugucacccgggcuggagugcaguggagugaucucagcucacugcagccuugaccuccuggguucaagugauccucuugccucagccuuccagguagcuaggacuacaagugugcgccaccaugccuggcuaauuauuauuuuuuuuuuuggagagaugagguuucacuauguugcccaagcuguucuugaacuugugagcucaagcgaucugccugucuuggccucccacagugcuaggauuacaggcguaagccaccaugcccggccugaaagucaaguuuugugucaauauuuucacaggccuguaaacauugugagaagucccugcauggaagaauuagugagaauaacuuaaaaacacacaaacacaccaucguuuggcuuuguuggugucucugcccauaguugaguauucuaaauuuccuguguuauaacagugagugaguuucaccagggcuuccuaauuuauaagcccuguaucuggauuuuuaggaauaaaacagauuugagcagaagaagucuguuggaugcagggaguauaaaaggggaaagcauccugcuguuuccaguggcagaagagaaagagaaguaccaugaagaggggugaacaacaucacucucgugccggacacagacaaggaaugauuaggcuugcagucccccagucucagccucucuccacucucacaagcaggaagggaucugagcucuguuagugggaaaucuuggaguuugcauuucucugaucacgaggcuaccuccuauccuguuuugaaagaggaacagaaaagcagagcuugucccaggaauugugaaaugggcugcaaugucuucagaggcaguagcaguuuuaggaagugugcccuccuggcucuggggaaagguugaauuggggucuugugggcacuuguuuucucaugggauguaucagucagacccaugcacaguucugggcggcagggaagugugucucuuucuggacuugagccagugagcuguuggcaugccuuuuuaaaggcauuagaaaaaagguuucuuucuuuuuuuuccuuuccuguucacaccaccuucauaugaacauggagaagggagguuucuaagugggccccugauuuacuccuaugucaauaaucgugccagacccuaaggggcagaaaaggcagccaggggauccugacucagaggcuguaguucgucagcccugcuaaagggccagggguuugucucucagugccugggugggcaugcuugacugcuaaccccuuagcugaaaggagauggcaggaguccuccacagggucccuucuucccuccuggcuuacagcuuccucugaagacgggccaguuccuugcugucuggcaagaggaaacagcuggggugcacuucacugggaguugggcaagaugucggcaguuuccuggugcccuucaaguccuccaaaaguaucgagcuaaaaggugacaagucuuccuucaauaaccaagaagaguuccagcuuaaugucugcugaaucuagaaucuucugacuuguauuuuggcccagcccacaaucuuggaugcagggugcagcaguguuuacaaaccucacaccccauuuccagaauagcagguagaggcacuggagcuuugauuacuccagagcccccaacaagcaagauggggccuggguaaggaguugacagugaccuuaguacaggacaaacagcucauuuggggcuacaguugcuuagaggggucaccuucaccguagcuggucuucccaacuccgcagcguucucucguuuucagcagagggcuacuuuggagcugauaauuaggccuuucuugccuugaauguuaaggaugcccaccugcucugugucucggcugcucacucagaauccuucagagugagagagagacagagugagagugggagugugugcgugugugaucuaagaccuaacugugugguucaggccugcugggcccuguagagagaccgugguggcuuugugcagcacuaugucuggucuccgucacuugaguuguguuguuaguucucugcucucagugcuugcugccuuccagccuuggaggcugcuggauccuuugggaagacaccgggcacugucucagcccuuccuuccaguuguugguggcuuucgugcaggcuaaggcuuuggcucccuuagccuggguccccuauagccuuuucacuggcuucuccaaugguuucgacauaaccaucagcuagaaaucuggguagcaacagcuguuuugggaagcugagguguccuuuccccuggcccagcccacucccucccauuuuuuuccccagcuuuauugaggugugauuaacaaaguaguauguauuuaagguguacaaaauuuuuuuuuuuuuuuuggagacagagucuugcccugucacucaggcuggagugcaguggcacgaucucagcucacugcagccucugccuccugggcucaagcgaucuucugccucagccuuccgaguagcugggaccacaggcacacgccaccacgcccagcuaacuuuuguauuuuugguggagaugggguuuugccauuuuggccaggcuggucuugaacuccugagcucaagugauccacccgccucggccuuucaguguugggauuacaggaaugagccacugcacccggccaagguguacaacauguuuuuuguuuuuuuuuuuuuuugagauggagucucacuuugucgcccaggccggaguacaauggcgcgaucucgucucacugcaagccccgccuccuagguucacgccauucuccugccucagccuccagaguagcugggacuacagguguccgccacaacauccggcuaauuuuuuguacuuuuuguagagaugggguuucaccguguuagcgaagauggucuugauuuccugaccucaugauccucccaccucggccucccaaagugcugggauuacaggugugagcuaccgcgcccggccaacaacauguuuugauagauguauacauugugaaauuaagcuagugacaucugucaccucacauagugacccuuuuggugugcguguggugagaacauucaaaagcuacuuucuagcugggugugguagcgcaugccuguaaucucagcuacugaagaggcugaggcaugagaauugcuugaaccugggaggcagagguugcagugagucgagaucucaccagugcacucccgucugggugacagagcaagacuccaccucaacuacuuucugagcgauuuuuuuuuuuuugagauaugguugugcucucucacccaaguuggagugcgguggcgugaucucggccgauugcagccucugcuucccaggcucaagcaauacucccaccccagcuucucgaguagcugggauuacaggugugugccaccaugccuggcuaauuuuuguauuuguagagaugggguuuugccauguugcccaggcuggucuuaaauuccuggacucaggugaucugccugccuuggccucccaaaguacugggaucacgggcaugagcuaucaucacgcccggccccaucucuuugagggacaggacaugugggguuucuugcucacccccacucuugugggacgcggccugugcccugauuuuccuucuugccuuggugucugaaucugcagcaucgcccugagcaacuggugguuuguggcccaccugacagaccugcuggaccacugcaagcuccuccagucacacaaccucuaguaaguggccgggaggcaccgauccuccucuucuuaccaccaggcccccgaggguggugugaacugaaugccugaaagggagguugggcuaagggggcccugaacagggcaggccaggagucuuggucuuuuguuauguuuuauuccaguuucgguuccaacaugagagaguuccuccugcuggaguacgccucgggacuguuugcucaucccagguaggaaggaccccaugggugugggcuaugcgggugcucuucagcaugcgggugccauuggagcuuggacuguucucucccaguuggcuccuugaaggcuucggaagggucagugaaagggagcuguaggugccaguccucggagccaugaggcagcaccucaugucuguccuccucgaaccuuugcagccuguggcagcugggggucgauuacuuugauuacugccccgagcugggccgagucucccuggagcugcacauugagcggauaccucugaacaccgagcagaaagcccugaaggugcugcggaucugugagcagcggcagaugacugaacaaggugagcuggcccugcucccagccuacugucugugggacgcaggagucaggggauccugaggucacacuuuaugccuaccccagccauccuccuccucacgagccacacuggagacguggggcuguggacgccaagagguaaacuaagagaugggauaauuacuugggagggacaggaaagcuagggauccacuggaacccagacaaaaucuacacgccaucuggaaaggccugagccgccccuuuucucacacacuugauuccacgaggucagggcugggguuggcgcuguuucccuguccagguggguugcuauugcuagcucagccuggcucaauggggaagcagugcuggagguggcuccagaaaagcagagagaguggaaugaggaugaccaagucugccccuucauuucuccccucacuguugaguaauguaaacaugaguuauuacccugcagagaggcaguugcauguucacgaccauuucugaaagcauaugguauucacgauccacaggaagaugugauuugaggcaucuggagagguaauagaagagcugacacguagggagaaacacguagggagaaaaaaaauagaagagcugacauguagggagcaacguuuugcuccccuugaagccacacacacucauagagccagucuugccgugaugggcacuuacacucuuagcagaucccagacacuguuaaucagccgaguuuccagcucugccgauccagcugcauuuagagcccaaagaguggcucugcgguggagugaggcugugaggccacuccgguccccacagggcucaggaauggagugauuuguggagugaaagccguuuaccuuuucuuuuccccugcaaaguucgcagcauuuguaagaucuuagccaugaaagccguccgcaacaaucgccuggguucugcccucucuuggagcauccgugcuaaggaugccgccuuugccacgcucgugucagacaggugggugccgcuaguguuggcuucccagggacugggugguugaggugggccugagacugcugcucugaucucugggccgggcccugcagguuccucagggauuacugugagcgaggcugcuuuucugauuuggaucucauugacaaccuggggccagccaugaugcucagugaccgacugacauuccugggugagucucuggguuuugugcccugugcuuugggcacaaguggguaguuggggagguuggagggaucacgucagacuucucccagcgcuuccuucauguauucccauugcaucaguggucccagaaacauccuccgucauguccaggaucaugaguuuggcugucacaucuccuuagugccuccauguuuguuuguuuguuuguuuguuuuucuuucuuucucucuuucuuucucuuucucuuucucuuucuuucuuucuucuuuucuuuuauuuuuucuuuuuuuuuuuuuuugagacagaaucuuacucgcucuguggcccaggcugccaggcucacugcaaccuccaccuccugacuucaagcaauucucgugccucagccucccaaguagcugggauuacaggcacgcggaaccacaccuggcuaauuuuuguauuuuauuuauuuauuuuuuggggacagagucucacucugucacccgggcuggagugcaguggcgugaucucggcucacugcaacccccgccucccggguccaagcaauucuccugccucagccucccaaguagcugggacuacaggcgcacgccaccacacccagcuaauuuuuuguauuuuuaguagagaugggguuucaccguguuagccaggauggucuugaucuccugaccuugugauccgccugccucggccucccaaagugcugggauuacaggcgugagccacugcgccccgccuaauuuuuguauuuuuaguagagaugggguuucaccauguuggucaggcuggucuggaacuccugaccucaagugauccgcccgccucggccucccaaagugcugggauuacaggugugagcuacugugccuggccagugccuccauguuucuucuuuuuuuuuuuuuuuuugagacggagucucacucugucgcccacgcuggagugcagugguacaaucuuggcucacugcaaccuccaccucccggguucaagccauucuuccuccucagccuccugaguagcugggacuacaggugcaugccaccauacccggcuaauuuuuguauuuuuaguagaaaugggguuucaccauguuggccagguuggucucaaacuccugaccucaggugauccaccugacucggccucccaaagugcugggguuacaggcauaggcaugagccaccacgccuggccuagucaaucucuuuuaauccaugacucuuguuauguauuuugacucugauguuuccccagauuuggcucuucggaguucuuccaagucuguuuugaaugcucuuggucugcaucucauugggaccuaugaguuuggagacagaaaaaaaucuccugcuuuguggaguggcuggucugagguuuuucuucuccuguuuagggccagggugacuuuuguaggugucacuugggcaauuugggggaauaugcagguuacucagugcucuuguuucgccauaggaaaguaucgcgaguuccaccguauguacggggagaagcguuuugccgacgcagcuucucuccuucuguccuugaugacgucucggauugccccucggucuuucuggaugacucugcugacagacgccuugccccuuuuggaacagaaacaggugaagguugcagcagcagugguuuucuuugcuugucagucccugcuagagcuuaguuguauagcuguugccgaugugcguguuuccuccuuugucguucugccugugcgcguguauuccccuuagcgcccucucugggauuccagacucacacaggaaacaaacacugcuugauuugaaaugagguauucguauacaaagcacacuauugcgaaggguaugaaaggaagaacguccgaacaugggccccugccccaaccaaugcaggccagggcugggggcagccaagcaaggcaggcucucuucccuaggugauuuucucagcagaacagacuuaugaguugaugcggugucuggaggacuugacgucaagaagaccugugcauggagaaucugauaccgagcagcuccaggucauuuucacuuuuggguugaugguuccacauggaggugggaaaaggcucccucuaucucaggcuuccccuucccuccagaaacacuggcuccuauggacacaugugccucuguuccccuuaaccuguguaauucacacaccaccuucuuuuaggagaaaaucagggauucuaguguucucaucucuacauuuuguucuuugcuguucaucauuuccaguauggcccuuugguauugcuuucuuuuacaucgauaauuugcuggaagcuacuaugaauguuaagugcccucuaccuuuggauuagcuagacccuucgggagugugaaagggcuccuuccugcucuuagcucaugcuggcgcucucugcuuugcaggaugaugacauagagaccaccaagguggaaaugcugagacuuucucuggcacgaaaucuugcucgggcaauuauaagagaaggcucacuggaagguuccugagaacugcuucaaugugguaucuuuguauggcaauguauauagauuuuuuuaaaagaauaaauguuguuuugcaaauguag

SEQ ID NO: 192322 - RNA, 6458 nt, Homo sapiens
gcccggcaagaaaucauguuuauucacauuccccaccccaccaccugagagucacuuucacuccaagcccugggccugacgggagggggccaaagaggggggcugccuaaggcagggcccagaccccacagugugggccucuggagcugugucuuuacucuugcugccgaucaaucccaugcucugaaaugcgcacacucuggcuccuuaguagaugccauaggugggcucaugacugucccuguaccgguccagguagcgcaggggcugccggugggggaagcgcuucugcuuggggugguaagggggcggccgcacgaacucaaacaccggcucccgcaugucugcaagaagagugagggguacgggguggucugcuggccugcgcccccucaggcugaggccugcccaccagggaccugccgcagccuuccccuaacaaagcuucucccuggcagggcaggcgaggccugggagcucaggcccacccagugccccagccccauggcccuuacccagaagcugguggaagauguaggugacggagucaucccagcggcacuggaagaaggacaagccggcuggagucaugguuucuugguguuucuuguagaaaucaaaagugcggaagguccgcugggccagcugauagcuaugagaagauagagagcguaugagaguguggaguggggcaccagagccccucaccccgccaccccaacagguaacccugagaggccccugggagucugcuagcacccuauccugcucuucugccagucucaaggcugaggucaagagagaacugagcaagagugaccguuccaggggagcuggccugaggccggguuaugugugggugguguagauuaccagggugaggggcgugcguccucagagaagucaaucggcugguccugcuugaagagcaggaaggcaagacgguggaugccggagccucgggcagggaagggggggagguagggacacgucaccuguccuucagccacccgguuacccgggauguugguucugggaggaggaaagucccgguuaauuaccacuccagggaggcagcaggaguguccccucagcuccaugcacacccuagaggcugacaugacucccugggaggacagcucuaagcaucucucuccugggacagaggaggcagccaagcucugugaacgccgggacaugcugcaaauacgggaagcgggcuggaggagcuccgagugggggacagggcuccagagagcaucagcuugacagcaaggccaugcagccgcuuccaggccccgggagccgguggguccgccacagucacugaggcuagaaagccaggccacuuuuggcugcuuuucccucugcguccugaagucuccaggaccucgucagggagugugugcccagccuggcacaggggcggccaacgccucaggcacaaauccccagaggguccugccgcauaggcugguaacaguugaauaaaaaugacggaaaccagccucccagucacuguccccaguuaaccagaaggcucaaaguuggggucacuggccugaccucugcccccuggccugguguucagagccaaaagcuaccaagauggaaggccgcccagucugggcccagggaaggagcgcccagugguucaaggagcaccugggggacgccacagcugcuaggccucucccgcuccuucucccacgugacugucacaguccaccucacgcugaguaaggcauguggugccauuaucccaguuuuacaggugaagaaaugaguuuagagacgaagggcccaggcaugguggcucacgcuuauaauccuagcacuuugggaggcggaggcgggcagaucgcuugagcucaggagaccagccugggcaacauggugaaacccugucucuauaaaaaaauacaaaaauuagcuggguguagugguuugcaccuguagucccagcuacucaggagacugaggugggaagagcaccugagcccaggaguuagcggcugcaauuagccaugauugcaccacuguacuccagccugggggacagagugagacccugucucaaaaaaaaaaaaaaaaaagaaaagaaaagaugaggaggcuuguggggacugaccgaggccuacugcaaacuuugucuccuguagcugucuucaaguagacacguggaucccagggccccuaacacccucaggaggcagagguggcaggugaauucaaggucccauggguaguccaugaaacucaggagcagcucaguccaggcucccagcuccucuucccgccugggcagcacccccuacccccaguacuccaguacucacagcagccaguggagguacucagcaucuggcuccagcaggugcccaucugcacaaaaacacaccugcugaccacggcccagccgaccacggcccugccacccccucccuuguuaggagccagcgcuggagaucuccaccuggccccucccccagccccccagggcccuggcucauaggaggugagcggggcaggaggccuggugagccccagacacccacccaagcuagugaguagcaacguccacaaggagcccucuucugccucauaggucaccucuggcgcuugggcagccuggcagggugagaaggaagcugucagccccaccagggacaggccagcuguugcagggagccuuggagaaaggggugcccacucugacccaaaagcccuugacaaccccuggcacaggcaggcaggcaaagggaugcguagagaagcagcccugcagaguugccuguccaggcaacaaccacaaaaacgaacaugugccaaggccgggccaggagggcacaccacagacagcaggcuggucacaggaaugugcuaagacagagccucuuuuuccuucauuuuguucuauuuucuuugaaauugucauggugucgucuuccaggaaaucaaagagacagagaacaacaaaauuccaaacccaggagugucugugacacugagaugggaugugucuguguuugcacagggcagggaggaggggcacaagugagugguuaccucgguuggagucaccucauugccacaguacacaggcaucaggucauccucacccacagcguaggccacgugcagggggacucggggcacaaagguggcaccguggaacaggucucgguagaggccguaauacucagccagacgcugcuugugguaggggccacagguccucucccacucggcccgcacggcauccagcgggacacuggcuagacaggaauaaggccaguugggauacggggguggggggggcagggacacacccuguaccccaacucugggauggccccuccccugagaaggcuuaccugugcggaggcgggcagcccgcuccucuuccacauuggcccgaagcuccuggauggccuguuuccguuccaguagcuguuggguccgggagacuuuggguggaggcagcccaauaucaaucuucucuuugggaucuggagugggaagaugugugggaaaaacagggucaugacucacugcagccuuaaccuccccaacucagucuccugaguagcuggggcuacaaguguacaccaucucaucuggcuaauuuuuguauuuuuuguagagacaggguuuugccacauugcccaggcugguaugaacucuugggcucaagugaucugccugccucagccucccacaguguugggauuacaguagugugagccacugcgcccagccaugguagcuaauuuaaaaaaucugagagaugggaucucauuauguugcucaggcuggucucaaaacuccuggucucaagugauccuccugccucagccuccuaaguagcugggauuauaggcgcaagccacugcacccagugagggggcgggcacaucuucuugguuaaacugccugucccuaccuaguccucucauucugugcuucaagcucugcugcucaagcuuucccugugauucacagaauuaaaacauacugugcagucuacuucccagaccugaauaggauguaacugggaagcaaaucagauacaacuugagguuguguuuuucuuugagacagaaucucacucucucgcccaggcuggagugcaguggcgcgaucucggcacacugcaaccucugccucccggguucaagcaauucuccugucucagccuucugaguagcugggauuacaggcgccugccaccaugcccgacuaauuuuuuuuguauuuuuaguagagacgggguuucaccauguuggcuaggcuggaggcuguguuuuucugauccccaaaccaggucacaguuuugucuaggucaugggaaacugaagucaaugguccuuccaauuauaguugagaucaccuccaagccuguucacagguggcuaugaacacccagcuguccuagguagagugaaugacugaugcuagaaggacuuauagaagugcuucucggccaggugcuauggcucacgccuguaaucccaacacuuugggaggcugaggcagggggaucacuugaggucaggaguuucagaccagcuugggcaauauggugaaaccccaucucuacuaaaaauacaaaaauuagcugggcgugguggcgcaugccuguagugucagcuacuuuggaggcagaagcaggaaaaucgcuugaacccaggaggcagagguugcagugagucaucgcaccacugcacuccagccugggcaacagagcgagccucugccuuaaaacaaaacaaaacaaaauaauaauaacgaaaacauacugagcccucaucagagauggcauuaggcaaaaaugccaaugaauugccucuuuuaauccucacagcaauuuuguagcaaagacacaauuauuuuauuuuacaguugaaacaagcucaaggacauuauccgagaggcugagcuaggauuuaaaucgggcuauuuagauuccacgcuugugccuuuaaccaccacaaaacugccucuauaaaugcuaaagaaaagaaaagaaaagaaaagcauauacuccauaaauuguaaguuccuuaaagguuggggucuuuuuuuuuuuuucuuuuugagacggaguuucgcucuuguugcccaggcuggugugcaauggcgcgaucucggcucaccgcaaccucugccuccuggguucaagcgauucuccugccucagaggccucccgaguagcugggauuacaggcaugcgacaccacgcccaguuaauuuuguauuuuuagcagacacgggguuucuccauguuggucaggcuggucucgaacucccgaccucaggugauccgcccgccuaggccucccaaagugcugggauuacaggcgugagccaccgcgcccggccagguuggguucuuuuuugagucacccugcccaggccuuuaauuucauucagcaaaguauugcacauguacauccuugcacuguucgggugcaaggauccaauggagggcaagacaagcaggaucccugucaacagggcgcuuacaaucuggggagaggcagcgcacagucagaaugcaguguggccagaguuaccuacagaguauuugaggcgcacagaacggcaucccaauccggaaagucagguggucaagauuuuaggagcaaauauuuuaggagcuggaacucuaauaguagggggagcgaauuuuccaagaaugaggugcagaaggugugaaaaauccuggggugauuaagcugccgauagcgcacacaggucugcaggcaggcccucccagcguccccagcauccacaagggcgccggcaaggcucgcccagcgcccggggaaaacgccggcgggucccgaguuccccgggcgguggcugcagccccugcuccagucgccccgcaccugucuucuccccgaaauacucucgguagguccgccaccagugcggggccugcgccuccugcucugcucggcgccgguagcggucgaagcuccgguacuucuccagccgcuccagguugcucaagucgaugucacuguugggcaucggccccagcggggguguccggcggcccaggacggcugcgggcagagagaagacguaaggccggcgccccacagcucgggcgacagcccccccccccccccccgcagagcugcccaccccucacccgaggugcugaagccccgccaucuccgacacucgcacagcgcggcucgccaccagggcgccgccaucuucccuccggccugcgacacugcggccgccacuaggacccgggcacagguggccagcgcggugccugagcgcaccacagcaggccccgccccuaggcccgcccccgggcccgcgcugcggagcaggccucagacgccugucccggaggccccugcaccgucugccucgggcgcagguggaagguggccgcggucuguagacgcccggcuccggaagugcccguu

SEQ ID NO: 192323 - RNA, 33417 nt, Homo sapiens
cccuaucccgucuugcucugcggcgcaggggcaagauggcugcugagaagcaggucccaggcggcggcggcggcggcggcaguggcggcggcgguggcaguggcggcggcgguagcggcgguggacguggugccggaggggaagaaaauaaagaaaacgaacgcccuucggccggaucgaaggcaaacaaagaauuuggggauagccugaguuuggagaguauccuagaguaaucgggccuaacucgcaaugauuacgugucgaacuggagggcugggggcgggagaggcggcgggucccgacaaguccuggcaggagaggccgaggguugcaguuucucucgcccuuaccuuuuggugcucagaauuccggggggggucugucucucgacuagucuuuccucgugucccccucgccguccuggcuagguccguuucuuccaguggcacugggauaucaggcagguuuccccuggugccccgcaguuguccaguuggagggcuugugaccaagugacaccuugagcaccuugcuuuggcaccuugagccacugaacuggggagaggaaacugcagucuugacauuuggcuuaauacucuugucugacagucgucauagacugaguaguaaaaccuacagcucgauacuuugaaaguggagguaaagauugacucaggaaaagcuuguugcccauuuugauuguaaguuaccguaguuaauaucgauugugucauuuuuuucugaucggucuguaggcauuuuaucuugcugacagucauucauauaagcuggaggaaucgguuucuaguuuccaucaguguguaucucaaccaagugcuugugguacuaguuugugaccuuuugaaaugaauaacaaauggagaaaacguaggcgaguuucugaaauaacacauucaacuugacaucuuaaugugcuuaaaguucucaggcgcuuggaguuaaauauuuugaauuacugguaauaguuccaaguagacgcuagcgagcccugauuuuacugagaccuuuauaucucuuugucccguuuuaguaauuuaaagaguccuuuuagcguucacuauuuuaaaauaugucucuagagaaguguugaggaaacauuaaaacuauaccuauauagaugaaggucauuggacuuucuaaagauuaguacauaaucuuaaauauuuuaagauuauuaaaaggagaaucuggccauucuucuuuugaaagaaaaaccuuaauacuuuuaugcaaacuguagccuagcuugguugacaugugcuaaucauagacucucuaagcaucacagcuguuaaggaaaguuagauuuggcagguguuggagauuaugcaaauggaggcuuaguacaugucauuuauaaccugaaucugaaugaauaaaauguggggucuagguguuaauuggugugaagcaccccaauuauagucagcauuuagaauccaucagcuuaauuuaaacuggguuuuggcaguuuccaguggccaguagugcccuccuuuuucaguuugcaaguaguaacaguucaggcaaucaguuuuccuguagguuagcccuguccugugacaagauagauauugaaaaugguuacaaaagaucucaccaguguacuaaauauuucacaaauuugugugugugugugugugugugugugugugcaugugcaugugugacugaaucucacucucaccuaggcuggagugcaguggcgcugucuuggcucauugcaaccucugccuuccaaguucaagcgauucuccugccucagccucccgaguagcugggauuacaggugcuagccauugcgcccggcuaauuuuuuguguuuuuaguagagacgggguuucaccaugcuggccaggcuggucuugaacuccugaccucaggugauacacccgccucggccucccacagugcugggauuacaggcaugagccaccguaccuggcuauauuucacaaauguuuaauguguugugguuugacacagauauagacugaugguacagguuuugauuuguuuggauucuugcuaugguaagauuuuccuuaaucucgacucuaguucuucagauuauuaaggaaucccagcagcagcaugguuuacggcauggagauuuucagagguacagguuaguaucacauacaagauguuuggaaaucauugugggacuugcuuugcuuuuguuaauauccuguuuacucugcuauaucagcaaauaugcuagaaagucuagagcauuguuuuuuuuguuuguuuguuugcuuuguuuuuuuuuuuuuuuuugagauggagucucgcucugucgccaggcuggagugcaguggcgcaauguuggcucacugcaaccuccaccuccuggguuccagcgauucuccugccucagccuccugaguagcuguuuuuuuuguuuguuuguuuguuuguuuuuugagauggagucucacucugucacccaggcuggaguguaguggcgcaauccuggcucacugcagcccaugccucccggguucaggugauucuccugcuucugccuccagaguaccugggauuauaggcaugugccaccaugccuggcuaauuuuuguauuuuuaguagagaugggguuucgccauguuggccaggcuggucucaaacuccugaccucaggugauccacccaccucagcuucccaaaguguuggaauuacaggcgugagccaccgugucuggccuauuucuuuuuuuuuuuuucuuuuaaauaaucuauacccugguagcuuugauugagaugcugaaguaguauuuauuuuauuuauuuuugauacggagucucacucuguugcccaggcuggaguauaguggcgcgaucucggcucacugcaaccuccgccucccggguucaagugauucuucugccucagccuccugaguggcugggacugaaggcacaugccaccaugcccggcuaauuuuuaguagagacaagauuucaccauguuggccaggcuggucuugaacuccugaccucaggugauccaccugccucagccucccaaaguacugggauuacgggugugagccaaugugccuggccuauuuauuuauuuuuauuucauuuuauuuauuuacuuauuuuuuugagacagagucuuugucugucacccagucuggaaugcaguggcacgaucucgguguacugcaaccuccgccuuccggguucaagcaguucuccugccucagccucccgaguaccugggacuacaggcaugcaccaccaugccuggcuaauuuuuguauuuuuaguagagaugggguuucaccauguugcccaggcuggucucgaacuccugaccucaagugaucugccugccucagccucccaaagugcuaggauuacaggcgugaaccaccacgcccggccccugaaguaguauugaaauaucauuuuguauuguaaauuaugugcuguauuacuuugacuuaaagguuggugcaauuuuauauauauauauauuuauuuauuuauauauauauuuuaaacuaauuuagucaaaauguauguauugaacaucugcauauuagacacugugguaaggcauuguggaaaauuuaaaaaugaaauccuagcuggaaugguggcacaugccauagugccaguuacuugggaggaugaggcccgagaauugcuuaagccccggaguucgagcccagccugggcaacagcaacauagugagacucugucucaaaaaaauaauucucccugcacuaaagggauuuauauuaguggacaacuaugugagaacauaauuauaaugucacacacuguaauagaaggaagaauaaagagcuacaugagcauagaggaggaggcuuggcauagaggugacauuuguagugcuucuuggcgauaaccuaauuggcuuccucacuuuucuucagaccugccugcaguucuuucuccauauguuuggugucaucuuagucuuccucaggaugccccuuucccugcuuucuuuacauuuauuagaauccuccucauucuucuucuucuucuuuuuuuuuuuuuuuuucagacacagucuugcucuguugccuaggcuggagugcaauggcguguucucggcucacugcaaccuccaccucccggguuuaagcaguucucugccucagccucccgaguagcuagaauuauaggcgcccgcccgccaugccuggcuaauuuuuuuuuuuuucgagacggaguuuuacuguuguugcccaggcugaagugcaauggcgcaaucuuggcucaacgcaacccccaccuccugaguuuaagcgaauguccugccucauccucccgaguaggcugggauuacaggcaugugccaccacaacuggcuaauuuuguauuuuuaguagagacgggguuucugcauguugggcaggcuggucucgaacucuugacaucaagugauccgcccaccucggccucccaaagugcugggauuacaggugugagccacugcacccagccccucauucuuucuaggccccgccaucaguccacugcagcugaaggugcuaacaagagaaugauuacccauguccuuucaacuugacauuugccuuguuuucuugguugccauuuucucugcaugauucuacucaauuuuaauguggguuccuugaacaugggcacuguguccuccaucucuuuguguuuccuauaauaccaaucauauugcccuccauguuuuaguuguucaauaaauguuuagggccggguaugguggcucaugccuguaaucccagcacuuuggaaggcuggggugggcggauugcuggaguccaaggauuucgagaccagccugggugacauagugaaacccugucucuacaaaaaguacaaaaauuagccauguguggugguacaccucuguuggucacaucuacccaggaggcugaggugggaggauugacugagccuggcugcagugagccaagaucacaccacugcacuccagccugggugacagagccagacucugucucaaagaaaagaaaaaaauguuuggaagcugauaugugauaauucuaguaaccauaaguauaauaucccaaaccauugacccuugaccuugccuuauugcagaauuuauuauucaaaauacucucagcuuggcugagugaguuuuguuugugguuucuuacaggggcuacuguucccguagacaaagacgucuucgaaaaacacucaacuucaagauggguaacagacacaaauucacagggaagaaagugacugaagagcuucugaccgauaauagguauugacugcuccaugcuaguugcaaauuacuucuugcuaauacauuuauugaacaaugacgugguagacuucaugccaaaccuuuuaauuaucucugugggcugggcauuguuuacuauuccuguguucuaaggcaaggaaacugaggcucaaagagauacauuagguuguucaagaacuguguuggggccaggugcagugguucacgccuauaaucccagcacguugggaggccaagguggguggaucaccugaggucaggaguucaagaccagccuggccaacauggcaaaaccccuacuuuacuaaaaauauaaaaauuacccgggcaugguggcaggcgccuguaaucccagcuacucaggaggcugaggcacaagaauuacuugaacccgggaggcagagguugcagugagccaagaucacaccauugcacuucagccugggcaacaagagugacacuccaucucaaaaaaaaaaaaaggagggggugagauucacugucucagcuuuggagccccccuuccucugucucuguacagggaagcuucuucucccuucuugccuauuaaacucugcuuuuuaaaaccaaaaaaaaaaaaaaaaaaccuguugggauggcaaauguugaagucagugauuagaaucuaauugauuauuagguaagguuucuagaauauaaauuucaaugucugaaacuagaugcauauaucaauauaucuuaaugaaauugagugguugagugguguguuuuuuuuuuuuuuugagacggagucucacucuguugcccagguuggagugcaguggugucgucucaccucacugcaacuuccaccucccggguucaagcuucuccugccucagccuccggaguagcugggauuacaggcacgugacaccacgcccagcugaguuuuguauuuuuaguagagacaggguuucaccauguuggccaggcuugucuugaacuccugaccucaggugauccacccaccucuugccuuccaaagugcugggauuacagacgugagcuacugcgccaggcugguguguaaauuauuauagaagagucuuguauuucagugcugaauacaccagugcuuggcauuugcugaagaauuuuuagucugucaggcaacauguagucaaggcccccgggucuuccucacaguuacgggccaaauuacgcugcugccaccuuuuguguaaaugaaguuuuauuggaacccagccacgcccauucacauagguauuguuuagagcugcuuugugcuacaucagcagaguaguugugacacacuagauauagaaggagaggaggcaugguccuugaaccucauugacuuucaucuuauuggaaaauguuggucagugcaaaccagggaaugcuacaguaaaagugcaauguuguauaucauuuacuguucagcauucuaaagccuuggaaaggagacuugagcuugaaggcuuuugacagggaagucaguaagcccacacagaggaggcuugaccuugaaggauuugugagagugaagaacauucugugucgggggaagcagcaugcccugguauccgugcaugcagucuaggaacuguaaagcucuggacacuuguuagcugcuacucaggcagugaaaagguugugagcuugguguguacagucagaaagcuagagccuggagaccauaauaggaugcagcaggauguagugauuaaaucucaugagaaccaguugggagaaaucuggacucucccuuuuuuuuuuuuuuuuuuuuuugagacagggucucacugucacccaggcuggaguguagcagugggaucauagcuuacugcagccuugaacaacuccugucucacccuccugaguagcugggacuauaggcauguaccaccaugcccagcuaacuuuucucuuuuuuucuuuuguaaagaugggaucucgcugugcugaccaggcugguuucaaacuccuggccucaagugauccucccaccucagccucccaguguacugggauuacagacaugagccacuacaccgagccuggacuaucuuaugauagcaagauccuuuacucugaagagacaagguuaagcugaaguuuaagacagauugaucaaggcaguaaagaaagauucaccaguauaauaauaaaguaguuaacgaccuuacugagcacuuaguaagugccagguucuggucuaaauguguuauuuguauuacuacaugggagagcggugcgcagaaagguuaguacuuugcccacagucacacagcuaguaagcgguggcacugggauucugucccgggcucuggagcucuuguuuaucaccacuuuaauauacugccucuuuuuuuuuuuuuuuuuuuugagauggagucuugcccuguugcccaaacgagaguauaguggcgugaucucagcucacugcaaccuccgccuccucgguucaagagauacuccugccucagccucccaaguagcugggauuacaggcgcauaccaacacacccagcuaauuuuuguauuuuuaguagagaugggguuucaccauguuggccaggcugaucucgaacuccugaccucaggugauaugccuggcucagccucccaaagugcugggauuauaggugugaaccaccgcaccuaggcaauauacugccucuuaaggacuuuucuaacuggauugagaugaaggaaguguugauucaaaaaugaggccagaucgugugccuagaccgugucuguuugacaacauucaggagggguaggucaugauucuggauuuaccguguuugaggugguagaggcuuuucaaugagaugugucuaguagaugaugagaaaccugagauugagcccagguuaggaauagagauacugguuuagagucauggcugagaauaucagaagaguuguuuugagaguggcaaaggcgggagaguauaaagaaaagccgagaagccgaagauuacaccucagagaauaucugggucuguugauggccuuuauugucuccccacuucugucucuggucuagauacuugcuucugguucugauggaugcugaaagagccuggagcuacgccaugcagcugaaacaggaagccaacacugaaccccgaaaacgguuucacuuguuaucucgccuacgcaaagccgugaagcaugcagaggaauuggaacgcuugugugagagcaaucgcguggaugccaagaccaaauuagaggcucagguuaguaccucaacauucagcuuguuuauuguggagauuaaagacauuuuaaaaagcugcaguuaaacagaacagaguuucuuaguguuagaaagugacagucagaagaggaaaaaaacuuuccgaacuugcuuuuaagaggagaaguuagcauguuuuguuuaucagcucuugauuuuuuuuauccuuuuuuuaaaauugggcaacgcuucauuccauaaaauagaaugaguauucccaagcucuugguuuuuuauaacuagcuguaacuuuuuuuuuuuuuuuuuucagacagagucuugcuuugucgcccaggcuggagugcaguggcgcguucucagcucacugcaacgucugccugucagguucaagcaauucuccugccucagccucccgaguaggugggauuauaggcacgugccaccacgccuggcuaauuuuuuuauuuuuaguagagacaggguuucacuguguuggccaggcuggucccgagcuccugaccucgugauccacccaccugccuugaccucccaaagugcugggauugcaagcgugagccacugcacguggccaucuagcuguaacuuuuuaagaaaggucauguuuugauauauagaugaaagcuuacaaucuuguaccuggaaaguucacaaaguaaacuuuuuuuuggaagugaguuuuuuaaaaaagagaugguagauauugcaagguuuuauucaacuucugaugcuuauguuauagcucagaaaaugguuaaguaaaaugcagaaaacaaauuuccuucuuuugaaguucuuuccugggaagugaauaaaucauaauaaauugccuauguaucacauuuuauugguuaaauacguauuucucuuuaaaaaucaaccugugauuaauauaucuauauucuuaggccgggcgugguggcucacgccuguaaucccagcacuuugggaggccaaggugggcagaucacaaagucaggagaucgagaccauccuggcuaacacggugaaaccccaucucuacuaaaaauacaaaaaauuagcugggcguaguggcggacaccuguagucccagcuacucaggaggcagaggcaggagaauggugugaacccgggaggcggagcuugcagugagcugagauugugccacugcgcuccagccugggggacagagcaagacuccaucucaaaaaaaauauauauauauauuuuauauauauauauauauauauauauauauauauauaaaauaaauauaauauauuguauaauauacaauauauaauguauauuauauauuauauaauguauauuauauaauauauaauguauauuauauaauauauaauguauauuauauauuauauaauauauaauguauauuauauauuauauaauguauauuauauaauauauaauguauauuauauaauauauaauguauauuauauaauauauaauguauauuauauauauauuauauauauauaucuccauauucuuuguuuggguuuuuuguuuguuuuuuagaaagagagucucacugugucccaagcuggagugcacagucauggcucgcugcagucaugaacuccugggcucaugcaguccuccugccauggccuccugaguaguugggacuagaggugcacaccaccacaccuggcuaaauuuuuuuuuuuuuuuuucugagacagagucucacucugucgcccagauuggaaugcaguggugcagucucagcccauugcaaccucugccucccaguuucaagcaauucuccugccucagccucccgaguagcugggauuacaggcgccugccgccauguccagcuaauuuuuuuguauuuuuaguagagacagguuuucaccauguuggccaggcugguccccaacuccugaccucaggugauccguucaccucggccucccaguguugggauuacaggcaugagccacugcgccuggccacacccggguaauuuuuuuuuaauuuuugguagagaugagaucuugcuguguugcccaggccgaucuugaacucuugagcucaaguaacccuccugccucggccucccaaauugcuaggauuacaggugugagccccaugcccagcccauauccauguucuuuuuuuucuucuuuuuuuaaaauuuauucuuauuuuuaaauuuuuuuguagaggcagggucuugcuauauugcccuggcuugucuucaacuguggguucaagugauccucccaccugggccucccaaagugcugggauuacaggugugagccacugcaccuggcccauauccauauucuugauaucaaaguuagaagccaauaaaggaagauugagugggagcacugguuugcuguugaagcaguuccuccucuuccaucuccucacaggcuuacacagcuuaccucucaggaaugcuacguuuugaacaucaagaauggaaagcugccauugaggcuuuuaacaaaugcaaguaaguccuauaguccaaaggcuguggccaguuuuaauuacagauugucaaauuuaagcugcagaucagauaguggauuguuucugugaaagugagggugacuuuucuuuccuauagaaauguugaugauucucuuucaaccuuagaacaugccaguuaugguaguugguaggagagcuucaaaaggccauaauuuguuuuuagucacuguguuccccaugaguuuuucuuauauaaggcugauguaaaaccuggcuuuucuuuucucgcagaacuaucuaugagaagcuagccagugcuuucacagaggagcaggcugugcuguauaaccaacguguggaagagauuucacccaacauccgcuauugugcauauaauauuggugagagcagggaucaaggcauuauacucaacuugaacauugauagauggccuauugggagcucacuucagagagccuagagaguugauguaacuuucuucuucgcuugccuccaucauugaccugaguuuugguugauggcaaaagcagaacuguugaagccagcccugcccaaaauuauagaagacgguucugcuucugugucuguccugcugugcuguguacccccgaagagcagucuugagucuccggcugaguucauuuuuuacuguuuuagagcaguuuuagguucacagcaaggcugagagaaagauacagagauccauguaaccccaccuccccacauccauagccucucucauuagcaucuucccccaccagaggggugcauuuguuacaauugauggcccuuuauagacacaccaucaucucccaaaguccauaguuuacaucaggguucacgcuugauguuguacauucuauggguuuggacaaauguuucaugauguguauuuaccauuauauaccauauggaguauuuucauugccccagucaauuucauucuuuauaaaagacuugucuucagagaacagauugugcugcagauucauugaaguagcauguggagggggaagagcucuuuaagucugaguugaaucuagugauucucaagaaaacagaccagacccuugaagauuuuccugucuuucucucuuaggggaccagucagccaucaaugaacucaugcagaugagauugaggucugggggcacugagggucucuuggcugaaaaauuggagguaaucuaguauguacauuuuugugaaaagucuuuggacaaaguccagaaggaguaauucauaauccccuagggauauuugauauuaauauauggauauuuauaucuguauuagcaaauaucuacauuugcuaaaaguuugaacaaaaaacuuuuucuuuuuuuuuuuuuuuuuuuuuuuuugagauggagucucgcucugucacccaggcuggagugcgguggcacgaucucggcuuacugcaagcuccaccucccagguucacgacauucuccugccucagccucccaaguagcugggacuacagccgccugccaccaugccuggcuaauuuuuuuauauuuguaguagagaugggguuucaccgccuuagccaggauggucucgaucuccugaccucgagauccgcccgccucagccucccaaagugcugggauuacaggcaugagccaccgcgcccggcccaaaaaacuuuuugcaguuaacacuugaaguauucuuuuuuuuuuuuuuuuuuugagacagucuuacucugucgcucaggcuaaagugcaguggcgugaucucagcucacugcaagugaucugcccgccucggccucccagcguucugggauuacaggcaugagccacuguucucggccaaguauucaauuguuuaaccucauuacauuuauuuucuaagcaaguaauauagaaaaagcaagaaauacaaaagaucagggaaaaauauaaaccacaugguugccauauuuauuuauuuauuuagagucggagucuugcucuaucgccaggcuggagugcaauggugcaaucuuggcucacugcaaccuccaccucccagguucaagcgauuccccugccucaaccucccaaguagcugggauuacaggcgcccgccaccacgcccggcuaauuuuuguauuuuaguagagacgggguuucaccauguuggccaggauagucucaaucuccuaaccucgugauccaccugccucugccucccagagugcugggaguauaggcgugagccaccgcgcccggcuuacuuauuauuauuuuuuugaacagcgucucuuuugcccaggccagagugcaguagcuugauuuugacucacugcugccuugauuuccugcucucaagugauccuccugccucagccuccugaguagcuggaacuacaggugaagguuaccacuccuagcuaacuuuuuuuuguuuuuugguagagacagagucucacuguguuucccaggcuggucucauucucgaacuccugcgcucaagcaaucuguucgccuuagccucccaaagugcugggaucacaggggaucacaggcaugauccaccuuauccagccauacaccaucauccuuugauggcugcaugguacuccguugcauagaagucuguuuuauuuaaccauucauuguucauuaagugguaaacaguauuaccaugaauguccauguccucagauuuugcacacauucuugauuauuuccuuaggauaaauuccuaaaacuggaauuaaaugguuuggaaacuugauacauacugacaaaugucuuuaaguuucuacugauuagcauuccugcuuguagcguauacagauaugcuuuucuccuuacauccuuaccaaaacuuaguguuacucuuuuuaaccuuccgcuauguccuuuuaauauuugaauuucuguagcuaaaauauaugauaccagggagaaauuuaaaacaaauagaaauugguggccagcagggugguucacaccuguaauccuggcacugugggaggcugaggugaaaggauaacucgagcccaggaguucaagaccagccggggcaacacagugagaccccaccucuacaaaaaaaauuuuuuucagaggcugggcacaguggcuuaugucuguaaucccagcacuuugggaggccaaggugaauggaucaccugaggucaggaguucgagaccagucugaccaacacggagaaaccccgucuguacuaaaaauacaaaauuagcuggaugugguggugcaggccucuaaucccagcuacuugggagguggagguugcaguaagcugagcucauaccauugcauuccagccugggcaacaagagcaaaacuccgucucaaaaaaaaaaaaaauuuuuuuuuuucuuaaauuagccaggcauggugacacauaccuguaguccuagcugcucgagaggcugaggcaaaaggaucacuugagcccaggaguuggagguugcaguaagcugucauuaggccacugcacuccagccugggcaacagagcaagacccugucuacuaaaaaaauuaaagaggccuggcacaguggcucaugcuuguaaucccagcacuuugggaggcugaggcaaguggaucacuugaggccaggaguuugagaccagucuggccaacguggugaaaccucgucucuacuaaaaauacaaaaauuagucgggcaugguggcaugugccuguaguucuagcuucucaggaggcuaaggcacaagaauuccuugaaccugggaagcagagguugcagugagccuagauagcgccacugcacuccagccugggugacagagcaagacugucucaaaaaaaaugaaagaaauugguguauacucuacuuucuauggaguauaauauguugguuauacaaagagacaaaugauagauuccacuuauuuucaccuccaucacucauauccccaguuaaagcuuuaacuuuuuuaaacuauuuuucaggcuuugaucacucagacucgagccaaacaggcagcuaccaugagugaaguggaguggagagggagaacgguuccagugaagauugacaaagugcgcauuuucuuauuaggacuggcugauaacgaagcagcuauuguccaggugaggaggaagaacuuacugugcugucuucuguaugugucugaagguuguccuguguguuuaagauguaguggcucguugguauucaguucucauaaaacaaacuuuuaaugcuguuuuggauuugguaaguacggagaugugccuuauugaauaaaauuauuuugaaaacugaguuuauagaggaauucuuaauguuuagagggcaaagaaauugacagcaacagucaucaacauaaaaaugggaggcauuagaggcuggcuuaaaguaaggggucacauuuggcccagcagguggugcagcagcuuaacuauuaugucucugaaguuucucugacauguugucguaaccuccuagcccuaaaggguucaccucuuaguccuggggcuuugcaggauagccugguuaaaccagaaugucuuguuuugugugcgguguacauguaauauucaugcaaaacuguuaucacuugauacugccuacugacauaguuaccuauugguggguacaaacaaccaaaugcguccuaaaagauaagacauccuggugaccuuuguaugacauagacagugaugggggcacuuuuuagagcuucuuuuccacaugaguuaaaggacaucuuuaaaaaaacaggcugcugacagucuacugccucaucagggaacaguggcauuuccgaagaccucacaguuaucuuuugcacccugaauaauuuguguauggguugguggggugguguuuuguuaauguguugaggaauuggcuuaagcaucuaaaauuucagcaacuugcuccagaauggcuacuauggguuggaggcagccuucaacagcugaagaguugauguguguccuugucuguguuucguauugccugucucauaucccuuuuauuugcuuaaaggacagaagacuagaacaguacuagaaaguuaauuuuugcuuaaacugaaaggcuaaggaacuuuuuuugagagcauucuauuggcacuguuguauggugcuaccuccacuggacaacggcucugguagcaacuauucagauuaugugauuggguuagugcuuugguuuuaaaagugaucaaugcuggaagaaagaaacuacuucuguccucaguucagugccagacagcagagacaguggggcaggaauucugacuugaagaggaguugggggagagagauccauaggggcaaguuaaaugagggcucuuucagaguggggcuacagacacguaccaaaugaagaacaggaaaagcuagcauuuauuaaguaauuuugaaaaguuacugcuggcacgguggcucauggcuauaauccuagugcuuugagaagcggaggaaggcagaucacuugagcucaggaguuggagaccagccugggcaucauggugaaaccccaucucuacaaaaaaaaguaccaaaaaauuuagcugggcgugguggcgugcaccuguagucccagcuacuuggaggcugaggcaagaggaucacuugagcccgggagcuugaggcugcagugagcugaaaucacaccacuaugcugcagccuggguaacugugcaacucugucuccaaaaaaaaaaaaaaaaaaagaagaaaaaaaaguuaauaacuuaaaguuuaaauacacauuuuuuuuuuuuuuaaagacagagucucucucugucacccaggcuggagugcagcggugcaaucucugcucacugcaagcuccaccucccagguucacgccauucuccugccucagccuccagaguagcugggacuacaggcacccaccaucacacccggcuaauuuuuuuauuuuuaguagagacgggguuucaccauguuagccaggauggucucaaacuccugcccucgugauccacccgccucagccucccaaagugcuggaauuacaggcaucagccacugcaccgggcccacaugauguuuuaagaagaucagccuggaaagggugggagggagugagagauaaaagacuacacauuggguaccguguacacugcuugggugacaggugcaccagagucucagaaaucaccauagaagaacuuauccauguaaccagaaaccaccuguucccccaaaacuauugaaauuuaauuuaauuuuuaaaagaucagccuaggccgggugcgguggcucacgccuguaauuccagcacuuugggaggccaaggcuggcggauuaccugagaucaggaguucgaaaugagaccagccuggccaacauggugaaaccccaucucuacuaaaaguacaaaaaaaaaauuagccggguguggugguagacgucuguaaucccagcuacucgggaggcugaggcaggagaaucacuuaaacccgggaggcggagguugcagugagccgagauugcgccauugcacuccagccugggggauaagagcgagacuuugucucaaaaaaaaaaagaucagccuauugucucacuuccuauaugccuucauugauaugacaucauacugaaaggaaagcacuguuucuuuuuaauguuuuuuauauucaugagaguucuuauguuuuuuuuucccuugcuggaauuauacuaagauacaguucuguauccuguuuuuauuaacgcguugugcaauggugugaucucagcucacugcaaccuccgugucccggguucaagugauucuccugccucagccucccaaguagcugggauuacaggcgcauaccaccaugcccaacuaauuuuuuguauuuuuaguaggucucgaacuccugacuucaggcaauccacccgccucggccucccaaagugcugggauuacaggcgugagccacagcgcccagcucaggcuuggugauucuuauccucaaguuaugguuaauauuuuaauauuugaguggaagagggaccauuuaucuuuuucuuaaaaaacaauguauauuuauauauauucauguauauucucaagugagauuuguuuccuucuuuaccagauuuccauguauuuuuuuccuaaaccucacugggcuggguaagguuugauucuuguccccauaguaggggugugguugggaauguggucagacuugccuugugugucucuuagucauacuaccaccuuccagcaauuuccauagacaagugaaaacaaucugagaaugugcuuuuuaaagcgggaggucuguaccucaggacacacugcagcucgcuuuccuccgcaccagucaguuuugaaacugagccugacgagagaaccugagacugcagaaaagcccauccugaagguuucaaguuuuguaaaagcugaccuaggauugauugauucauuuggacuaaucaguaacauauuacuucugggcuuaagauuucucacugucauaggcacaccugggaaaaggucuagucagaccaccaauuuuugugcagggaguuuugccacuuauguuuaagagcacguucugguugguccaguggcuggcggagaaggucgguguacagguggccaggaauccugccucugcguguugagaggaguuucuuauuccacuguccuuucaggaaucaucuuagccuugaauauagauuuauagaauaaaaguguaaauagcaaaauauauugaaggcuuccuguuuggagacauuuugcccugcccagggagaaucaugagagcuucuccuucagagauuaguggucugagucauugcagugugggcgucguaagaaaaacacaacugacuuaagucccgcccuucaaaucgacuuuuuccuucauugcuuuuuaggauguuuguaaaauucccagugggaacuuagagcuuugugggagcaguggggagguuuuuugguuucagcaccuugaugcagaggcuuaguuaaagggagcagaggugauacguggcagucaagagguuuuaaacuugaacuguacccuaccgacaggaaaagaggcaaauccuguguagcugguaagacgaaguucgcucuuuucuugaacgccgguugcuccaaccacuuaaccccacuugucugagaaggguguuggcauguuuguuggauugcauggaauuaaaacgggcgccguagcucuuccuuucugcugagaauguggcugugguauauguguguuucuuuuuuuuuuuuuuuuuuuugagacagggucucacccugucacccaggccaaagugcaguggcacaaucucagcucacugcaaccuccaccuccuggucucaguugguccucccaccuuugccuccuggaauagcugggaccacaggcaugcaccaccacaccuggcuaauuuuuuuugcauuuuuuguagacaugggguuuugucauguugcccaggcuggucucaaacuccuggacucaagugaucugcccacaucugccucccaaagugcugggauuacaggcgugagccaccgcguccgacgccauguguguuucuuaaguaguggugccaaguccauucacaugucuuuuuuuuuuuuuuuuuaaguucugggauacaugugcagaacaugcagguuuguuauauagguauauaugugccauggugguuugcugcaccuaucaacucaucaucuagggauuuuuuuuuuuuuuuuuugagauggagucuggcucugucgcccaggcuggagugcaguggcgcgaucucggcucacugaaaccuccgccucccggguucacgccauucuccugccucagccucccuaguagcugggacuacaggugcccaccaccaugcccagcuaauuuuuuguauuuuuaguagagacgggguuucaucguguuagccaggauggucucgaucuccugagcucgugauccgcccgccucagccucccaaagugcugggauuacaggcgugagccaccgcgcccagcccaucaucuagguuuuaagcccugugugcauuagguauuuguccuaauacuuucccuccccuugccucccacccccugccauucacaugucuuacucgaguuuuuaagcacucuagacuuauguaucuuauuccaguugcugaguauuauauggcggcaccauuccacagauuuguacuuugaaaaauuaggccaguaagguugacgaagugauucuaaagaaucuugccaaccuggggucggccaacaauauucuauaaagcaugugcuccagugcugcacuguccagugcaguagccgcucaacacaugugguuauugaaauuuaaauuaauaaaacuuccagccaggcucuguggcuccugccuguaaccccagcacuuugggaggccaagacagguggaucaccugaggucaggaguucgagaccagccuggccaacauggugaaauagccaggcgugguggcgggcaccuguagucccagcuacuccggaggcugaggcaggagaaucucaugaacccaggaggcggugguuacagugagacgagaucacggcacuauacuccagccuggguagcagagcaagacucugucucaaaaacauaaaauaauaaaaagauagauaaauuaauaaaacuuccgagugcucagguguucauuggacggugcacguagaggacauugcccguggcagagaguucuauuggauggugcugcucuggugguuccaggagugaaugguggccguguuugcuuuacuagauuuauagcaugaaugagccccaguucguucccaaguuagugaacaacaggaaagucaaguaacuuauaaguggaaaaguauguuugauuuguauuggguaaguuacaaggaagauuuuuuuuuucacacuggagacuaagaaaagagaagaaauagauucuuaagagaacuuuuaagaaaagcuuucuuaagagaagaaaaaggguuuuucuuuaagccccuguucccccaaccaucucuuaaaggggugggcagcacuggguuuucguuugagcuuucuuagaggucaguugaauauuaacacauuuuuucagauugaguguuaauuucuaugggaagucaaauaccauaauggaauguugauguuuuaauuucacagugggucugccagucacacagguucauccccuuucugccuuuuguccauuucuaucugcucggucagauucuuugggacgauaauguggcuuggcagguauucaguuagugaaucacuuucucacuuacccuagcuguguagcagacaggugacacccaguacuugugcaaagacugucgucucaugcgugucaaccuuguauguccuaaaaauuguucucagaguagucauguggaauaucugagugcagcacgucuguggcgaaaagaacuuagugugauauuuaggagaacugucuuuuugguggguauugauuagucuuuuuuauuauuuccuuguaccuaaaagaaacaaucuuugaguugggucacauuuguaaaagguaauuguguuggcauacaguagagcuugacaaguuuguucuggaaggaaaagauaaggaaaguucuggugugcugugcuucaguguagagugucccaaguccagucuguaaggccccucaaggggugccagguccugagcagagggugaagcgcugcagggaaguagcaggaagcugugcugggaagagacguaaagccuuugcuaagucucagaucaguuaugcagacagcuuuuucagcauguuugcuuuuaaaaauagaacuccccuuuccauaugaauaaugaaugacuaaggcuaugagaaaccauuauaugguagagaacaguaacaauuaaaaugauaucugguguggcgugcgugagugagugugugguugggggacuccaugugcgauuuugcuccucucccauuaggugacuaugguuugcucaaaggaaagucucuuacuuugaucugcccuuguuuaggcugaaagcgaagaaacuaaggagcgccuguuugaaucaaugcucagcgagugucgggacgccauccaggugguucgggaggagcucaagccagaucagguaggacccucagccgagcccugguucuugcucugggcggguccaggucagccuguguccccuucucagguggaccccagugcucugagugcacugcucgcuuggccacuguuucguuuuuguuuuuuugaggugaggucguaagggagcaaacaagggccucugggcuccaucacauugagaaauuaauuucucccuccccuguuccuccuaaugguuuccuauauggccugugaagccuguggccuccaauucugucuccagguggacuucuccagugccucccuuuucugaaaacacuaucccugugguugauucaggcaucuaggcugaaaaccucagaucuauuugucucuuuugucccugucaccaaacccaccuucuucucccuuugcagggccucuugccuauuguugcuucaccuguuucuauuagccuuuucucgugugccuaggcaaccgcaaaggucuccuaauugcuucuucuggcuuggucucgguucccuucuccaggccuuucuuucgcaaaguacaaauggaaucuuucuaaaucuaguuucccugucuaauuuuaaaaagcccagugauuuccucuagggauugagcaauggccuccaaacuuuuaugcugauaaaccccauaggcagcauugagccugcaccacugaugcauuuauuuaugaauuauauagcuuauuauuugacuaauuugucauauauaaacugcauuaaaauaagggcuuuuuugaaugagauaaauagaaauagaaauucuaauuuucguuucauacccagacucccuggguuuuaugcgcccuacuuagagaccacuggccucucaguucagacuugagcugguguacaagccuuccuuagucuguucccagccuuguacuucacugcauccuucugaguccucugccucaagcuguuccacuuacuggcaucucaguaaugccuuucccaccccguguguuacacuguucucauuccccucccuccgcacacuuggguaaucuuuccugccccucuucaccuguccaaaccccaucuguuuuucaagguccagcucauagcuuaccauuucugaaaagcauaugccugcaccauccuagcccacagagaucucugcaguuucuaaauaucugauacuugcagcuauaagcuuugauaguuaauuaaguauuaccucuucauaaaaacuuuauugugguaaaaaacguuaaacauaaaaccuuaaccauuuuuaaguguaugguucagugguaauuaaaugcauucauaacguacaaccaucaccaacaguccaucuccagaacucucugcauuuuguaaaacugaaacgcugaacccauuaaacaacaauaacuucguugccuagcaacuauuuuuuuuucagcaucugccacaaagccuugaguauaaacuuuguuuugaaucacugcuuucucuaaggagucaccugcuuccuugccccguuaggcugccuuuauguauugugcuucccuucaucgacuuaacagaggugccuacagagucccagccccugucacugucauucaccuugaaugcauagcaguugggagacaccucacagaauguaaggaaugugaugccgcaaaggcgcauucauuuccuguugcugcgaucauauuaaccacaaacuugaugguuuaagaugauccaaauguauuaucuuacgcuucucgaggucagaaaucuaguggguucacagggcuguguuccuuuagaaacccuaggggaauccuuuuccaguauucccaagaaugcaucuccuggcuucuagcggcugccuguaguccuuggcuuguggcucuccguuugugcuucaaagcgaucagcuccucuccccucugcuuccguuccuucaucuucugcaucucugacccaucugccucccucuucucaggacccugggaugacauuggacccacccagauaauucagagaucccuaauuuaaucacaucuguagagucucuuuuaccauauaugguaacaucuucccagauugcacggaggcuagcauauagacagcucuggcguauguuauucggccagccacaaaaggcacacucugacagcacaagggguggaacugggaucuguggcacagaccuucacacagagccguggacuguggaaugucugauuuuaaugcuuugggguuaggcacggggaggaguggacaggaagucucaucuggccguuacucucaguucucuuauuugaggucaauuuuuagaugccaguggcaacuugagugccacugucauucuagauuaugucaaguauagaucuuugauauuugaggacuccugucuuacuagaguuugugucuauguucagggcacuuuggagaccccaccauuccaugagguggucagagcgauggagagcaucaguugcuuuacuuuuuaccuuuuucacuuucugcagaaacagagagauuauauccuugaaggagagccagggaaggugucuaaucuucaauacuugcauagguaaggguuauuuuaauuuuuuuacuuuuuaauauuauuaaaauauuugaacaaaagaguauauguaauauuuauguauauuuacauuuauaauuucuuuucuuuguuuuuuuuuuugagacaggaucuagcucugucacucaggcuggagugcagugaugugaucucagcucacugcagccucaauggccugggcucaaucaauccucuaaccucagccucccacugaguagcugggacuacaggcaugcaccacuacauccagcuaauuuuuguauuuguuuuguagagaugggauuuugccauguuaccugggcuggucucaaacuccuggacucaagcaaucugcccaucucagccucccacagugcggggauuauaggcgugaaccacugcaccuggcuuacauuuauaauuucuuaaugcauacaaaugcuaaugcauguauguccauuuuaucaaauaaguauauaugcuacauuuacauuuuauuuuaauaugccuaauuuaagauuuuuauauagcuuaacuagaacacagccaggcaugguggcucacgccuguaaucccaauacuuugggaggcugaggcaaauggauugcuugagcccaagaguuugaauuagcugggugugauggugcacaccuguggucucagauacuccagaggcucaggugggaggauccccugagcccagggaggucaaggcugcggucagccaugaucauggucaugucacugcauuccagccugagacagcccugacucaagauucucaaaacaaaaacgagaacacaaccaguguuugaagcucccugcggcccuugccucauuuccuuccacuccuagagcuaacugcaaccuuugccucccgggcucaggugauccucccaccucagccuccugaguagcugggaccagaggcaugagccaccaugccuggccuguuuauuuauuuauuuagagagauggagucucgcucugucgcccaggcuggagugcaguggcgcaaucuuggcucacugcaagcuccgccucccagguucacaccauuuuccuaccucagccucccaaguagcugggacuacaggugcccaccaccaugcccagcuaauuuuuuguauuuuuaauagagacgggguuucacuguguuagccaggauggucucaaucuccugaccucaugauccgcccgccucggccuccuacagugcugggauuacagaugggagccacugccccuggccccccguuuuuuuuguuuuguuguuguuguuguuuucaauuuuuagagucaagguuuugcucuauuacucgggcuggagugcaguggugugaucguagcucacugcugccuugaauacccaggcucaggugaucuccugccucgugaguugcugggaucccacucucuguuuuuuguuuuuuuuuuuuuuuuuuuccacugugugguucuugaaaaaggaugcagaagguauaaaucaagcuaaaaaucaaauuuugugauaagaucucaugcggguccccugcaaacuugccacuggauaguagccaaauggagggucccuugaagcccaagccaaauggcccugcuguggccacgcccccacccgcccccugcuuccucugggucagccccaacuuguaguccaguccucccaguuccuccgcuucucugaguauaacuugagcugacuuguggugcauuccagcuaccugacuuacaucaagcuaucaacggcaaucaagcguaaugagaacauggccaaaggucugcagagggcucugcugcagcagcagccagaggaugacagcaagcgcucaccccggccccaggaccugauccgacucuaugacaucaucuuacaggugacccuugaggaccgggaaggcaagggccugugguuuuccuuugccugugucggacacaaagugacuuaacuuuguaucacggaagggcugugacaagcaggaccuauuaguagcugggaagagacaaagaucuuacaccaguucugcagucugugagccccuaccucucagacaugcugaucugcagagaauagugaccccagaucaucacugagcacuugaccuguguaagacgcucccaggugccauagagcaucugagaccugaguccaugccaucucggcccccagggaguuugucagucaguaggacugugagacacacacagucaaggcaucugaguagaugcuaagcaaaauaaaagcucagcgcuggaacagaucccuuccagcuaagaugggccaagaagucucugaaggugggugagcugaguugaguuguaaagggcaaauauguuuccaagaucagaggggaguggaggugacagcagguguggcugcugcccaaucucuucacaggcuuuuccccaucguauugaccucgggcuuuuuuuuuuccucacucuuguccguucuuacaaggucuucugucaaaaauucaaccuaagaucuacucuucaugaauuuucuuguugcaucuguuguacagaaucugguggaauugcuccagcuuccugguuuagaggaagacaaagccuuccagaaagagauaggccucaagacucugguguucaaagcuuacagguaacgucccaugggaugggcaguuuuccuccgccucccagguucuauaagcauugggagcaugacccagcccacagcagaugggaccguuggccuugaguguaugguuaccuugccugugaucagaggaaggucagcccagcauguucaaggggaguuucuaaaggcuguggucaguaguggccagugaugaugucugccuuuuggccaggucggaggaguggagcacacacguuaaacuuggcuuccucgcugggcgcgguggcucacacuugucaucccagaacuuugggaggcugaggcagguggaucaccugaggucgggaguucgagaccagccugaccaacauggagaaacuccgucucuauuaaaaauacaaaauuagccaggcaugguggugcaugccuguaaacccagcuccuugggagccugaggcaggagaaucgcuugaacccgggaggcucaccgcaacuuggcggugagccaagaucgcaccauugcacuccagccugggagacaagagcgaaacuccaucucaaaaaaaacaaaaacacuugucuuccuguacuuuccuccucccuuccaggggaaaaggggcacgccuugaaaggguguuaauuagcagaaccaguguggccaguucaaggaacuugaacugacuugggauaaagcuaaacucaguuucuuaaaugacuugugucauuuguaacuuggaagugggcuggguagcacgauggggcccagccaggauggaaggcagagccccaugcauucuugcccuuccucuuguggcccucacaugccagugugcucuggugcuccagcaugccccgucuucacuccauggccccuucuguccugucagggaccagcagcgcucaggcucugcugagcccaggagaggaauuugacucaggaagaaccuucugugaguuuuguuuuuggaaagcgaugagcagagaugaaugauugcgacuuggguguguggauggguuugggauuucuauuugagccgggcagcguucuuccuuccuuccuguccccagccucaccaugcuccuuuugggaacuguuccuccucugcagagucagccagucaguaaaaaaccguggcucaguguugggccuaccugggcaucucugauugcugggaagcaucucugcaggguagccuacaaaucugaacacuucccaugaagggggcucccaugcggugaucccacguuaagaaaccuguuuccaaaugugaaauuucgccuaaacugcaaggaaagccuuggucuuggguaauugcugcuuuagaauauuguggcucuuuucccuccccaucagguguuuuuucauugcucaguccuaugugcuggugaagaaguggagcgaagcccuuguccuguaugacagaguccugaaauaugcaaaugaaguaaauucugaugcuggcgccuucaagaacagccuaaaggugagagguuggccucuccuuguuugcaagcccuggcagguuauggagucagcuguggaggagcugugaggguacaacagcugggcgccaccucaggcugguccucccuggcugcccgugggaccugguguagcccugacugcccaggagcugcaggcugugucacucauggcugugcuccaggccugaggaggauuuagguaugaagaagggaaggcauuuuucugauuuaaaagaaacaaaaaccaccacaggaaaaccugaaguacugcucucagacuugacugcacguugaaaucucuuaggaagauuuuuuucaagguagaugucugggucgcacccccagagauugugguucuaaucagugugagggaucugaagugggcauugggacuuagaaaggccccuuagugauucugacaugcaaccaagugagaagcacuggugaagcuguccugcagggcaugcgcaagaccagcagcagcggcggggccucacuaggaaugcagccucucagcucccacccggaaccuucugcuuguuuucuuucuuucugucuuucuugagacagggucucgcucugucacccaggcuggaaugcaaguagcaccaucauaguucacugcagccucgaacuccugggcucaagugacccucccaccucagccuccugaguagcugggacuacaggcaugagccaccauaccaggccaauuuuuauuuuuuuguagagaugggggucucacuauguugcccaggcuggccuugaacucauggccucgaacuccuggccucaagcaguccuccugccucugccucccaaaaccuugagauuggaggcaugagccaccaugcuggccaauaucugcauuuuaacaagauccccaggccauuugggggucuguuaaagcuaaggaaaugcuugaucuaaaguacagccacagggcuggaugcaguggcucaugccuguaaucccagcaguuugggaagcugaggugggcagaucacuugagguaaggaguucgagaccagccugggcaacauggcgaaacucugucucuacaaaaauagaaaaaaauagccaggugugguggugcacaccuguaaucccagcuacuugagaagcugaggcaggagaaucacuugaaucugggaggcagagguugcagugagccaagaucaagccacugcacuccagccugagugacagagcaagacuccaucucaaaauaaauaaauaaagugcagccauggaaggcuuucuuugcuuuacuuuuuuuuuuuuuuuuuuuuaagauggagucucugucuccuaggcuagagugcaguggcacgaucucggcuugugccaccaagcccagcuaauuuuuguauuuuuaguagaggguuucaccauguuggccaggcugguuucaaacuccugacuucaagugaucaagccucuugauccgcugaccucagccucccaaagugcuaggauuacaggcgugagccacuacucccggugcuuuacugauuauugaacgauaacuagcuucuuaagcuuguggcgugcugugaugguauagaacuuguugcaacaucagcuggucuaaggaauccauguauauuugacaaguagagaccauuuagaaaagcaagcaggggccgggcaccguggcucacgccuguaaucccagcacugugggaggccgaggcgggcagaucacgaggucaggagaucgagaccauccuggccaacauagugaaaccccaccucuacuaaaaauacaaaaaaauuagccgggcaugguggcaggcgccuguggucccagcuacucgggaggcugaggcaggagaauggcgugaacgcgggaggcggagcuugcagugagccaagaucacgccccugggcggcaacagagugagacuccgucucaaaaaaagaaaaaaaaaagcaagcaaagguuccugucguugauggagucacgccagccaguguaggagcugcuggaucccgugcaagcucagagggguagagaagaagcucucugccuucagagagcuuguaguuuuguuguagccacagacuggcaugcaggagcccaccuauggaugcagaagaaauaaaagagaccccaagcaaaggcagagcuagaaaacagcacagggaugugggcaggugggagugacaggcauggcagcgucaccaccauggaauaucaucuugggacgcggggcaaaccaguguggaccugauuucaugugcugaauuguuuugugggggaagugucagaauggaggcaugaaggauucuguggcauccagaccuucucaggucauucccaauaugccaagcaagagaccgaggccaggaaaauucaucacccucguugaagcagugggauguaacgacuaagggcuuaugcccuugagccagauggcccagcccuuuaccccagcccgcugccacuugggcgcauggcuggcacauugcuuaaccucuccaugcuuccauuuucucaucuguaaaaugggagugcaaacugccucaggauuauugagaagguuaagcuagugauuauguaaccugcuuagaacaaugccuggcacacuguuuaguguaugauaaauuuauuaauauuaacaucaucuuuauuuccaggcauuauuacuuaagccguggcauagcuuuucccauuugaaacaggcuaguguuuugcuuuguuuuguuuuguucuaauagugagaaccguuuagaaagucuaaaguccugugaaaauaccaguggggucgguuaacucggguuagcuuggugugcuucucugaccuggcccuggcucgggaguacacguuuucugaaucuuacaggaccugccugaugugcaagagcucaucacucaagugcggucagagaagugcucccugcaggccgcagccauccuuggugagcccccugccuggccuuuguauccccagacuucccuuccugccacuccccuucucugucacaccccauacuacuguuuuaagguugaaaggguugucuugguucaucuguaagauguuccuggccuuuacuugugccagcugggcaucagauuguguagaagcauuucgagugcacuguuacacuggcccuucucccuguuacuguccucaugcaacugugcuggcuucacugggccgacggcauuggaucugggauugaucuguuuaucuccaccacuucucagcaggagacaggccuggcuuccccacaugcuggcuccuuuugcuuuugggauguaggggccaccugugugauaggccucauuugugauuagugugcuauuauaaauccuuguucuuacugaaucccugugaaacuuucagaugcaaacgacgcucaucaaacagagaccuccuccucccaagucaaggacaauaagguaagucugggccaugguuuuugaggaauacgaagcaggauuaguaacaaacuaggaaugcaugcucauuauagagcaguggacccuaaauuucuaaggaaaccccccaccucccucccuucucuuacccaaccucaaagcuucuugcauaaagcuuccuagaugucagaucaucccugggaagaggguugaggaaccuguugcuguaaagaguagcacccguggguaagagcucuaacucguaacauggccaacaggccugcaccccaguccuagccugccacucucuuagccucucuggguuucagugacuuugacuacaaggcagggaugugguagccccuccucguaggaggcugucgggauugagugauugagugagauggccccuguaaagcucugaaccaggcagucggcacucaggaauguucaccaaggguguucugugaccgaugcuacauacgucucuuugauuugacuuccagccucugguugaacgguuugagacauucugccuggacccuucccuugucaccaagcaagccaaccuugugcacuucccaccaggcuuccagcccauucccugcaagccuuuguucuuugaccuggcccucaaccauguggcuuucccaccccuugaggacaaguuggaacagaagaccaagaguggccucacuggauacaucaagggcaucuuuggauucaggagcuaaccaggcucuuccucgggggcgggggagauucugacucuuaaucuguauugugagaaaaucccagcaaguuccaugauauuaaauccaggucugcauuggcccggggcaagaguuuaacaucuucggcccugcauuccuacaucuugugucuguacacguucuuaagcagcgugucaggagagcacccuguugucuucugguaaaugugugcagggucauccugucuccuguaccuccugggaaaggggccgcugcugucuggugcccugugagcugugauugauugccuuuggucaguaaugcguucaggaguccacaccaggcacagauggggccuugaaacgcuuugucaugcuucuucaguaccauggauuugaaaugaacucauccuugcugugagcauccaggagcccuugagaaguuuaucuaugacuaugaaacuggcaacgucaccccagaauuacggucagccuuauuccccuucaccucccagugaacgcuaagaaguuucagacaagcagagagcucuauuuuuagaagaaauauguuacacucagaaaugaugaaaccaaaucuuauauuaaaaggcaaagaug

SEQ ID NO: 192324 - RNA, 72414 nt, Homo sapiens
cgcagcaaacacauccguagaaggcagcgcggccgccgagaaccgcagcgccgcucgcccgccgccccccaccccgccgccccgcccggcgaauugcgccccgcgccccuccccucgcgcccccgagacaaagaggagagaaaguuugcgcggccgagcggggcaggugaggagggugagccgcgcgggaggggcccgccucggccccggcucagcccccgcccgcgcccccagcccgccgccgcgagcagcgcccggaccccccagcggcggcccccgcccgcccagccccccggcccgccaugggcgccgcggcccgcacccugcggcuggcgcucggccuccugcugcuggcgacgcugcuucgcccggccgacgccugcagcugcuccccggugcacccgcaacaggcguuuugcaaugcagauguagguaaggagcggcgaccccagcccccgcgcggggccccaccucccccgcgaccccgaggguucgcagacgccccgcccgcccgccgcuggccgagggaccccagcgcccgccuccuggucccucggcgccuucucgaauccugcaaguggacgcccagagccgacuuucuuuccccccucccuccucucccuuucuuucccucucuuugccgagaugcgucucaaccucaaaauuccaccgaaauuccgccgcagcuccagccccaggaaagggagccaguuuggcuuuuggcaggcggcgcgcccugggaugccagcgcugggggcggggagcgugggggacacggcgugggggcggggggcuggaggacuggggaccccaggaagaaacuuucgcagauaaggugggaguugggcuucucugggcuuggggcuggguggggaagggcuucucugcuggggcuucucccaccagccccauuugggggcuccccgaucaagccagggugggauggaagcccgcccuacccgaggcagguuccacaggcccagaggggcaggugaaaaagccgguggcgucuccuggcguggcuccuugcuugcgcccugcccaggaggcccugcaaacuggcugggcagggaccgggacccccgaauguuccgcuuuuucgggacguccacaaaagcuggagacuuuggugaccggacccggcacgugggacugugcugcugcucagauuccccagcaaauacccaugaccuccggacuccuagcccccaaaagacaggcgccauggagggaggcaggaggggcccaguuauuuguucugauccauggagggggaggaccagcagaaaugggaggaacccgcuggcucgaaguuuccacccugguccugcaccucaagccucugcagcccuggugcuggucagcaugguuuuccuggggcaagucuggcuacacggcagguggucucggagcccccugcccuccuuccuucuuaugucugagucucagucgagugaccuguccagggcagauggagcaaggcgggggcccccucaccugcccagaguggaggugggacuuucuguuucuccugcugucagccacgcccuucccauaccccgcccacggcuucuugccccaccccgguuagcccuaggagcugcgugcccagcuggggaaguuuucaguugcaccaaucuauugagaucacaggucucagguggcucaggccaccugggcggaaggcuuggugugugccugugucaguuuccacaaaacccaguuugggggaaaugaggucuuuucuccaguuuagccuuggugcucagcaagauuugugggugaaggagagguuccuuugaugagggagccauaaugggccuuucucuggggguccacgaggagugcaggccuguccaggcuccuuggcucaccagcacgugcuggggcaggauguagccaaggcccagaaggaggcuguggauaaaaggaccugggaguuggauuuguaggaguugggccuugggaccccucccccucccgcccccccccccaccccgccccacacacacacuccucagcugugugggagaauguccaggcagccacucuguccuugcuuggcauaaguuaaggcggccacugagcugggagcuguuucugcgugggguguggauccaggauggcagaggguggagggcugcagugcgugccucccgccuccuucaugcucagcgcagcacucuccucuucuggguugccuggcauuugugucuaaaucuuugcaucaaaaucauccuguagcuaaaacuuuucaccccaucccggcucagaggcccagucagaugccagaguugcacugcagagcucagggcauucgcuuccuguggccgcugugacaaacuaccacaaaugggagggcuuaaaagaacaggaaucgauucucuguagcucaggaggccagaagucugaaaagguguccacagagccaguuccuucugggggcugugagggagaaucucuuccaggccucucuccuugauguugcuugguuccauuuucaaggaacacaucacuuccauuuccgccugucuucacauggccuucucucgugugucucuguguccaaauuucccuguucuuuuuuuuuggagagcaggcuggagugcaauggcgcaaucucggcucgcugcagccuccgccuccuggguucgagcaauucuccugccucagccucccaaguagcugggguuacaggcaccugccaccacacccggcuaauuuuuuguauuuuuaguagagacaggaauucgccauguuggccaggcuggucucgaacuccuggccucaggugauccgccugccucagccucccaaagugcugggauuauaggcgugagccaccgcgcccggccaaauugcccuguucuucuaaggacagcagccauuggauuuagggcccacccuaauccaguaugacuucaucuugauagaucaacaaauacucuauuuccaaauaaggucauauucauaggaucugacuagaugugcauuugaggggggacguaauucagcccauacaccaggcugccuucucuuauucccagucacccuuuccgugcucaaccaacuugggauaaacaacccaggacaucccaggguagggucccggaacaaaucccacagggacgacagcggccugucuauucuccaguguucgauucuccucgaagcgaugcagguuugugacuuucucagcaaugguuccccauucuggcucagagcagaauugccuggaagauucuuaaagauugcucaggucuaggucccuuugcagauacagagggucuugcucagacuucggcuuuugcaguuuuaaaaggcccacaggugauuuaaccagggcugugacccaggggucucagaaaggggguacaguggagguuaauaaaggcuggcuuguuauguggcaagcuggcuccuuuuacucuuggcugcaugcagccuuguuaaauggcuuggugucuacaagaggcaauuggcuuaagaaacagucagauuucugucugcccggcugaggauuucugggagguaucucccuagcagcucuugcaguugguaggaccggaacuguggucggcaaagauaauucaugaugagguggugauguuuaggauaagggaugguaagaggugaccugauuucuuccuggaaggccccagguccuuguccuuuccagcaaggccagcacaaacgggaagcauuuugugucucaguuacaguacuguucaaaugcgcugcuggcccggcucccucucacccagugaaauccuucacaucuacugccagccugcacagcuacagggaucuggcuggaaauuagcuuugggcucaccauucaggcagucccaugccuggagccacuuagccagcugagcuacuuggcagacucgggcugcuugggcccguuucuggacucaaggguaaagccaggagcucucuggaugcagagaauaaaaccucuccucuggcuuggguggcaguaccuaaggccacacauuauccuagaagaccucugcgaugacaucuuccucacauguucccaccuccagaaacuguccucugcaaaucccccgaggagcuccagcuccagcuagagagggguccacaaccaagagggggaacaacugcuauuuucuggggugaacagccaagggugaccugguuccugggggacacagugacagggaccagacagauaguaggggccaccccagaaaacacacagcacgcagucaaaaauggcucugucuucaggacacgugcucaggaaaagcaacacagcaucagauucaugugagcugggucaggccuuccaugcgagggggcggcguggcgcuuuuuaaagaaacuguuggcaacucguugugcgaaguaugugaucgaucuguauugucaguuuuguucaucuugauuuucauauugggcuugucuguguuucaacaagcaauuauggaguggcugccucugcccccggggauguaagggagaagcaagacauugucccuguggugggggaugcagggggugguacaucuuggcaccaggcgguguggaaggggguuccugcugcccggcguggugagcaggccuccccuccucaacugcccaggugugguauaaagucaguccacucagugugguuucgguaaauaauuaacaacagauaaacuuucgaaauaaccaaaauucaggaguaaucaugugacaaugugaaaugcauuugcaagaugugaggauagaaggccccaugguagguugaggagggagcuguggggagaacugaggcucuucggcuugguuuugaacagcguccuuggagggacaggaucugucaggggagucacugaccccugaauuacuggcagcucccaaggcagggggacuggaagagcagggagagcugugcacagccuggagguauggcaggugcuggaaggagcucucuggacaacacacguuucucccuaucugggaucugaggacagugccagccucagagccucucgggccuccccuauuugcacccuucugggggugcagagccacguacgcaguccuggccugucguuugugagcugcaggugggcuuggguacugccucccuccucccugcugucgcagccagguugcuagguagaugccacuggugugggcugagagguucagacucuguggcgacaucugagcacauggagaacagggcauagaugacuccugggagacugagaggcgcgggcagccgucuccaguccugaugcagaaccacugacucgaugcagugggggucguguguaggggugaacgucuuggguucggaaacaacaaagaggucugcccgaggcuucccaggcagcugcgaggagggaugcaacagcagggaggaggagauaagaaggaagcaaagacaggcagacguggcaguggcaggggcaggaggggugcaugcccuggacacucucucugucccccggugcacgcacaggcucacaaaccagggacggagggcaaguggcugcauggcuaggauggucuucuuuucuuuuucuuuuuuuucgagauggagucucacucugucuccaggcuggagugcaguggcgcuaucuuggcucacugcaagcuccgccucccggguucacgccauucuccugccucagccucccgaguagcugggacuacaggugcccgccaccaugcccggcuaauuuuuuugaauuuuuauuagagacgggguuucaccguguuagccgggauggucucgaucuccugaccucgugauccgcccaccucggccucccaaaguguugagauuacaggcuugagccaccgcacccagcagauggucuuuuucaagaggggagggcagagugaagaaaucaagguaagggagggugaagaagccgcaucuggaggacggcacuggggaccguaaccccuggucauuuagcggcagcaggguggggugugcacagguguucuaagccaagggaccaacugccccaggaaaggugagaguucuggguacagaguaggccaaagaggagccuggggauucagggggacccacaaggagauuggggccaaaugucacggcucuggcuugucaugugacaucugcauuccaucccgggacccacgcagccaccaaagauguucuggcuguggaaugacagcgggcguugcccagggagccugguagaaggcagccgccuaacuccgcgugcuggagcgggccuggggguggcacuggaguuucaggacucuccaggugcugcugccgcccgccaaaguuggcauagaccagucgucuccggaggggugcccaguacagccucggugcuaagaauguuaugaauaguuagcauauggauucagaguuguacuccaaauauaauuuuuuuuuuuuuuuuugagacggagucuugcugugucacccaggcuggagugcaguggugcaaucacagaucacugcagcuucaauuuccuggcccaagcgauucucccaccucagucucccaagcagccaccacgcccagcuaauuuuuuuaauuuuuuguagagaugggguuucgccauguugcccaggcuggucucgaacuccugagcucaagugaucugcccaccuuggccucccaaagugcugggauuacagaugugagccacggugcccggccuauauauacuuuuuuaaugaauaucugauauugugagugcuuggccaagguuuuguuuuuguugcccgugggucugaacagaaaguguggaggcugaccaccucagugucgggggguggaguaagcaggcagaugagcugcccugagauugcugggaggagggaaggcgggcagacccagacuucccaauggagagauggucaggagcauggaugucucagaguggcaggcaggaugaagcugguguccccaggaccucccagggcccaccugccuggaccccugcagccugugcccugacgcccuggugcccucgugcauuugcugggacguggcugugcagcggcagagggaagggcacagagaccccgccccgaugauucccaccuuacaacugagggcugagcuacuccccagucagccaggucagacuggagcccagggaaagcuuccggagccccagcaagucagguugagaguguguuuacgcuaagaagcaaauugaggaacagucuuuauaaaagagggguccuaacccagagugugugaacacccagccagagauaggccuggcggguuuggggguggucacaagcccggaaacuguaagugaaguuguguguguguguguguguguguguguguguguguuugugugugcacgcguacguguuuuuuuuguggacaguggcagccgccaacuucucaaaggugccuguggcccuccaaacgucaagucacugccauuuaaaaggagucuuuuuauagguuucgagucuucuguuucuugugaguaucugccuagucucggagcugagcgaugguaacgaucuugccuuucucuccucuuccacccucauucugcacucggccgcccugggcagccaggauccgcucagacacuaccaccacgaggggaguccgaggcagaccuguaaccagcucuggggaaaggaugccaucaguguccuuuggccuccuagcuggucucagggauggcuccaaagaccugggagguucugugguugucuuccauggggaagacguccuugguagacggcagcugcucuuugaucucaaacucugaucacagcuggaccacacauggccugagggaacuccagaccucaccaguuaggaagggccuggugucuaugucuuagauaccugcuucuuacagaauuuauucacuuaaguguuuuuauauuuuguuuuacaauagaauuugggugccuaccguacacagaaauacuauggcaagugugucaaggaauuauuuaguuuucugagacggaguuuugcucugucgcccaggcuggaaugcaguggugcgaucuuggcucacugcaaccuccgccucccggguucaagcaauucuccugccucagccucccgaguagcugggauuacaggugugugcugccaugcccagcuaauuuuuguauuuuuuuuuuuuuuuuuuuuugagacggagucucgcucugucgcccaggcuggagugcaguggcgggaucucggcucacugcaagcuccgccuccuggguucacgccauucuccugccucagccucccaaguagcugggacuacaggcgcccgccacuacgcccggcuaauuuuuuguauuuuuaguagagacgggguuucacccugucggccaggcuggucucaaacuccaaagccauggugcccaucuucaaggaagugagcgcaggaaugcgaagaucaucuugcaggcugcaccucuugcuagagacucuuaccgagguuaggacacuguugagauugugggcccugagggguggaucuuaucagagcuaagauaagccccgaggaaagguccugggguggguauggggagcccaggguggcugugguagagaguguaccacagggggacagagucauuagaacaaaguauggccaggcuugagcccagguggagcagcaaagccuggaggcccggcagugggaccuggcagugggacuccggggaaggcuuuauggccccugcacugggggagagggggcagacaggagggggaugacacugaggaggaaggugguguugagaggcucgcaguuaccaggggagcagagcucccaccugcacuggggaagacccaggagauggaaggcaggcccugagcggggccaugggucgcgggcagacacaggagaugccucuggagcuugacccagugccugggagccagaugcccucuaaccuggucaggagcucaggcggguagaggucucuguugaguucugcuggaaucuggugaccagaaagucucggcgagagggauuugagcuagaacuucagcagacaguggaaauuguguaacggggccuuggagggaacaggaaacggagcauugagggggaagggagccagcaguagcgaggggaacugacauucauagcaaacagggugagcgggggucaaaugcuggccccagauugaguccagcagagcgauccgggacagguggccucucucugcccccacuuccacaccuccaaaaaggagaggcgaauuuccugccucccaggaagcucucggagcuagugggggacaccagcucuuucugcaucaaacccuggcucucccugucuuuguguucuuguuccuccccaccccgcccugagggaggccugggagcagccagggaggugaaucaugacauggugauaaugacuauggcaacaauaacagcuggcagaggugccaagggcuuggagguauguucuugcucuucacuagugucaacccauuuccuucccuauccucauccccauuguacagacgauccaacggaggcacaggcccacuaaggaaccugcucaggguuagcuggcuaggaaauagcagaguaaaagaagagaugguuuuuaggccgggcacgguggaaucaugccuggaaucccagcacuuggggaggccgaggcauguggaucgccugaggucgggaguucaagaccagccuugccaacauggugaaacuccaugucuacuaaaaauaaaaaaauuagcugggcgugguggugcacgccuguaaucccagcuacucgggaggcugaggcaugagaaucgcuugaaccugggaagcagagguugcagugagccgacaucgcaccacugcacuccugccugggugacagagugagacucugucucaaaaaaaaaaagaagaaaaaaagagagagagacggcuuuuaaaaggagguacaucaacagaauggugcugauucagacugauacuggcuuggggaugaauggucuaggcuguggagcugggcugaagcucuacaggugacggauggagccacugaggagggagaggagcuccugaggcuggccuuguucaugagguuugccugucugcuggagauaagcuaaaucaauuaaucuuucucccugccgcaacagagugagcagacauuucaaaugauauuacagauuuguguuuaugaccuagaaaaauguucagagcacaguacuuucaaaagcccagacugggccgguugcagugacucacgccuguaaucccagcacuuugggaggcugagguggguggaucaccugaggucaggaguuugagaccagccuggccaacaucaugaaaccccaucucuacuaaaaauacaaaaauuagcugggcgugguggcgggcaccuguaaucccagcuacucaguaggcugaggcaggagaaucacuugaacccgggaggcggagguugcagugagccgagaucgugccacugcaugccagccugggcaacagagcaagacuccgucucaaaaaaaaaaaaagaaaaagcccagacuggccaggcgcgguggcuuacaccuguaaucccagcacuuugggaggcugaggcgggaggaucacuugagcccaggaguuccagaucagccuaggcaacauagcaagaccucaucucuacauaaaauaaauuaaaauuuuaaaaauuagccaggggugguggcacgugccuguagucccaccuacucgggaggcugaagugagaggaucacuggagcccaggaguuugaggcugcagugagcuaugguuguaccagccugggggacagagcaagacucugucuauaaagaaaaaaaaaacagcuuggcugggugcaguagcucaucccuguaaucccagugcuuugggaggccaagguggguggaucaccugaggucaggaguucgagaccagccuggccaacaucaugaaaccccaucucuacuaaaaauacaaaaauuagccgggcaugguggcgggugccuguaaucccagcuauucaagaggcugaggcaggagaaucacuugaacccaggagguggagguugcagugagccgagaucgggccaccguacuccauccagccugggagacagagcgagacuccaucucaaauaaauaaauaaauaaauaaauaaauaaauaaaugaauagccaaaauuucgaaggcagaugaaugccaauaauguucucaagaagcaauaaaacauuggguuauaaccugugccucugaggacucaaggggaagucaggcaggccccagccagcguuagucgcagcugccugcucucccaggucagcccuugcacccucgcagaggaagccgucccuuccgccucucuccaucauaaagaaaacuucucugucucuccauucacgucccaaaugccuucuaacuuuaaaauaauuacacaacuauauguguuaaucauggaaaagacacuuaagcaaaaagcaagaaaaaucauccugauuguauccauugccuagaauuuuuuuuuuuuuuuuuuuuuccccgagacagaguuucgcuccguggcccaggcuggagugcaguggugcaaucuugguucgcugcaaccuccgccuccuggguuuaagcaauucuccugccucagccuccagaguagcugggauuacaggugugagccacugugcccggccuauguuuuuuguuuuuuuuuguuguuguuuuucugagacagguucuugcucugucacccaggcuggaguaaaguggcaugaucauggcucacugcagccucagccuccugggcuuaagcaguccuccuaccucagcuucucaaguagcuggaacuaugggaccauaccagcacacccagcuaauuuuuacauuuuuugucgagacgagguuuugccacguugcccagucuggucuugaacgccugggcucaagccgucuucccaccucggccucccaaagcacugggauuacaagcgugaaccacugcacccagccugcuuuugagcugcuuuauugagauguaauucacauaccaugaggucacuccucuaaagugcacaguucagcgguuugaguacauucacagagccgcacagccaucaucucuaauuuugcagcuuccagaguagggccucaacguggguucacgugauguuuccccagauagacucaggucaaacgcuguuguuagagcccugcagagccgcgggucucagcccuuguugguauggcgagguccuguagccggcagucggccucccaaaauguuguuggcuuuuuccagcgguuggcaaacuagacccacugcugggcugauggccuguuguuguaaauauuuuuuuuucuuuuugccaccacacccggcuaauuuuuguauuuuuaguagagacaggguuucacuauguuggccaggcuggucuggaacucccaaccucaggugaucugcccgccucggccucccaaaguacugggauuacaggcuugugccacggugccuggccuagugcaaauaaaguuuuauuggaacacagccacgcccacugguaaggccaaacccacguggcuuuugugcuauaacaacagaguugaauggcggugaucaaggacuguaugggccucaaagucuaaauuacuuaccagcuggcuguucauagaaaccuuuucggauccccagccuaagucaucgcaggcugauggcacaggucugggcuucccaguccuuguguggcuggcuccucucuccccggauugccuguucccugcuuuccagaagcaagcagguggccugggaagaaguggaaccugcagggugucauucuccaagccgaugcugaagaugcaaugccuucacccgccucuucugugcucuucaucgcacgggugggcuagagcagggaagauggacuuucaggcuggagccuggcuuucuguggugggauguucuguggguaccgagacccccuuacugcaucuucagggacagaaucuggcuuggguugagaguuuauuuggcccuuucugaucuguaaucgggagagauugauugagcuuuccugacacagacguggcaaagcaaacuggcaguggggcaggcuuugccaaggcucgucaugguagcggaggccuggacagagcacccgccaacagcugcugcuuaaccaaggacagaaugaggaaauggacauuucagagaaaagaggcgacaugaaaaguauuggagaaaagagccugggcuuuggagucaagugggacugguucugaaucccgacugugugccucucugagccuugguuuccucuucuguaaaagcaagaucagacucuucaguguggugccaugggagauucauauuuuuuuuuugagacagagucucacucuguuguccaggcuggagugcaguggcacaaucuuggcucacugcauccucugucucccggcuucaagcaauucuccugccucagccuccccaguagcugggauuucaggcgugugccaccaugcccaguucaauuuuuuuuuuuuuuuuuuugguguguuuuuaguagagauaggguuucaccauguuggccuggcuggucuugaacuccugaccucaagugauccacccgccauggccucccaaaguauugggauuauaggcgugagccaccacacccugccaagauuaaauuuuugaugagugagucaaauggaggccaggugggguggcucaugccuguaaucucagcacuuuuggaggccaaggugggcggaucacuugaggucaggaauuugaaacaagccuggccaacauggcgaaaccccaucucuacuaaaaauauuuuuaaaauuagcugggcaugguggcggguaccuguaaucccagcuacucgggaggcugaggcaggagaaucacuugaacccaggcggagguugcagugagcugagaucacgccacugcacuccagcgugggugacagagugagacucugucucaaaaaacaaaaaacaaaaaacaaaaacaacaaaagcacuggaggggcucaauaguuaguuaguuuguccuagacccuucuagaauguugagauccuggacagugcuucugagaaaccugcagucucuguccaaggagcccuuaaggaagaaaggcaggaguguggggcaggaagaccagcuuccccuuuccauuccacacggcuggcucgcaauauucuguuucuccugcgacagccugguuccucccugcuccccagcucgccucugccaccauucuucccucaguccagaucaagaguucaagggacggggacagaugaucagaaaggcccagcucaggcaaggaaggggagaaaagggaacucguauaugcggugggugggaauggaaaguaguacagucacuaugguggagguuccucaaaaaacuacaaauagaacggccauaugauccagcagucccacgacugggcauuuauccaaaggaaagggaaucagugcaucagagagacaccugcacccccaugguccuggcagcacuguucacaauagccaagauauggaaucaaccucaguguccaacaacagaugaauggcuaaagaaugaaauaguauuucauuguggauguugguacaucuacacaaugaaauacuacucagccauaaaacagaaugaaaucuugucauuugcagcaacaugaauggaacuggaagacguuaagugaaauaagccaggaacagaaaguuaaacauggcauguucucacucauaugggaaagcuaaaaaaaagaaaaguugaucucaucgaagucaaaaguagaacagagaauacuagagucugggaaggguugggggaggagagagggagagauuuguuaaaggauacaaaauuacagcuagauaggaggaaugaguuauaguguuccaugucacuguuggauuaauguaauuaacaauaggccaggcgguggcccacaccuuuaaucccaacacuuugggaggccaaggugggcggaucaccugaggccaggaguuugagaccagccuggccaaaauggugaaaccuugucucuacuaaaaauauaaaaauuagccaggccuggugguguguaccugugaucccaguuacucaggaggcugaggcaggagaaucgcuugaacccgggagguggagguugcagcgagccgagaucacgccaccacacucuagccugggcuacagagcgagacuccgugucucaaaaaaaaaaaaaagaaaaagaaauuaacaaaaguauauuguauaguuucagauagcucggaggacauugaauguuccuaccacaaagaaagaaaugcuugagaugauggcugugcuaauuacccugaucugaucacuauacauuguauguaucuaaacaucacuauauaugccauaaauauuacaauuauguguccauuaaaaauaaaggcccagcccagcucacauaaggacggcagguguguuccuuaaagcaucacaccgggucccaguacuagacggacacuccgccuccgguugugugacucugccuuuucugugcccuaguucccuguuugcuccagcuaguugagaauccacacugccugggucacagugcccggccugggucccguaauguuguggggggcgggggguggaauaagggagaaagccaggagugccagcaaggccggcuacuuggagugucgguagcaugacgcugcacgucuagagcauguacagaaacccgaugagacccgagccuuacggugacccuagguacagaggacguuugucaccacugggucucucuaacacugggaaggugacauaauccguuugcccacggucacacgggcagcuggggguccagcugcaccauggccaggccucuggcaccaggugaugggguacggggugcuucagugacacagcacuugacgugacaugagggagaaaggacugggugggggggucauucgugggcuucagguccggggggauuauuaugcucagaaggcaugugcugacacuguggcaggagagcucuggggacaggugggcuccuugauuuaucuuuuuuuuuuuuaaagagaugagggucuugcucugucgcccaggcuggagugcaguggcgugauccuagcucacuguagcuuuaaccaccugggcucaagcaguccucccacuucagccucccgaguagcugggauugcaggugugugccaccacgcuuggcuaauuuuuaaaauuacuuuuguguuuagaaaccagaucuugcuauguugcccagucuggucucgaacuccuggguucaagugauccucucaucucagccucccaaagugcuaagauuucaggcaugagccacugcaccugaccuaccuacuguuuuggggcaaaggcuuagauggacacgcacacacaugacucuccugggcuucugguucagcacuuucucuucugggggugcuccucucauuucauccucaauccugagcugaccccagaagccaaggaccagccugcccagcccaggcagaaacugaguaugccaagaggaauggggucaggguggagcugggaugagcauugcuggccugacucucccuugugaggucuuguccacuuggcccaguuggcuccagggcagggaauaaaggaacagucugugguggucuucccuucugugcacuaguucuggaaagcagggauaaaacaaccaggcaaaugcauaaaaauacugucgagggcuuuucagcacaaaggacuucacaucuuccuuauuuacaaaggcucugcgggggaggugaggcagguguuuggauggggagcagccgaugacuugcccaaggucacccacagaguggcagugccaggaauccaaggggaaugauccuggcucgagucucugggaagaagauuagauuucacagcuuuggauuuaacaucacuuugcuccuuuuggccaagaggcauguuguccucagaaggccuuggugacagguauauuuugccuuaauuugaguaguuuagaggcauggaagggcauuuuggcagcagugaucaaggacuuuaaaaauaagucuucccuuugaucaggcagcccuauaucuuggaguuuuucugagagaaauaauuuaggacacauggaaguauuuagcugaaggauauucaucuccgucuugcuuaucuuacggaaacguuagaaacaccuauauauacaguagcaggggcgugguuaaauaaaucacagcaucagaugcucugcagacaucacaugguauagcuuuuucuuuucuuuuuuguuuuugagacagugucucgcuuugucacccaggcuggagugcaguggugcgaucuccacucgcugcaaccucugcucccugggcugaagcaauccucccaccucagccucccaaguagcugggaccacagacacacaccacuaugcccagcuaaguuuuuguauuuuuaguacagaugggguuucgccauguuguucaggccggucucaaacuccugagcucaagugauccucccaccucggccucccagagugccgggacuacagacgugagccaccacaccuggccagaacguuuggacacaugaggggacauuagacuuucuuuggcaaggguguauuuuccaguugcucuagaaugaacaugaauuccaugggugcaccuguuuuacuggacuucgcuauauugugcucugcagauacugcguuuucaugaauugaauaucacggcuggcucaacucugagucuaucggugccauuuuuuucucacaucacguguucacuucauguguuugugucccauuuuaauaauucuugcaauauuucaaacuuuuucauuauuaucauaccuguuauggugaucugugaucaguggucuuuggcguuacuguuguaauuguuuuggggcaccaugaacugugcccacaugagauggcaaaguuaauugauccauguugucuguguucagacgacuccaccaacuggccgacuggcggcuucuggucucucucucucugccuaggccucccucuuuccugagacacaacaauauugaaauuaggccaauuaauuacccuauaaugggacugggcguggggacucaugccuguaauuccagcacuuugggaggcugaggcgggaggaucaccuugaggccaggaguucgagaccagccugggcaacacgacaagaccccaucuccacaaaaaauuaaagaacuuagcugggugugguggcacaugccuguaguccuagcuacucaggaggcugaggcgggaggaucacuugagccugagaguucuaggcugcagugagccgagaucacaccauugcauucaagcuugacagacagagcgagacgucucuuacuuuaaaucaaaagcuaggagugauuaagcuuagugaggaaggcguguugaaagccaagguaggcugacagcuaggccuuuugugccaaacagccaaguugugaaugugaaggaaauuaaaaaaugcuacuccaggugaucacacaaauaauaagaaagugggccugccggccagacacgguggcucacgccuguaaucccagcacuuugggaggcugaggcggggggaucaccugaggucaggaguucaagaccagccuggccaacaugguaaaaccccgucucuaccaaaaauacaaaaauuagccaggugugguggcgcaggccuguaaucccagcuacucgggaggcugaggcacaagaaucgcgugaacccgggagauggagguugcagugagccgagaucgcaccacuguacuccagccugggcaacagagcgagacucugucucaaaaaaaauaauaaaaauaaaaaagaaaaggaaaaaaaagaaauugccacagccaaccccaaucuucagcaaccaccacccugaucagucagcagccaucaacauggaggcaagacccuccaccagcaaaaagacuggacucacuaggucgagaugauuguuagcauuuucaagcaauaaaauauuuuuauuuuuauuuuuauuucuucaaguuuuggguuuuucuuuuuuuugaggcaggaccuugcucugucacucaggcuggagugcaguggcaugaucuuagcucacugcagccucgaacuucugggcuuaagccauccuccugccucagccuccugaguagcugggacugcagguacgcaccacuaugccuggcuauuuuuaguuuuuuauagagguaggaucucacuguguugccuggcuggucugaaacuccuggggucaagccaucuaccugccuuggcuuccuaaagugcugggaugacaggcgugagccacugccccggccaauaaaguauuuguaaauuaagguaugugcauugauaagacauaauguuauugcacacuuacugggcuacuguacaauguaaacauaacauuuauauuugggaauauauauugguuugggaaaccaaaagagucaugugacucacuuuauuucaauauucacuuuauuaugauucugugggaacucaacccgcaguaugucugaggucugccuguaccuguaauuuuuaaaagcuagcauuugcuaauaugugguucuaauugcagucaacaauaguauggacccagacucucaaggcugaguuggccuuaggccaguagugaaucccaugccagagagaacauuuagcagggcggauuaauccagaggauggggcugccuucuagagcuugccaaggcagcgucaggagagcccaggcuugagagagauguccucaguccagaaaagaccugacgagcacuuggcagucgugcuggacauucugcaagggccaucgaaggccuagcgugccauccuguugguccccaugcuauuuccuccucacuagaaccucuccccuugcuuuagaaugggcgucaaggccacgcugagaggauaaaagauguagggaucuucuccgaggaagaagcauauagaagauuuuguaucuauggguccguauuaggguuucccagagaaacagaaccaauaggcuccauccagcugcguaagaugggauuuaugugggaauugacucaugcaaguaugaaggcugggagguccuggaaucugcugucugugagcuggagcagcagggucacuggugcaguaaugcagccugagucucaaagccugagaagcgggguggccacugggguaaguccuggagcccaaaggccugaggcccaggagcucugagguccaaggcagaaagaagguggaugucccagcucucucucuuuuuuuuuuugagauggagucucacuuuguugcucagguuggaguucaguggugcgauuucggcucacugcaaccuucacuucccugguucaagcgauucuccugccuuagccuccugaguagcugggacuguaggugugcgccaccacgcccgggucauuuuuguauuuuuaguagagaugggguuucaccauguuggccuggucucaaacucuugagcucaggugauccaccugccucggccucccaaagugcugggauuacaggcgugagccaccgcgcccagccuggaugucccagcucuugcagagggaggguuugccugccucugccucugucucuuuguucuguccgggcuuucaacagauugagugauggugccccaccuggcgaggagggaucuucuuacucagucccccgguucagaugccagucucuucccagagccacccagaaaucacguuuucccagcuaucugagcaucccuuagcccgucaagcugacauaaaaugaaucaucaagggcugcgaagauggacuccaaaagugggcggggguagggggguggugguggacugugaucgagaacauuccugcagggagaaugccucccuucccugagucagggaccagauaaccuuuccaggguccuuccagcccaggacaaagggcuuugucucagguucagcucuccugagaauucauccuccccgagauuuggacaccucagccgaauuccugcuguuuaccuucuucucucaagaaacaacaaccugaggauuguugcuuucacuucuucggacccaaaucaugauuucccagccacauuucucaguugucaaauuuguggaggaugcuggaagcuucuagugaguugcuuacagaugauccaacuggcggcuuacuaaaacauaucuugggcugggggcgguggcucgugccuauaauccuagcacuuugggaggucgaggcaggggaaucgcuugaggucaggaguucaagacccgccuagccaacaugguaaaaccccgucucugcuaaaacacacacacacacacauaaauuagcugggcaugguggcaugcaccuguagucccagcuacucagaaagcugaggcacuagaaucccugaacccgggaggcagagguugcagugagccgagauugcgccaccguacuccagccugggcaacagagcaagacugucuaaaaaacaaacaaaaaacauaucuugacaaugccagucaucacuuuaccacagaccuuaagaugccaaccacccagacuaggucaggggcccccauuuccagcagcuacuccugcuuccuggaaacccccugcaccggccagacucccccagugucccauguucauccccagccucgcccugccagcuucccucgcccauccuucugaucaaacugucuguggggaacuagcccucaaacgaggccaaguacguguggcuucuccuccugugugggcaggugguugacgggauucuuucuucccccgccuccaguggguuucaguuuaacgauggcuuucuggagcuguuuagaagcgugaacagaugcugucccuacaggagaagggauggcaggcguugucaggaacccugaccuugaaguguaccuccuuaauggccugacagcucagagagaaugacacccugggaggucuccaugcagccagcuggggacaaaaagauguccucugccugguauggccacgagcauuuguacauugcacuguccuuguucacccacaccuccuuaaacagugccuucaggugcccccauggcucccggcugcuugagccaaaucuuuaugauugauccccuaaccuacacgcuugcccccuggcuggcucacagcugucccugaccucaccccugccaugaugucacagcucaacagcucugcuguucccauggcaacagccugcuaugaguagccagccagggcagaggccgggcugcagguggaggcggggaagcgauuccggccaccuuuggucagugggccccugagaccacugcggggcugaggcucucugugucuguucccaucuguggugagggugggguucuuuccaugcccagcuguuuagcgaggcucccaagagggccccggagagugggccaaggaggggcuccaagccguggguucgcaaggccagcggcaaagucccugcaccacggggcuccccacaggcagugugaugggaaggagagugagggaagcuggugggacuggguuggagaugaauaugguuguuggaggaguugggcuggggggucuucaggaagcaggaacaccugcugggauuggggaccccugaccuaggcugggugcuuaggaucuugagguuugcagggaagcgguaauggacgcugucgagguauguuuagugagccaccgguugcaucagcuguaagccccccacguggggagcuggcgucucagcugggaguuuggaggucagucugccucagugucugucucugugaagcuggucaaggggaggccugagcccgagcuugcccccagaggcugccugcccaaccaucuccacccuggagagcugacccagcccaggauauggauacacacagauucaugagcuguggccccaguauucggguggaaaagccugcugugggccuagccaggacucauucuaacgugacccaccccugccccaggugaugcuaacacagccaguccaaaacccagugcaggcugggcaugguggcucaugccuggaaucccagcacuuugggaggccgaggcgaguggaucaccugaggucaggaguuuguaaccagucugaccaauauggugaauccccgucucuacuaaaaauacaaaaauuagcugggugugguggcgugcgccuguagucccagcuacuugggaaggcugagacaggagaauugcuugaacccggaagguggagguugcaguaagcugagaucgcaccacugcacuccagccugggcaacauagugaaaccaaaacccagugcaguggcuugggacccccguccccccgccaccacugggacguggcuaagaguuggggagaagagggcgaaaaccaagccucuggcagcacacagcgugucauggaggguauuuuuagaggcuagaacucagagaaacggaguuaaaaauguuucugauguuuguuuuaucugggcuugguucggaugccuccagugaugggcgucucacuaccuacaaagucagcccagugauuucaagacagcccuggagacagugcuuccugcccuccugucagcuucugccucccuguaauguguucuggguggucuagcucagucaucuggagacacacacaguaaguaccaccccucuuccccaagcauuucaggugcuucucguggugacaagcacuggcaucucuguagaugggugcugcuguuguuaucauccccauccuaaagagcaaacugaggcacccagagugaagucgcuuggccuaggucacauaguacucuuaagcaccauacucugccauucuagacuuuucuauccuuugcaaacacccuugccccaccucaccuccuuuggcuuuucuuccuaggaccuuuggucagugggccccuccugaccaaaggaguucauucuccuccuggacuccaagccugcggccucuucuccccguccuuaccgcccuccuccucucccgagaacuguccaggaagacacaccucucccucguucagauuugcuccuuguucuucagcccgugcaucuccuuuaggucuugaacaguucuggacagguuuauuccugaucauuucaucacgguuuuauugauuuugaaacuuuaucccgugacaugaucaaauuggccauuucuagagcacaggcacuucguagcuguugaccaucauuuagcuccacgucugcccgucgguuccucgugcguggaauccagcaccacgugggugucucugccgagcucucggcauuuccugagcccucccggaagccagacucuguucucggcgcuucacacgggccgucucgucugaugcuguggcguccugcagggugggaacgggcggugcccguggacguggcgcugugccugccggcguccugggcaccacagcguugccgcuugcccacugccuccuagcauggccaggugaggucgggcuggcugggcugcaccauucgcucgcauguuagaggcguuucuguucacucaggggacagucacguuggcccuucugguggcccagcgucuuuuguccccugugcugcuccacacacccaccucuguacuugcauaguuggauuuagggacccacauauaaguuuuagauguguucccauuaccuuuuuuuaucuuguaagauuuggccaguugugcaagcuguuaaaaaccucuaggcuagagucuagcaacaauuuuccaccucccccaaggguuaucuguauccggggaugcccacagcuuugaauugauaaggucaggugugaaagcucaggcagugguccuguggaagagcccaccaccaccucggacucuacuuacuuuauuaaaaaacacauuuuuuuuuuuuuuugaaauggagucuugcucuguugccuaggcuagaguacaguggugcgaucuuggcucacugcaaccuccgccuccuggguucaagugauucuccugccucagccuccugaguagcugggauuacaggcauauaccaccacaccuggcuaauuuuuuguauuuaguagagacgagguuucaccacguuggucaggcuggucucgaacuccugucgugaggugauccagccaccucagccucccaaagugcugggauuacaggcgugagccaccgcgcccggccaaaaaaaccacaauuuuaauaagcuuguuuguguggcugcugucagacaguuaugaccagggaagggaggacacaggaagcucuaaaaaggcgacuuaaaaaacccaaauugcauucuggggucacuuaguuuaugggaccucuguucuuuacauuuuaaaagcccucgagggauuuccuauauuaucaucccaaagacaauccaaaauuucccccaaagaaggucaaauuacauauucuacguaggcgccuuagacagagaaaugucuaacuuuccauaugaaaggguaagcucuaauuauauggaaauguucucucucuggccgaugccagcuaacggagcccuucuauagcuauuuuuauguuucaaagacaaagcgcuugacuauguggcccgggugcugggcuucuggagaaagggaagagcauucucuuuguucccuuggaggguuggggcauccugggggagugggaacgaggccugggcuggggacaugcggguaggauggggaaggggguguguccaugucacgaggaaccugcaugagcacauuccaggcgcugcuggguguggggcauuugggaauggccaggagcucuaccaccccugucuggugugcagcguuccaggcuaggguggcucccaggggagccagggcgagcugcuugaccguucucaagccucuaggcccagagauugccaggcuuuggcagggcagcuggugaacuggcugcauuccugggccccucccgcaggggcugggauaggaucugucaggggugaggcccaggaaucuaccccuucaccagcagcucagcugauuaugaugcacguggcugcggguugcacucagagacuugcugguguggacagcagggaaucacaugggggaugcugaaauguaacccaggucucucaguuagacagcgcugggcugcagugcgggagaggacggggugcaggccugggggucgggggcagagaggcugauugggaggcuuuuaagggccucaggugagagaugaucagggcugagcugcuggcaggggaggaaggcagagcaagaugcagcuuccuggaagagaugguuugccagggccgcaguacuccaagcguggucccccagauggcagcaucagcaucccugggagcgcuuuagagaugcagagucuggcgggcgugggggcucacacccggaaucccagcacuuuagagaugcagagucuggcgggugcgggggcucaugccuggaaucccagcacuuugggaggccaaggcgggcagaucacuugaggucaggaguuugagaccagccuggccggcauggugaaacccuaucucuacuaaaaauacaaaaauuagccaggcaugguggcgcgugccuauagucccagcuacuugggaggcugaggcaagagaauugcaugaacccaggagggggagguugcagugagcugagauugcaccacugcacuccagccugggcaacagagcaagacuccgucucaaaaaagaaaaaagaaaagaaaaagaaaugcagagucuugggccccacccagacuauugaaucagagccuaacuguuaacaagauucaagcagcaccauggccaggucucacccuucugugcauguugacaaaucaaguacuugagcagaaagaagauggggaugaucgacgugaugaacucagaggcaccaaccgugguguccugggucgaugcacacagaaugcacgcaggccccuugcaggccuucccacccuucagaagcucagcacaccugucagggucacaggagggccagggaggucagaggucacgugaggccaagcacaguccaagcagagucuccuugugcuguggaagugguuuccagcucugaccucccugggcagcaggcuaggagccuggaucaggggccugccugcucggcccggaaucccugcugcccugauuacgagcuauguggccuuaggcaaguuacuuaaccucucugagucucaauuucccugucagauugugcggauaggaauaggccucaccuccuauggugaggcggugagauggagagagguguacgugaaaugccggaagaguaugaaacccugcgggucugcgugcugaucagugugaugucuggauucaaacccagcuccuccguguaagcugggaaaguuauucagccucucugagcuuuuguuucuuuuugugagcucagaggggaaaucaaggagagcuggaggcggcagggacaagguugcauccgauggugucaugggggaaaucaauuccugaaugauggagccagcugugauuuucuggacuuuaucccaaagaccucugcccagauguuuuaaguuuguacccauuuccgugucuccaggaaaaccgacacagcagccccgcuggcuccuuucacagucacccucuggaucauguugcagugacucuagccaaggguauggccugugucgugucuguuacaggccgaggugggaagaaaagguugucccuguaucuggaggggccaguucaugccuugaggaggagagaggcacucuggguccugccauuguccucagggauggccaugcuugccauugucccacgugucuguucggggggguccuucuccuggggauacaacgucugccgcguugauuuuugggugucuaaguguaccgggcuaguaucacauugagagucacccacuguggguggauucacccauucccgucauggugccuggggcuccagcagccucgucacaacacagccugguaguuggagggucugagccuuuguuacaaccgcccugacuuagccgcaggacuaugcaccugguggggacuggggugggcggccacucucucacaggcccaccccaaggcucuagaugggcacgugcauuguucaaaugccgucauaccuugggggugcgagggggcagcgugaggcagacgagagaggcggaggucucacagugaaccacaggaucugguauccugcagccggggugcaggccugacuguggagcccccauucugggcgccucacacucccuaugacugugaugcuugccccccgccccccgaugccacaggagugcacagcaggccuggagucuccuucggagggggugaggaggccggcggggggcgggggggugcugucugugggcccuggcacuuccacgcugccuggguggagggucccugggugaggucugccuuggcugaaaagcugucugagcggccgcccagggaaaggcgagcugcuuggacgucauucucaagcuguaggccagagguugccugacuuuggugagaaucgcugggaaucugguggccaagcacauuccugggcccaggugcugggaucggaucggucugggguggagcugccaugggcuggcuccugcgcuggggccacggggcuguagagagcaagagaggagaaugggcccaguguccacuccgcucugugggaggcccuggugccguccggaggccagauugguguccacucgccuuccuucugcugcuccgagcgcggcuucugcggaggggggagcugugguuucucugagugguugaaggcagccagcagaaggcaggcuugucagcucgggguggcaggaccagagggcagcaggggaguagaaaacaccaaagcagcccaggaugcucagaacacucagaggauguggaggacagaggagcgccaggaccccugccccuucuagaauauucuaagcaaccagagagggcaggugccucugggaggggagcuguagcgagggcccugauuggaaccauggcugucuucauuggcaaguguccugccaagggcacccgacguccugucuggcagggcuggagagacacugggcugccuggagaucagccugggcaucacaggcagaggcaggcaucccagcaggcugugcaacaggugaacggcuguuucuccuuggucaucuugggcucagcuaaggcucuguugcuuucccugccagugccugcacaaguccacgugagacccugcccucugccucaaguuaguaaguggggagggucucagaggggagagcaaggagagcugggguagcggggacgagguugcaucugauggugucagagcggggaucgauuccugaaggauggagcuggcugcaauuuucuagacuuaucccaaagaucucugcccaaauguguuaaguuuuuacccguuugcgugucuccaggaaaacugacgcugcuucauugggaugcccacgccaguggggcuggcacggggugcacugaggucauugaacgggcugggggcacuuccagagcagggaagacuuguccagguuuuacuaauuguugguugacaaggggugugagccaacggcucuuggcacagaaauagacugugaaccuuggggccuccaggcaccuuccgagacacacagaggggcauucacagcagccccgaccucaccacaccuaauuggacaucccuguggccguuccugguggucuuuggugucugaggccaacuccuccaugugagcugggaaaguuauucaaccucucugagcuuugguuucuuuuuguggacucaggccuucucuugguuauagaccuaggaguggaaucucugggucauaggguaagucuguguuucccuuuuuaagaaacugccagacuguuuuccaaaguggcugcaccauuuuccauucccaccagcagcgugcacaggguuccaauuccucccccuccuuccucacugacaguugcuauugucugucuuuuugacgacagccguuggaguggaugugagguggcaggacacugcagggucagugugcauuucucuaaagaccgcugccguugaacauguuuuuaugugcuguauuagccacacaucuauguucuuuggugaaauaucuauuuaaaucuguugcugauuuuuauuuuuauuuauuuauuuuugagacagaaucucacucugucauccaggcuggagugcaauggugcaaucucagcucauugcaaccucugccucccagauacaagcaauucuccugccuuagcuucccgaguagcugggauuauaggugcguaccaccacacccggcuaauuuuuguauuuuuaguagagacgggguuucaccauguugguuaggcugcuuucgaacuccugaccucaagugauccgcccgccucagccucccagugugcugggauuacaggugugagcugccacaccuguccuucuuuugcugauuuucaaaugggauuauuugccaucuuacuggguaguaagagguguucauauguucuggauucaagucuucuguuggauauaugauuugcaaauauuuccuuccaguccguaccuuguauuuucacuuuacuuaugguaccuuuugaagcacaaagguuuuuuuuuucuuuuaauuuugaugauguucagcuuauccguuucuuuguuuauugguugugcuuuugguguuguaucuaagaaaucuuugccugacucaaggucaugaauauacaccuacguuuucuucuaagcguuuauaguuguagaugaaggucuaugauccauugugaguuaauuuuuguauauagggugagauaaggcugugaauucccauuuuuugccuguggauauccaacugugccagcaucauuuguugaaaaacaaaaaaacuauucuuuccccacauuaaauugccguggcaccuuugucaaaaaucucaaucauugcauugaagggcccagcuuucucucucccuuucucucuugaucaucauggugguuggcagaucuggcuaaauauaauauuaaccacuauucuaauugugugaucugauuuaccaagaggugcaaggaccucccacuagaagacuuaagucaaagccagcugcagugugaccaccugagguuggucaaaggugcugggguucguccaagcagcagagggccugucucugccacuuaccagcugugugaucuggguuaagcaucuucaucucugccugccucaguuucccugucugugaaccgggggggguaggagcuucguaucucaaaggauuacuguaaaaaagaugaacggauacaugcccagugcucagaggggagccugcacgguuaauguuagcuguaauguagaugcaguauuuucugacuccugcaacuacaugugacuucagcugcaacuacguuugacuccaaaggcuuagccugguuccacauagacuaagaugaaagaagggaaggagcaguggagggggacuccauaucgacuguggcugucccuuagccuuuccugcagcucacagaucuggcuguuucuggcaucagcuacccguggcaacagacacaaucccguacuguuuugguguaaaugccccuccuuuccuaggaaggccugccaaagcaugggucccuuccugaugccaaagagaccuggaagaguccuucucugaucauuauaaaaggaaagagcugggagucaugaagagagagcuaacaccagcuucuccuccucucugguuucuacuggauucaaguaucagacuugcaugcacacauacauaccugcaugccccacacggacacauacacauacacacaccgacaugcacacagaggcacacacagacaugcauacauacacacaccuguacaccccccuguacacacagaugugcaggcaugugcacagaaacauaaacagaugugcacacgcacacaccccugcgcgcacacaccccugcacacacaccgcuaugcacacacaccccugcacacacagccccacgcacacaccccugcacacacaccccuaugcacacacaccccugcauacacaccccugcacacacacuccuacacaccccugcacacacaccccugcacacacaugcauggagacacacacacccuugcacauacaccccugcacacacacccuugcccgcacaccccuacacacacaccccugcacacacacuccuacacacacaugcacacacaccccugcacacacaugcacacacauccuugcacacaccccugcacacacauguaugcacacacaccccugcacacacauguacgcacacacaccccugcacacacaugugcaugugcacacacccacacacaccccugcacacgcgugcacacacuccugcacacacacaugcuuggcaggcuccucccugccccgucucuuccuccuuuccuuuacgaucaauucucccuccagaggcccagacuuccucuuuuacuuccaccugcucuucucaauauuuguuuccaagggcugcccuuugugccccuccaucccuaccugaauccuaacccuugcccuuugggugggauugucagucucggcacuacugacaucucuggccagguuauucacugucuugggcagcccuccugugcagugugggguauucagcagccucccucgccuccacccagcugcaggcccggagcaccuccucccugcauuugugacaauagaaaauguuuccagacauugccaauguccccugggaaacaacaccacacucuguucaaaacagcugcccuacaggcucuugucaaaaguguacaggacagaaauugggaggcugagagugggcccuggugggcacgggucaagagagcuuggaggggcacauuuugcagccuguccucacagugagaaucccgugugcuugucuccagggcuuugcucacucuccugggagcgaucuggaaagcugcacuugugcucccuuccucguagguuugcuguggaacguuguggcuucuguggcuccucaggcccgggggcgccccuugaacccuccacucuuggcuccaagcaccuucccugggaagcuguaucugcuggguucgcagacaggaacagaaacauggauggagccauguggcugagccucuguccugauaacgaagaccugcuuuggaggaaaaagcacaaauugcuacaagcccggggcaaaggcgaucucgcucugcagagaagagcggaugccaagcuguggaaaaacuaccagcuccagcgcuuggcugaggaguugaggagaggguaucaggaggcacagcaccugcacgucgguggccuggacaggcugcagucagcacgucuguugggcuggggaggaggacgggccagggaaaaugagccugacucgcaggggcccauccagcgaagaucagccaggcccccgagggccaaggagaagcauagagcagcccuuagugaagagaggaguugcagggaagaguugggccagcaacaccccaggcacuccaggccccggaagacagcagcgaguccagagaaaccacagacuacaaaagccacgggucggaugaauucucaccuggccccgccugagaagagaaagggaaggccagaaccuucgaccaagucuggggguggccgcugugccauccauccucggaggagcaaaggggcggaccuagaaaggucaaacccacucguggcugcugugggagaaaucgggcuuguggaggaaaaagagaaaggaacagcucgggcggggaggaggcaacugggaaagggggcaguuugcuuuguuccagcccugaccagucgcucucagggacagagucuggaggggaagcugagagaccucgggcagcuguggccagcugauuccagcugcagaagggaagccguguccccagcaucucagugcacgcuccgggagaagaacaaguggcagaaagagcuggaguuggccuuugaagaguuguuuaauauaaacagaaagcugaaaaaacaccugugcuuguaccuggcacugaagcccaggauggaccagagaccuggggaagggcaugccuucucagagaugcaagaguguggcgcugggaccccaagagggaagaaaauggcagacccagagaugcugccugccggggaacccaggagcccagcagaggaggaggcgcagcaggcagcguccaagaccgacuugaaaacguucaugggcaaggcccagaaccaaaaauaucagggcacggucaagcccacguuuagaaauggaagucaaacauugucucccgaggcagguauauuuaucaacaaagaggacucauuauuguauagcacugaaucuggacaagagacccccaaacugggcacgcuggcagagggcucccuucagcuccaccuucaagaccaggcagacagagugggcucgacggcauccaggcaaaggcagaaagcagagauggagcagagaagacaaaaacaacuggaaucgcuugaacaaauggaacacccagauaugagcuuggaaauccacuacaaagcugagcuagaaaaagagaggagggagcaaagaagagcucgacuggcccaucugaaguccuccuccacgagagcccaggaaagggagagaggaucugagcucagcaccacuuccccaucgggcaccagccucgccgacgacgaccggcacagucagaugauccgagaccagcagcagcagaucuuacagcaaaacagguugcacaagcaguuucuugaagaagcccggaaaugcuugcgggaguuucagaacauaugcuaaaugcgagaggcccacccgggguaaauacaucacugauaauggugcugccagcacugguacccgggucucuaagaucuguguuugcgucauugccucagagacuauuaggccucuuuaaaaugggcaaucuggggccgggugcaguggcgcacgccuguaaucccagcacuuugggaggccgaggucggccucaggaucaccugaggucaggaguuugagaccagccuggccaacauggcgaaaccccguuuuuacuaaaaauauaaaaauuagcugggugugauggcaugugccuguaaccucagcuacucaggaaauugaggcaggagaaucacuugaaccugggaggcggagguugcagugagucgagauugcaccacuguacuccagccugggugacagagugagacucgucucaaaaaaaaaaaaaaaaagcaaucugucauuauaccguccuccagggcacauucccucacagggacucuuucccuaaucuugccuuuauugauugauugauugauugagacggagucuugcucuguugcccaggcuagagugcaguggugcagucucgacucaguaccucugucuccugggcuuaagcaauucuccugccucagccucccgaguagcugggauuauaggcgccugccaccaugccuggcuaauuuuuuguauuuuuaauagacacaggguuucaccauguuggcuaggcuggucuugaacuccugaucucgugauccgccugccuuggccucccaaagugcugggauuacagacuugagccaccgcgccuggccuagucuugccuuuaaaacgaagucccuuuugggaaaccaccuauauacaaaaauaggaacccguguggguuucagugggugugucuagcccaugugcuguggaugcaucucccagagccgaucaugucacuacauuccagccugggugacagucuguuuucaggggccacaggcacagauggagacuccaggucauuuaagcccuucagauguuuuagccaaauaaacacuggccuuucaggggcacccaaggucagacgggcacaauuucaggagauagaucacuuagugcuuagccaaggcugagacauuaacggagauugaaccaaagcuaaaaccucuuagucuuucaaagucacaacaaaaccaacauuguuuaaauagcacgucgcuuaauacauucuuauaacuuuaagagaaaagagaguagacggaaaagagaagacaagccacccucgccccgcugggugauucccucuggggcuggcaagggugucggcaccuggguguuugaucaguuuccuccccgcuagcuuugccacugaccuggcauccaccagagccauggagaccucacacuggguagcuucucuucugccaauugcagucuuagggacaggcacagggaucaacauacuuuuucugcaaagagccagagaguaaauauuuuagccuuugccagcugugcagcccccgugguaauuacccagcucuacugcagcugcucagaagcagccacagaugagauguaaaugaaagggcguggccagguuccaaugagacucuacaaaaauagguggugagcggcaucugcccuuugugccauaguuugcugaucccuguacuaggaugguuucagagucugucucucucccucccuuccaacaaccucagauacauugacuuagaucaaccaaucuuuguucaugacacauuaguaucauugguccacgaauggccuuacuuauguauauuuuguagacaauauaaugaaguaccaugagcccaucacccagacccaagacccagaauauucacuaccugugcgcuaccucccuuuuccaucccccugcugccuccuuggacauauaccugcugauggcucacaccuacaaucccaacauuuugggaagccagcgcaggaggaucacuugagcccaggaauucgagaccagcgugggcaacauggggagacccuauccuacaaaaaauaaaaaauuagcugagcauagcggccugcaccuacagucccagcuacucgugaggcugaggcaagagguucauuugagccccagagacugaggccgcacagggagcugugaucacgccacugccagccugggugacagagcgagacccugucucagaaacaaaaagauacuggacgcgguggcucacaccuguaaucccagcacguugggaggccaaggcgggcggauugcuugaggucaggaguuugagaacagccuggucaacacugugaaacgcugucucuacuaaaaauacaaaaaauuagccgggcguggugguggcaucuguaaucccagcuacucaggaggcugaggcaggagaauugcuugaauccgggagguggagguugcagugagccaagauugcgccacugcacuccagccugggugucagagcgagacuccaucucaaaaaaggaaaaaaaaaaaaaagaaacaaaaagauauauaccugcugaacuugggguuuagcccucccuaucuuuauccauauauguaugcuaaacauaguguuuaguuuuacuugguuuugaacuuuauaaaaaggauauuauguggagucuuuugaaagcuagguuuuuuggccucggcacgguuacugaauucauccacaucacacaaacgccucuuacucauuuucacugcagcauauccucaucgcguguaugagcuucuuuccaggaucauagcuucuccaguuucgugcuuguuuccaaaaagaggacuauaucucugaugcauuugaaucaaaggaccgggugucaaaaagugcuuuuggcacagcugggauguaggugugggaaagaucccguuuauugcucuuuuuuuuuuuuuccuauuuuuuuuuuuuuccccagaaaaagauugaccugcucuuauaaaauauuuaauuuacaaauaugaggcugggcgcguuugcucauaccuguaaucccagcacugugagaggccgaggcagguggaucacuugaggucaugaguucgaggccagccuggccaacagggugaaaccccgucucuacuaaaaauacggaaauuagccgggcguggcggcgcgcacuuguagucccagcuauucgggaggcugaggcaggagaaucgcuugaacccaggaggcggagguugcagugagcugagaucaugccacugcacuccagccuggggacagagggagacuccaucucaaaauaaauaaauaaauuuacagauaugaguccuagacacugucccagucacuagagaugagcagugagccacacacauggaaccacaggacucccguucugguggaggacgcagaugaugagugaguaaaagcuggaacuauggcugugcaggacaaggugcucagugggaccccaagugcacgccucugagaaacucaagccggacuucccuggcgaaugcgaagcucguggaaccaacaagcguuacgcucauuuggacggggcgggaguagcaucccacaagacucuuuuguuuuugcuuuuggguucuuuaaucauuaguagcuuaggucucuguugucuguggcuuucugcuucaggccaaguagaggaaauucgaggcugggcaugguggcucacaccuguaaucccagcacucugggaggccaaagcagguggauggcuugagcccaggaauaugagaccagccugggcaacauagugagauugugucucuauaaaaacaaaaaguagccaggcauacuggcgugcaccuauaguuccagcuacuagggaggcugaggugggaugaucucuugaaccugggaggucgaggcugcagugagcugugauugcgccgcugcacuccagcuucagugacagagacccugucuuagggggaaaaaaaaagaagaagaaaauuuugaucuuagccugguuucuuucuauccucugcuuccagaaugucaugggcuaggguugcaaagccacuccacaauuugcuauaggcucaacaugauuaagaaggaaacugggggucaggagggcugcuguuuuucaaaagccacauagauuucucgggguggggugucaccgugcuccugcuguuucugcacuugccuugugcccagcuauuuuuugcacacggagaccuggagcguagccgccugucaguguagcaucaccucugucugagagggcagagaggguguuauggcaugacugaguuaaaagccauggccacaauggggcccaaacauugaguagccgaggucuuccugccuuagccuggaagccacagucugaugggggaaccagccugccuuugaguggguuauuuuuguuuccauuuucaaagguagcauuugugacccauguguucuaggugaggaaucgccccuucuugaccacacgagcuaaaacuaggcguggagacgggcagcaagacaguguggagggugacucaucucugcccggacggucacaccugcacuguccccuggcagcaggaccagacacccggcccuuucccaccuguccugcagaaggcuaaggggacagggugguucuuuaacuagggcauuggugugggcacuaaaacagcccuccaggauguccacacccaaaaccauggcccuccagugauucuuacggagaugucaugaguaacuuuccaucccagggccuggcagugccuguguuccccuccccccuuggucaccuuggcacagcuggacugcgguagaaagggcuguggagcagccuccagcuuccccuggcucaccccgucccaugccuccacccagagccuccaccaggagcuggugagagcccuacugccgggguuggagcccuggcucugccauuugccagcagcuaggugaccugggcagaguguuaagguuucugcacuuccuccaaggccuggcccuccaccuccugccccucacaccccucacaccccucacacccagcuuccagcaucucucuucccaccaccucucuuccggacacaagugcacagggccugcccccugccuugcgagccuaaauccuccccgaagugccaggcaccucauagggcuauguuggcgggcucaggggugcccccuggacucacaccccagcccuugcccagccuucauuugacuguaaaacaagggauggagccacccggaaggguguggggcuccugagguuuccagagagcacugccaugccagcagcggugaggaucccagaugugguggccguguucaccuucauccuaaggcacuuccagguaccccgcacgguucuccugcuccgaacacuuugcaccuucuagagcucugcucugguuuggugcuucugcccccacccuugggggacagauuccguguucgcgccucacucugcauuugcuggaaccuucguccuccggccccaucuuugcucccugccuuguggguccuucuccccaaaccacagggacccaggaaggccuccguggcugagcaguggugcgugggucgcccuguugguccgugaggcuuggacggggagcagcagcguugcuugugcuuucugccgaggucagcuguccaugggcugaggggggccagcagggucuggcaggugcuaccuguucaccuccuggccugcucccccccaaccugcuggccaguugggcuuuggaugugaccccacccugagagcugcccuggggcguccaucuucucuccgcacaaaucucccuuccccuucaagcccugugugaccaggaucuccgacacauaagacaaaaggaaauaggguuuuuagaguggacggguggguagagcacccucccugaccuguggucauucuuccaguucgugcaaauggcaaggggguuauaucgagaucuccaagaagacacggggcggagggcuggggugcagccugcacuugcagcugcugugacagcccaggccaaguccuccagcuggagacggggcuacacagaugcacaccccccaggacaagcuuagggagucugggggcgccgcucagcauggggcuuguuugggaagcugugcugaggaggaagggaaaggggaguggggaccucagccccccugcuuucauucuuuccuggguguguggacccugggauuccagccuucauguccuucaugucccuguuucugucuccugagaaaugcagcaagucaggcucagcccacaggccacaugacccuggguccgacgaacagccagggcucaaagacagucagugccaaugagccugaagccugggcccggaccucacguucguccccaaaaauggaucggcuugggaggaacagugcccugcccaccucgcgcugucgcagccccccagcaacagugcgaggagagaaucugcugcugccccuggcuccggaguugucacccuggcccccugcucaucuguuguaggggggcggguugcagggauggguagggguuuccucggugccucuccaggcucccucugccuccugcccugcacgguccugcuccugucccugcuccggcucuggcuuaggguuugcagggcugagcuuggcuguuccgugggucuugacggagaaaaugcagagcugcacuucccuccacaaagccgcacuguucucagcaaauccucccggggucuggugcauuguuuucaagugauucagcagcacgugaaugggaagggccgagccggaggcucuggcaugagaccugcuggcccaccagggaaagggagggcagcgggacgugggccccgagguccucccagagcugcagagggagggggcagggcccugggguuggggagggcggcaggaaggcugggcagagagggcggcuuugcucugcguggcugaggugcucugauagaugcuguuucccaagaggagccaaaacgaaugggcaggaagugagaugggagagcuggucuccauggagacgggcacccaguggccagcagcucacgugcacuagaaucucaggcagccggggagggagcauucccuggggcggcagggccuggagcacccccaggugcccgcuggcaggcgguguggccccggcugaggcugcgcuucuguucccugaucucuguugugcacccuguuaccuucucugccccacccuccuccgcacccuccccaacaaaauaucuuuucugaguaguugucauuccaggcguuuuucacccuggccugagucaugcuggccaaguccucuguccucacccuggaugucacggucccgcccugcaccagggcugcaagucaccacugaggguggaccuggggccucucugucccagccacccacaaacucucaaggucagagucuggaaagggagguggugccccaugucuucacuuccggugucuacacccucaacuggggacggauguccagugugcuccuauggugcccccucugcugaggucuuuccugcuucccagaaggccccguugcuggcuuccgggggccgaggagguuggaggaccugagggugggucuggccuccacagcagcugcagggcgggaagagccugguuccugcccagcaccacagggcuguuuuuaauuaccaagucacggcccucuuuucugcucauuucccuaaaaggagugaauuuggaggaggucugccgcacccgcugaccaaaaggggcuggcaugaaggggccgaggaagggcagagcccagugcccgggggagacccucugacugcccaccaagggcacccggcugugucacuugaggccagaggcugaaggugagcuggaccagcuaacccucacugucaccucacaacacuugugacacuuccuggcugcucagccuugccccgugccccugggcaguuccguugggagaggcguggccuccaaaccuagaggacuagagcaggucugggguccuugugagcacagccccuuccuggaucaccgucugccaucccugguggcguuuguggccacuucugcugcuccagcuggcgaggucggccccauccugcuaaaagaaggaggugcugcccgaauggagagcuuccauguuucuaagcugucuuuacugugauccugaagcccaacgagauuaguuacacacaaacauuuagggaucccacagcgaucugagagcagggccaugaaaaauagucauuuauuacagcaguugcagggcagggccacagcuguguuacuggacaucuguccugagcugaggguguagacaccagaaguggggaaagugggcuucaccucccuuuucagacucugaucuuguggguggcuggggcagaggggccccugguacacccucagcuggcgcuuuagacauauuaaucaaaauggucaggccgggccagguggcucacgccuguaaucccagcacucugggaggccaagauggguggaucacgugaggucaggaguucaagaccagccuggccaacauggugaaaccccaucucuacuaaaaauacacaaaauaaaaaucagccgggcaugguggcgggcaccuguaaucccagcuacuccagaggcugaggcaggagaaucgcuugaacccaggaggccgagguugcagugagccaacgucgugccauugcauuccagccugggcgacaagagcgaaacucuaucucaaaaaaaaaagaggauauggagccccugccagguugaccagccauauggugucauuacauccacccaaaagggacaagagacucucauccccaauggcaacgccaaguuauaguuacagauguuagcaagggcguuacuaacugugugauuugaggguguggacauuggcacucauggcaccccacuuuucuggagaguuuagacaaggcguggaacgucacaguccuuucccagugaaagaacaaagcugaguccaccugcaacugccauuggauccuccccaggaguaaguggagguuggguuucauccgggagagaaaaugguuucuuugauaauuccucugaaaugacuggcauguaauuccacccagagccaaaugaaccaaaugacgcucagaagacgucugcggcuccggccugcaguuaccgcguuugcgucuacgcaguguggaguccuccagggcuggccccugggaugcaugcaguggccacuggucuucauugccacugugggugcucugggcugacucugacccagcugcagcaucagaaugccccccacccacuagugaugugggccaguagggucuuuggcacaugugugaagcccccacccgacucccaggaaugacccauguugagaacauggggaccccuuggcguucuccgcugggccauaagcaggacaggacagaggggaaggaggcgcuuucccugccagugcugguccuaugggcgccccuccccaggugaaagcuggagccugcagaagaggguggacggcugggaggggccagugcccuccagugauacugagcaaacccucccaguccgagucagugugcacacaaggugcagaugaucgggccggguuuugacuuuguauuuagcagccgaauguguuucugagucccagggaucccugcaccucgucugggcagacaggugacuuugagggacagugggccaccuucucccgcugccugagcacgucccguagccgagacaggcgcuaugcuguuacaguguguggagugccccggggagaggcugugaguggucuagacguuggguguugauauccaccgguuugccugucccaaacuugggccugggagcccggcagaguggcucaaguggaaaauguucuauaugguauauuuauacauauagcaugugggauuccuccagcgagcaguugggccccuggcaagauaauaaagagaauucaaugaguguggaauaaguacauuucuuacaggcaauuuucuuuuucuuucaaaggcagggucugguucuuucacccaggaccgaggugcaguggugcauucauagcucacugcagccuugaacaucuaguucauacaauucuccugaguagcugggacuauaggcagaugccaccacgcccagcuaauuuuuguuuuuuuuuguuuuuguuuuuuguauuuuguuuuuuauagaugagguauugcuauguugcucaggcuggucuugaacuccuagcuucaagcaacccauccaccuuggccucccaagugcugggauuacaagugugagccacugcacccggccuuucgaggcaauuuucuuuuggggucugucucccucccccaauugugggcauggcuuguucuuauuuuccgcaggaacuuccauaguacuucuguggacacaggaggauuggaaagauguugguggguguaugaaggggacgugaggacgcaggacccacguguugauggcagcagaggggacaccgaggagagagaacaagggaggaccgugccacagaagccguggcgucucugccuggggcuggcgugguuggagucuguggagagugccgccccuccggccagcccuuggcccuggcacaugcuggugacaccagguucuccagcaagcccccuucacugucugcuccccuccgagagcagcagcagccgguccggccucugaugguuuuccaggggcgguugugacugucgaagucugaccguagcccauccucuuuggaucgucucccgcgaccuugguuuuccgcccacccgguucuuuuccguccccacucuggcgggugcgcucgggauuguuuuugcaggggggaagugacaucauaugguguccugggcuggagggguggggguggggacccugcaguugcgugugcuuugaauucagccgacgguuguacauuccaguagccggcaucuggcggugaauucaucagccaguguaucacccuugaucucaaacccagauguuguguucacagcagaagggaaagaaggaaaaacgaaaucugagacgcccagggagaggccgugguuucugggcucagggcaguuagaacgagagucuuuauaaagacucccccucucgcagcugccucuggcuccuuggggaaggggcagaggagcagagcagccccucucgggggcauggacaggagaugggcugacacccaccccagugccuaacaccaggcccagcacccaguagguguucaguaaacgugucugugccacaauuuucauuucuucccagauuccuuaugucucuucgcuuuccccagcccuguucuucacauggccugggacucggagaggcccucccucuuuugaaguggccugcuuuccccuacagaacuggugguccauccuggagcucagagugcggaccauugccauuggcauggaaauguauuccggagagcucucucucccuccuccucuguccaccacugggcauuggaaacucuccuucucuguguuccuauccaucgucugucaucuugccuggauuggaugcuccucccaggcaaggccugcuguaugcaggauucacccuguacccucucuucaccugcugucaccucugggcaacaacccccgacagguacccgcugcucugagcaggucagcggugcagaucccgcuaugccaacuggugugcaccgaucagagcugucagcuggccccucuccuucaugucugcggcgugcuggugcuuuggggaagguugccguggaacugguccuucuuugccucucuugauucccauuuuccuucuuucauguaauuucucauuuugcaaagugggggaggaggugcccacccccaauuuaaagggacccugaagaaucugaauucuguuccccaggggcagacuaaagcagcccaggggagauggagaugcccucaggcucugcuccuccaggccccucacccccacuucccugccccucacccccacuucccugcaggcaucuggcggccuccucgccaguucacuuucuaguccuaaccccacguggcuacccuggacccuugauuugaccagccuccucuuuucugacacuuuaaagaaggaaaguguguaaucugcagcccccaggcaaagcuagcacgcugggaagcugcaucaaaucgagagucuguggccugcugaccaggaccgggucuguguaccugaguggcaugaugccaccgucccaaucccucacccacgggagcgggagaauucgcccugcuugucuaugcgaugcucgugguccugaacuguacacgcauuaguucccgggcaccgcagccuccacaccagccccucuaacagucaccacgaccuugugaagugucaagacuguugucaucgucucugucuuaggugugaacaacuguggcucagugaagucaaggagcuucucaaagaucacgcagccauccaggggugaaugcaggaucucugucucuugcugccuccuucaaauaagugcccagcugccaccugggagccuuaggcguuuuuguaagagaacagcaugugaaccucaaugcccaugguaggaugcaacauuuuggccguuuugaaguaaucuuugcuuauuuucugaacuccagugacaugcuuguugagugccuauugugcguuaagcauugugcggcuuaguggaccauugaaaggcagcuccaaggccgggcgcgguagcucaugccuguaaucccagcacguugggaggccgaggcaggcggaucacgaggucaggaguucaagaccauccuggccagcauggugaaaccccgucucuacuaaaauaaauacaaaaaauuagccgggcaugguggcgcgugccuguaaucccagcuacuugggaggcugaggcaggagaauugcuugaacccaggaggcggagguugcagugggccaagauugcaccauugcacuccagccuggaugacagagcuagacuccaucucaaaaaaaaaaaaaagaaagaaagaaaagaaaagcagcuccagaaauuuccaaaauaacauacagaauucagcagacuguaauaaaggccggcuugcugcuccuacuggaacuguugauuccuuuggauucugcuggcuugcuuuuuuuccuuuucuuucuuuucuuuuuuuaaaagacggagucucacucuguugcccaggcuggagugcaguggcaugaucucagcucacugcaacuuucaccuccuggguucaagcgauucuccugccucagccucccaaguggcugggauuuuuguauuuuuuguagagaugggguuucaccauguuggcuaggcuggucucaaacuccugaccucaagugauccgcccgccucggccucccgaagugcugggauuauaggagugagccaccgugccuggcccugguuugcuugugagcuggugacucugcuacaugaagagcaaacuuugaccaaguuaaucuggcacauugacuaauuugcauaaacauuuuuggugcagcauugucguaagguauauagauuaggcagggagcaagagagccaaggacaaacugcaccugggccaccagcccaaaguugucagcgucaucucagcuccaucuggcaaagaguuagugagcaccaacuguucugcagucagaaucuagccucaaccuguuaggaccucccagggcccugagcagacaggugugcaggaacugacagcaggauggaaaagagauggggaauauaccaagugcugcagaaggacaggauuucccagaggaagacagaaaagggcuauuuuagcugggucuugaagaaugaagaaaaguucuccaggcagagaggggagauggcauuuggggcggaagaaacuugccuguucaggcugggugugguggcucacaccuguaaucccagcacuuugggaggccaaagugggcggaucacuugaggucaggaguucgagaccagccuggccaacaugcuaaaacccugucucuacuaaaaauaccaaaaaaaaaaaaaauuagccuggcaagguggcaguuaccuguaaccccagcuacucaggaggcugaggcaggagaauugcuugaaccugggagguggagguugcagugagcugagaucaagccauugcacuccagccugggugacaaaagugaaacuccgucucaaaaaaauauauaugguaauuagccaggcaugguggugcccaccuguaaucccagcuaccugggaagcuaaggcaggagagucauuugaaccugggagauggcugagauugcgccacugcacuccagccuagcagggguggggaugacagagcaagacucugucuaaaaaaaaaagaaagaaagaaacuugucuguucagagguguggaugcaccugggcguguucagggcagacaaguauuaugaagugguagaauagugggagcaugggugggggguguugggcacagcagcugaggccccuggcugacuucagguugcaaaggcgcucauauuuuaggggagggcagggggcagccaaggaugauguuugagcagaaacgaacgugaauaaaaaaagacagcugguugcgguggaugagaggaugguuaggagggcacuggaaauagggggccgucagggcaaagccgucuguucuggaguggccugccgggagacauuuccuagauguggcuuuucaggaugaggcauggauuagccugggaaacaggaaccuguggccuuggccagucaugacucagcuccaacagaagaagaaagaagaaagggguuugugcccaggcgaggcaguggggcuguggugugggacucugaugccagccugggauccagagagcauugguggggcccagggggauggacacagauggagcacccacacgccugagccuccuugccccugugggaagagacagcccugccuaagggguucuaagagauuugagccgaccacgugggguggggcuggggcuggggcuaggaggcugccuggagccuggcguggucugcuccuuaccucucuguuuugcucauauccaccguaacauaacacuuacccagagugacccugaagagcugaguuugggagggcaaagcuuuuaaagccauuaaaacagaccaugucaccaacuaauggccuugaaauuaagaaagggagggcucuacccaacccugcccaagugacagcaugaacuacugaucugcuuguccucagguuaccaggaguggaacagaauccuggcuuaauugcuaggagaaagcccuguguugcauggccugucagcaaccucaggcuccagaauauucuggaauugccccagcccagccucuuccccaacuccuuucuguuugguuggggcuuaguugggauccucuuuccuucuguuuguccuuccucagcaucugucccuugggucugccagcugugccugccgaugucuccuuugggugaaacuuccugccccugccccuguugugccccugauagacucuguguuacuguaaagaaucacccaggcugggcgcaguggcucacgccuguaaucucagcacuuugggaggccgaagcagguggaucauuugaagucaggaguucgagaacagccuggccaacaugaugaaacccugucucuacuaaaaauacaaaaauuaagguugggcacuguagcucaugccuauaaucccagcacuuugggaggcugaggcagguggaucaccugaggucaggagcucaagaccagccuggccaacauggcgaaacgcuuucucuacuaaaaauacaaaaauuagcugggugugguggcagcugccuauaaucagagcuacuugagaagcugaggcaggagaauuucuugaacccaggaggcagaaguugcagugagccaagaucaugccacugcacucuagccuggacgacagagugagacuccgucugaaaaaaaaaaaaaauuaaccgggcguggugacagacgccuguaaucccagcuacuugagaggcugaggcaggagaaucacuugaaccugggagauagagguugcagugagccaaaacggugccacugcacuccagccugggcaacagcgcgagacuccaucucaauaacaacaacaacaaaaauuacucauagaacauuuuccaggucaggaaagaugagaagagcuggauagaccuuuccagauguaagacccccaaagcuaaauaugccggguacguuuaaggccccuuuaagguggauaacucccccucugcccucagcccagaaaagcuuguuuccaauaggccguggcuggaggguggggaaaugucccauccuucgcggaaugugugggauugugggucaguuccaugggguaccugcuugccccagccaccagugaguacccacuggagagaaggaaaaaaaaagccaaaagcacucaagcaugauaucaacagaugagcuucagucaaaucaaugacugccucccacuguuacagaaacugccuuggucacaagggacucugggcuucuggcuugggccccugucaacaaagaagggauucuuguugaagaaucguggaaggaggaggaggaggcugggcaucaucucucagccuggaggaggagacgccaugccgggggcugggaucaccaugccccuugcccgucucgcaccuugcugcugucuguaaccccccagcaccucccgcaggccuggacgucuuaucccucuccuuagccccaggagcguguuucaggaacucuccucaccucugugucuuguguuuugcagugaucagggccaaagcggucagugagaaggaaguggacucuggaaacgacauuuauggcaacccuaucaagaggauccaguaugagaucaagcagauaaagguaauaguggcugccggcaucccgggcugcacugugggcacagcugugggguguugggguuggcagagagccugggucccuggaacacgaucuggccaccuguggacuagagcagaggaugaggucaucaagcugcaaauagauccgauuucccuuaauccucgaaugccugaaaaguuguguggagaugacaugcuccccacaaauucaauuccuucagaaaccuguccgggcguugcggcucacaccuguaaucccagcacuucgggaggccgaggugggcggaucacuugagcucaggaguucaagaccagucugggcaacauggugaaaauccaucucuacaaaaaaccagccaggcaugguagcgcccaccuguggucccagcuauucgggaggcugaggugggagaaucgcuuaagcccaggaggcagagguugcagugagacaucucaccacuguauuccagccugggugacagagugagagcuuguauuaaaaaaaaaaaaaaaaaauauguggcagggagggcagggagggcagggccuggccuggggcaggagaggugaugcuauugucauugacaguaacuaacauggucuguaagagagacgaaaauucaugucgcagguggagggacagccgugugauauggugguaguuguagucaucgauauuuaauuuugucauuaaaaauaaaaaguaaaccaggcacagugucucaugaguauagucccaggugaguggaucaccugaagucaggaguucaagaccagccuggccaacauggagaaaccccauguaucuacuaaaaauacaaaaauuagcugggcgugguggcgagugccugugaucccagcuacuugggaggcugaggcaggagaacacuuaaaccugggaggcagagguugccgugagcugagauugcaccacugcauuccagccugugcgacaagagcgaaacuccaucucaaaaaaagaaaaaaaaaaaaguagcugaaaaucaauguuaucagaaggucaguggaaugcuucaucaucacauguaugucaguuuaaggggaugaccuagucucucagugccugagucucuuucuuuacgaagcaggaaagaggaucugcucuuacgaccucauaaaggggucgugaaaaggccagugccagugcccaggaaaugcuuuuagccuuuuggcaaaugaugucauuuaguacagcaucaacauaaccuuuccugguacaagcuggagugucacucucaagccauuugucaugacaucaggcaugcuuccauuccauuuggguuugcuuauugaaacucuucggggggaaaaaaacagccucccugagugcugagaaaaugccauucuucaccugggcagcaggugcguuccugaaaggcugugaguaaaucacauguugagaaagcaaacucuucuggcccauggaguuauguccuaauuccugaggugccucucugcucucauugccaucaaguagacaauauuugaccaaaauuccuggaaauauagguuggguggagugacuuaugccuguaaucccagaacuuugggaggccgaggcaggaggauugcuugagcucaggaguuugagaccagccuggguaauagagcgagaccucgucucugcuaauuaaaaaaaaaaaaaagccaagcaugguggcaugcgccuauagucccagcuacucgggaggcugaggugggaggaucacuugagccugggaaguugagguugcagccccagccugagcaacagagugagacccuaucucaaaaaaauaaaaaauuccuggaaauaugcaaaagucaugguccuucauggugguccagagucacguggagguacaaaagccccuccccauagauucagaaaugaccucuuugggguggggggugagggaacagagguguugucugaggaugucaugcuccagaugacagucuuuuuuuuuuuuuuugagauggagucuugcugucucccaggcuggagcgcaguggcacgaucauggcucacugcaagcuccgccuccuggguucacgccauucuccugccucagccucccgaguagcugggacuacaggcgcccgccaccacgcccagcuaaauuucuguauuuuuaguagagacaggguuucaccauguuagccaggauggugucgaucuucugaccucgugaucugccugccucggccucccaaagugcugggauuacuggugugagccacuucgcccggcacagaugagucuugugcucaccugcugugaucugccacacuaaaaguugagugacuccaaagaaucacuuugcuauaagaagucuuuuucuuuucuuuuuuuuuuuuuuuuuuuuugacggagucuuacucugucauacagguaggaguacaguggcgccaucucagcucacugcaaccuccaccucgcagguucaagcgauucuccugccucagccucccacauagcugggauuacaggcgcuugccaccaugcucagcuaauuuuuguauuuuuaguagaaacaggguuuugcuacguuggccaggcuggucucaaacuccugaccucaagcgaccugcccaccucagccucccaaagugcugggacuacagccaugagcccugagcccagcuggaacggucuuuuccuaacccauguauuugcacuuccugguccucuugggugcuggcuguaccccagcuacagguugugccgcccaggguguucuggaugggaacggaauucaccaacuguguggccucccucugcuuacauguccuccuccuugucuuuccagauguucaaagggccugagaaggauauagaguuuaucuacacggcccccuccucggcaguguguggggucucgcuggacguuggaggaaagaaggaauaucucauugcagguguguaugaguggggccaucagccggaggcuggcacagaaguggggcuguuccuagacgcgguccagggcucguuucccaggcucgggggguggggaggcggaguagcugaggaacagugaggcaggguacggagcccucucggccacuucccgucagagaaugcuagugaauguucacuaccugccaauuuccugggaaauuugagauugguggacaaaaaaaagggagcauuuuugccuuuuguuccuaaaagggaggcgagugcgggaugcuggagacaugcagggcagagaaacccuuucugccgucgggagggccaaaagcucgcguaacaucuguggauacuaugcacgagaccugcuugacuuauucauucaucugucuccuuuuuuuauugugguaaaauaauacguaacaaaauguagccauguuaauuaaccauuuucuuucuuucuuucuuucuuucuuucuuuuuuuuugagacagagugucgcucugucgcccaggcuggagugcaguggugcgaucuuggcuuacugcaaccuccaccuccuggguucaagcgauucuccugccucagccucccgaguaguugggauuacaggcacacgccaccacgcccagcuaauuuuuguauuuuuaguagagaugggguucuaccguguuggucaggcuggucucgaacuccugaccucaggugauccacccaccucggccucccaaaguggcaggauuacaggcgcgagccaccgcgcccggccaaccauuuucaaguguacacuucaguggcauuagauacauucgcuauugugcaaccaucaccaccaucugucuccacaucuucccaaaccaaaacuccguccccguuaaacacuaacucccccuucucucuuccucagccuuggcccaccuccauuuuacuuucugucucuguggauuugacuacuccaggggccucacauggguggaacccugcaguguuuguccucucugucuggcuuauuucaguagcaucauguuuucaagguucguucacguuacagcauacaucagaauuuccuuacucuuuuuuuuguuuuugagacagagucucgcucuauuucccaggcuggggugcaauggcacuaucucggcucacugcaaccuccgcuucccagguucaagcgauucuccugccucagccucucaaguagcugggauuauaggcacacgccaccacaccuggcuaauuuuuuuuuguauuuuuaguacagacaggguuucaccacguugaccaggcuggucuccaacuucugaccucaggugauccgcccaccucagccucccaaaguguugggauuacaggcgugagccaccacacccggcccaaaauguccuuacuuuuuaaggaugaauaauauuucauuguaugaauguagcacauuuuguuuauuguugcaucucuuuguuuauaguuuuuugguuuguuuuuuuuuuuuuugagacaaagucuugcucuguuucccaggcuggagugcgaucaugacucacugcaaccucgaucuccuggggucaagugauccucucgccucagccucccaaagugcugagaucaacuacaggugugugccaccacacccagcuaauuuuuuuauuuuuugguaaagaagucucaccauguugcccaggcuggucuugaacuccgaggcucaagcaauccuccugccucagccucccaaaguacugggauuauaggcgugagccacugugcccagccuauauuuuuauuccuaaguaaaauuauuuucccuuacuuccuucuacggccuccucugcuugcccagcuaggcugaaccacaggaggccaggacaggauucucaaucucagcacuauuaacauuuggggauggaccauucuuuguugugggggccuaccuuaugcauuauaggauauucagcugcaucccuggcccccacccucuacaugccacagcacccgcuccagucgcggggucucuggacauugccacaugugcccaggggaggugggguagauugccccugcuugagaaccacugggcucaaagagcuuucugcagugauggaagcggucucugcaccauccaguccagcagcccccagccuuguggcucaugagcacccgagauauggcuagugcagccgaggagcugcauuuuaaauuuuauuucauuucaaguaauuuuaguauaaauguaaacagccacauguggccggcagccgcagucuagcauggcacugacucagccaguuaaggaacauuauuccccuccucccuggggaaguaggaaucugaucacaaacuuaagaaaaaaagaauagacaaggccuggugcaguggcucauggcuguaaucccagcaauguaggaggcugaggcgggcggauugcuugaggucaggaguucaagaccagccuugccaacaugguaaaacccugucuguacuaaaaauacaaaaauuagcugggcgugguggcaagugccuguagucccagcuacucaggaggcugaggcaugagaaucauuugaacccaggaggcagagauugcagcaagcugagaucacgccacuguacuccagccugggugacugagcaagaccccaucucacaaaaaaaaaagagaaaagaaagaagagacaagacaauuccccuagccugguacuauaguuuguuccaaaaggcaacuguaaucauaaacauauacuccaaauccaaauauccaugauugggggauuuucuucugguuuaggugacauguacuuuuuucccuucuaaaaaucaaugugugcuuagugagcaccuguuaggugcccagccccguguuagagacaaugggagauucccacggugagauccuuggcucuggucaucauggagcacacagauguuccgaauggggagacuggaaaagaaagaaaauagauuuugcuuguggagaauugugaauaguaagugaaugcuuagaaggugcaaaaggggccgggcgagguggcucacgccuguaauccuagcacuuugggaggccgagacgggcagaucaugaggucaggagauugagaccauccuggcuaacacagugaaaccccguuuccacugaaaauacaaaaaaaaaauuagccgggcgugguggcgggcgccuguagucccagcuacucaagaggcugaggcaggagaauggcgugaacccgggaggcggaacuuguagugagccgagaucgugccacugcacuccagucugggcgacagagugagacuccaucucaaaaaaaaaaaaaaaaaaagaagguacaaaaggaagagagacucucacagguccaagggucuagacagacuugcugcuggaagaaggugguguccuugccuauggauggggaggaggucauugcagggaggaagaugcagggcugugaguugggcagggaagacuccuguuaucuccccuuggguaagaucuucccucccuuccuuaacaugcucacagcuccugcuuugcuggguaucucggucaucaagacuucuaucccucuccuuggggauaauaggagacuucccccccuuuuaagaugcauuucuggacuuccuaaaauguuuuauuaugagcacuuuucuuauucucauuccaagacagagucucccucuguugcccaggcuggaaugcaguggugugaucuuggcucacagcaaccucugccuccugggcaauucucgugccucagccacccaaguagcugggauuacagaugugugcccccauaccuggcuaauuuuuguauuuuuaguagauacgggguuucaccauguuggccaggcuggucuugaacuccugacuucaggugaucugcccgccuaggccuuccaaagugcugggauuacaggcgugagccaccgcgcccggccuacaauucagugguuuuaguaugucacagaguucugcaaccaucacuacagucaaaaagaaauccuguauucuugagcuauuacccuccugacuccccucccccucccccagcccuaagcagccacugguauacuucccgucucuauagauuucucuaugcugggcuuuccugggaacggaaucauacgugugacccuguguaaccggcuucuuucguguuuccaagggucauccauguuacaguguguaucagaauuucauuccuuucuaugacugaguauuccacuguauggauagaccacguuuuguuuauccggucaucauuugaugugcauuuggguuguugccaccguuuggccauugugacaaauacugcaaugaacauuggugugugagauuuugcagggaccuguucucauuuuuccuggguguaucccuggcaguggaauugguggggucggggguggggagggguugggugacuuuagguuuaaccauuugaggagcuggcagaccguuuuccaaagcagcugcaccauuuuacacgcccaguauuaucuaugauuuuuacaauaagaaaaaaaaaaucaaauggagaaggguagagggacaaaaaccaccuguggugcaaagaucuuaccagcuaacuaaugcccucaaaaaaaacacagaggaggcaggagagcugggguggccgcacagcacgcacgguggcgcguggcagaggcauggucugcaguguggcauucgggggcugcugcagcugugcacagaacagagcacgggaggaaauuucccagcgugucagcaucugcugugucuccuuuucaguucuuuccuguauuaaaccuuuaaaauuauggcauuuauuacguuugucaucagaaaaauaaaaucuggagagacaagaaaggagacagaaucccccguggugcagggaacuuacuuccaguuuucugcauccuguuuguuccuauccacagggaacagccuuuaaaguaagucccagccgucccagcucaguuucgucacacugcccucuaggggcuuucuggccaaacugcagcgcugcggaaggacucuugggugcaaaagugaccuuggucugagccagcaccgguguccaaacauacccagcugaauccucgcccaugcugaagcucucuguuuguuuuuguuuuuguucgagauggagucucucucuguugcccaggcuggagugcaguggcacaaucucgggucacugcaaucucugccucccggguucaagcaguucuccugccucagccucccaaguagcugggauuacaggugcccaacaccacgcccagcuaauuuuuuuuuuuuuuuuuugagacagaguuucugucuuguugcccaggcuggagugcaauggcguggucucaacucaccacaaccucugccucccggguucaagugauucuccugccucagccuuccgaguagcagggauuacaggcaugugccaccacgccuggcuaauuuuguauuuuuaguagagacgggauuucucuguguuggccaggcuggucucgaacuccugaccucaggugauccgcccaccucggccucccaaagugcugggauuacaggugugagccaccgcaccugggcggcauuaaguacauucacaguguuguguaacuaucacuaucuauuucuagaaguuuuucaucaucccaaacugaaacucucuccccauuaaccaauaauucccuguuccucuguuugcccagccccugacaaccaccuuucuacuucgucuccaugaauuugcccauucuagacaccucguacagguagagucauaccuccuuccauagcugaagcauugcacuuagcauaauguccucaaguucauccauguuguagcaugggucagauuuuauuuuauuuuauuuauuuaugagacggaggcaacaaagcccaggcuggagugcaguggcgcgaucuuggcucacugcaacuuccgccccccagguucaagcaauuuuccugccucagccuccugaguagcugagguuacaggcaugcaccaccacgcccagcuaauuuuuguauuuuuuuaguagagacgggguuucaucauguuggucaggcuggucuugaacuccugaccucaggugauccgccugccuuggcuucccaaagugcugagauuacaggcuugaaccacugcacccggcugguagauuuuauuucuuuuuaugugcauacauuuuaaaguuuccaaaauauguaauacucuucuaaguugaauucuauauauguuuucaaauuguuaacauuuccauuaacuuuuuaacucagauacuacuuaguaucucaaggaggaggcacgagguuuugaugaggacacagaacuaaaggugccaagugcaaacaguuuauugcauaaagaaaauaaggaaaugggcugaccauaguggcucacaccuguaauccuagcauuuugggaggcugaggcaggaggauggcuucagguuaggaguucaagaucagccuggacgauauagcaagacccuaucucuacaaaacaggaagggaggaaggaaggaaggaaggaagggagggaggaagggggagggaggcauggaggaagggaggaagggaaggagggagggagugaagggagucagggagagagggagagaggcagggaagaaaggagggagggaagaagaaggaaggaaggaaggaaagaagagaugagcuggguguggucaugugcaccuguaguccuagcuacuugggaggcugaggcaggaagaucucuugagcucaggcauuugaggcugcagugagcuaggacugcaccacugcacucuagcccagguggcagggcgggacccugucucuguuuuagaagagaaaaagauaacgacuaagugucaugaaaagaugugaagaaauacaaugagaugcccgagugaaggcucugaaaacaccugcucgaguucgaaugugugcucugacaccugacucguuaauguccuuggccaaguaacuuuaccugucugugccucccaugccgauccguacaugggggaugaugacaguaguaucugccccacgagggguuguugagaggaugaaagugggaguaggagaccagaaaugaugaucacagagaugcugguuaucuuggucaggccccacucaaggguagcugauaauuuuaugucuuacacuggagaugacagugacccauacacgcagcacagcacugcaugaaaagcuggugagucgauacagagagucauacugaaggucuaaggagggcuaggguagccuguagcagaaugagcgugaaggcucugcugaaagggcauugcucccuggaccuguggcgggauccucgguagaaagcugacauugaaagauuuugaagagcuuuaguuaaaaaguuaaaaacagcccagcgcaguggcugacgccugugaucccagcacuuugagaggcugaggcgaguggaucaugaggucaggagauugagaccauccuggcuaacacagugaaaucccgucucuacuaaaaauacaaaaaauuagccaggcaugguggcgggcgccugcagucccagcuacuugggaggcuggggcaggagaaucacuugaacccgggaggcggaaguugcagugagccaagauugugccacugcacucuagccugggcgacagagcaagacuguccccccacccaaaaaaaauaaauaaaaaauaaaaauaaaccaauguuggcaaggcuauggaguaaagggaacgcuuaggaacgcuuaugcgcuguuggugggaauguaaacgaguucacccacuguggggcacacuuuguagauuucucaaagaacugagaaagcaacuagcauuugacccagcaaucccacugcuggguguauacccaaaggaaaauaaaucguucaacggcacugcgcccguauguucauuaccgcacuaucugcaauagcaaagacacagaaucaacccaagugcucaucaauggugacuuggauaaagaaaugugguguauauauacuacggaauacuacgcagccgugaaaaggagggaaaucauguccuuugcagccacaugagugcagcuggaaaccauuauccuaagggaacuagugcaaaaacagaaaaccaaauaccacauguucucacuuaaaagugggagcuaaacauuggguacacauggucauaaaaaugugaacaagagacacuggggaauacaaggaggugggagggaggaagcaggauaagggcugaaaaaauucuaccuauugggcgcuaugcccacuaccugggcgauggauccguucauaugccaaaccucagggacacacaauauacccauguaacaaaucugcacauggacuuccuguuucuaaaaaucaacaaagauugugagaccugcccaguggccagcuggcuguguaucuucuccaccaaugaggcugcauuacuucauccuccucucccugggagggggagcaggggugaagcuguuaauggccacaguggcugacucaccucauggcgagaggaaccucucucaucugacuucuuucccagccuuggucagaugacuccacauugaaucuggcauuuauuucccgaggcaggaaccuagauccaguuugccucgagucaggauagacccuuuauccaggggcuaaccagaaaucacagggcacagugaaccacucagcucuggcuggcuguggccagugagugaccgcauggccugagcgggccaccuccuccuggaccgaugacucagucucacgugucgagucgggcaccaggagacucauacagaguuggcccuguaauuuucuucuacauuccucuucuccaaaaggaaaaauaaacauacaacccuucguuacaaauuuuaauucccgguuuucuguaacccagacucaugccucgcuuuucucggagacagacauaaguagaacaucgcugcagaugcucacgguguguacacccaaccaagucuuaaucagaccagaggcgguccucucuucacauuuauacaugacagccacguucauguuagcccaauaacuaggaccauugaaaagauacaauuuuuuggcugggcgcaguggaucacuugaagucaggaguucaagaccagcccagccaacauggugaaaccgugucucuacuaaaaaauacaaagauuagccaugggugguggcgcauaccuguaaucccaauuuuuugggaggcuaaggcaggagaaugcuugaaccugggaggcagagguuccagugagucgagauggcaccgcugcacuccagccucggugacagagcaagacuccgucuccaaaaaaaaaaaaaagaaaaaauacaauuuucacuucaucucuucuuccugccauugcuuaccuccugaggaagccagaauuggugguaaaaggccaaaagagaagauggcaggaaaaggcagaaugugaagcauaucauuagaacaagcacgggugugucucaucaguaaacuuauugagcaauuacuaugugcagggaacuguggaaacaaaaggguuaagacacagcccuuacucucuauacguacucucugauuaaggagcgagaugcagaagaaaggcaaaucuaauagaaagugggaguuaaugcuggucaagugauacauacaguggaaaucaccauagaagcugggaagccaggauagagcuucagccugucuguaguggcaggugcccaggcuggacagggaaggggcugcgguauaccuguaugggcgccaaaugccagaaucaaccaggauacaggaauggguuccuuuccaucugucuguuuugcuccuuccugaucuauucugaacucacagaaaauagcuauaggucuaguggggaaaguuauauaucuaauuuugauuuuuuuuuuuuuugagacggagucuugcucuguugcccaggcuggagugcaauggcgcgaucuuggcucuuuguaacuuccaccucccggguucaagcgauucuccugccucagccuccugaguagcugggauuacaggcaugcaccaccacccccagcuaauucuuauauuuuuaguagagacgggguuucaccguguuggccagguuggucucgaacuccugaccucaagugaucugcccacccuggccuccuaaagugcugggauuacaggugugagccaccaugcccagcuaguuuugaauuguuuaaggccacccaaacauuuaccuuaugaaguuauaggauuuggaauaaauguuacaggaguaauucuacuuucucauccuguuccucaccuggaaugucacauaagucuaaacggagaaaaggacccgaagauaaaggaacagcuagaacaggaagugcgagcauaagaauucaaacccagggagcuggcacaaugagugccccgugcccaggacaauggaggccacuugugucugcuuggagccccaggcaagccauccacauuuccauggcacaggggugcagucgaugagcugcauuaguccuucgcugggcuguguuucuauuaguggauccucugaggcuggugcugugccugagaucauuaagucagaugcgcugaaacuuugucaaacaaaagugcuuagggcacagccugaggcucugucugcuucucaaggaauugcccaucagucucugccaggcgugggugcucaucacugacaccugugucucuucacaaggggcuguuguagcaggagggaugagguuuuuuuuguuuuuguuuuuguuuuuuuuguuuugaagacagagucuuacucugucacccaggcuggagugcaguggcuugaucuugacucacugcaaccuccaccuccuggguucaagugauucuccugccucagccuccugaguagcugggacuacaggcacccgccaccacacccggcuaauuuuuuguauuuuuuuuauuuuauguauuuauuugagauggaguuuugcucuugucacugaggcuggaauguaguggcaugaccucuucucgcuguaaccucugcccacuggguucaagcgauucuccugccucagccucccgaguagcugggauuacagguacccacgaccaugcccagcuaauuuuuguauguguaguagagacgggguuucaccauguuggccagacuagucgcaaaugccugaccucgagugaugucccuaccucagccucccaaaguacugggauuacagccaugagccaccaugcccugccugaaagauuaguuuuuauuuuauuuauuuuuuauuuauuuucuuuuuugagauggagucugucucugucgcccaggcuggagugcaguuugcaaucucggcucacugcaaccuccaccucccggguucaagcgauccuccugccucagucuccugaguagcugggauuacaggcaugcaucaccacgccuggcuauuucuuuuuguauuuuuaguagagacgggguuucgccauguuggccaggcuggucucgaacuccugaccucaagugauccgcccaccucagccucccaaagugcuaggauuacaggcaugagccaucgcaccuggccugagggaugaguuuuuaaaugacuuccauagcugucauuagguucugucagccacuggaacacacugcuuuguucuuuuccuccugcuuguaaaacgccaaggcuauugccaauguaguaucuucagcaaaggaaggaggcagcugagucaggagccggaaguacagaaagaagccacagcucaucaugccugaugaagggaauucagagcagauuccuaauuuucaaaaauuccaugcuuuggcucuucauaauggaaaaaugcagaauuauaaguuuaaacucaaaugggagaagcaccugugaauuaauauuuugugaaaaacaaaacaggaaacaauauaaucuacauacugcaugacguuuuaugugugaagaugcacauagaagagaauauuggccgggcgcaguggcucacaccuguaaucccagcacuuugggaagucaaggugggaggaucacuuaagcucaguucaagaccagccugggcaacauggugaaacaucgucucuauccuuuuuuuagaauaaaauuuaauuuaaaagaauauuggggccaggcgugguggcucaugccuauaauccuaacacuuugggaggccaaaguggggguauugcuugagcgcagaaguuuaagaccagccugaguaacauagcaagacccuguuucuacaaaaaaaaauauaaaaaauuagcaggguguagugguucacaccuauagucccagcuauucaggagacugagacgggaggaucgcuugagcuugggaggucaaggcugcagugagcuaugaucauaccauugcacucuggccugagcgacagagcaagacugucucaaaaucaauaguggaauauuggaaggaaauacaucaaaauauuagcuguggguaaugaaaguagggaauuuuuuucuuuucuuuuuuuuuuuuagacugagucucgcucugucgcccaggcccaggcuggagugcaguggcaccaacucggcucacugcaaccuccgccucccggguucacgccauucuccuaccucagccuccugaguagcugggacuacaggugcccgccagcacgccuggcuaauuuuuuguauuuuuaguagagacggggguuucaccguguuagccaggauggucucgaucuccugaccuugugauccaccugccgcggccucccaaagugcugggauuacaggcaugagccaccgccccuggccaggaaguuuuuucuuuguuuccaauguuuaaguuucugucagugaacaugcauuauggcuuucuuuuuuuuuccacuuuuuauuuuuuugagacggagucuugcugugucacccaggcuggaguucaguggcgcgaucucggcucacugcaacuuccgccucuggggugcaagagcgauucuccugccucagccucccaaguagcugggauuacaggcgugugacaccacacccggcuaauuuuuuguauuuuaguagagaggggguuucaucacguuggccaggcuggucuugaacuccuggccucaagagauccacccgccucagccucccaaagugcugggauuacaggagugagccaccgugccuggccacccacuguguuuuaacucagaauagacagugcacaggauuguugcaacgaaaucccagcgccccugcgccggguggaggagcugggcaggaggaggacuuuucccucucccugagcucggugauccccgucucuccgcaggaaaggccgagggggacggcaagaugcacaucacccucugugacuucaucgugcccugggacacccugagcaccacccagaagaagagccugaaccacagguaccagaugggcugcgagugcaagguaagcagguccugccucugcuggagcaucgccuccucccagugucuccagauggacggcagggauuuugaucccuggcuuuccaggacccguuaauccccggcuccugaucuaagaccaggcucugggaagguagagucaucccaagaguaaggcugucuggcuggggacagagccuuugaccccuggucccuggagagcccugaggcacaucucugacaggggaugucuggaggccgggcgcugcggcucacgccuguaaucccggcacuuugggaggccgagauaggugggucacuugaggucgggaguuggaaaucagccucaccaacauggcgaaacccugucucuacaaaaauacaaaaauuagccaggugagguggugcacgccugugaucccagcaacuugggaggaugaggcuuaagaauugcuugaaugugggagguggagguugcagugaguugagaucacaccacugcaccccagccuggguugacagagugagacucugucccaaaaaaaaaagagggagaugucuggaaggcuaggagauuugagaguaagagcaugaauucagcucuguuaccuguagcuuccagaaaaaggagcuguauggggagagagaauauggucccauggagaauuuucuacaaaugugcaagugcaaacgccuguguggcuuaugagaaggcacugcaggccuuacgcuguuuccaacauucccgacauuuucacaccuggguuggugucuauguggggucuguguguugagaauaccugaacaccugcuccucuuaaaaugagcccggagguugugccaggcacagcuggagcagugcagcgccuagauguggcuguggaaggugagauuaccgccuccagggcucccaggcuggcuccuacccugugggcuccuagcacccuauccccacccucccugcaggaagcauggcugagugcugggcaccucccacccugggucacucccagugagucugggaccaggagacucuggugaggcuguggggauuggccuucccuggggagcugccuggggcugcccucccuccugacggcccccagccccuucuccgcauguucaaaacaggaauucugaacucauagucuccagccacacguauguuaagcgaaacuccucugugcccagcaugaaaucaaaagcaaguuuuuccuuuuucuuuccacgguggugaaggcggucauccucuuguagccuaggguuccuuggccaaauugcuaguugccgaugaccucggggcucggcuugcgagcaacacugggcuggaaucugucuccaggaaacccaggcccuuuuauuguugcugugucccccagagggcagggccaagcugaggccauucugucaugcucaggaagguagaagauggcccaaagggaagcacaccugcaguaggagggggggcagcggugggcagggcacagcuucccugcagguuagacccccucgcaggccagcugccugccccugcaggaaccgugggucucgggagaggcugccaucccugcacaugacagguaggcacauugccggguucuggacaugcccccagagcagccucugcccaccccuuccugggucccugacuccgucccccuccgugugccccuccccagaucacgcgcugccccaugaucccgugcuacaucuccuccccggacgagugccucuggauggacugggucacagagaagaacaucaacgggcaccaggccaaguucuucgccugcaucaagagaagugacggcuccugugcgugguaccgcggcgcggcgccccccaagcaggaguuucucgacaucgaggacccauaagcaggccuccaacgccccuguggccaacugcaaaaaaagccuccaaggguuucgacugguccagcucugacaucccuuccuggaaacagcaugaauaaaacacucaucccauggguccaaauuaauaugauucugcuccccccuucuccuuuuagacaugguugugggucuggagggagacguggguccaagguccucaucccauccucccucugccaggcacuaugugucuggggcuucgauccuugggugcaggcagggcugggacacgcggcuucccucccagucccugccuuggcaccgucacagaugccaagcaggcagcacuuagggaucucccagcuggguuagggcagggccuggaaaugugcauuuugcagaaacuuuugagggucguugcaagacuguguagcaggccuaccaggucccuuucaucuugagagggacauggcccuuguuuucugcagcuuccacgccucugcacucccugccccuggcaagugcucccaucgccccggugcccaccaugagcucccagcaccugacuccccccacauccaagggcagccuggaaccaguggcuaguucuugaaggagccccaucaauccuauuaauccucagaauuccagugggagccucccucugagccuuguagaaaugggagcgagaaaccccagcugagcugcguuccagccucagcugagucuuuuuggucugcacccacccccccacccccccccccccgcccacaugcuccccagcuugcaggaggaaucggugagguccuguccugaggcugcuguccggggccgguggcugcccucaaggucccuucccuagcugcugcgguugccauugcuucuugccuguucuggcaucaggcaccuggauugaguugcacagcuuugcuuuauccgggcuugugugcagggcccggcugggcuccccaucugcacauccugaggacagaaaaagcugggucuugcugugcccucccaggcuuaguguucccucccucaaagacugacagccaucguucugcacggggcuuucugcaugugacgccagcuaagcauaguaagaaguccagccuaggaagggaaggauuuuggagguagguggcuuuggugacacacucacuucuuucucagccuccaggacacuauggccuguuuuaagagacaucuuauuuuucuaaaggugaauucucagaugauaggugaaccugaguugcagauauaccaacuucugcuuguauuucuuaaaugacaaagauuaccuagcuaagaaacuuccuagggaacuagggaaccuauguguucccucagugugguuuccugaagccagugauauggggguuaggauaggaagaacuuucucgguaaugauaaggagaaucucuuguuuccucccaccuguguuguaaagauaaacugacgauauacaggcacauuauguaaacauacacacgcaaugaaaccgaagcuuggcggccugggcguggucuugcaaaaugcuuccaaagccaccuuagccuguucuauucagcggcaaccccaaagcaccuguuaagacuccugacccccaaguggcaugcagcccccaugcccaccgggaccuggucagcacagaucuugaugacuucccuuucuagggcagacugggaggguauccaggaaucggccccugccccacgggcguuuucaugcuguacagugaccuaaaguugguaagaugucauaauggaccaguccaugugauuucaguauauacaacuccaccagaccccuccaacccauauaacaccccaccccuguucgcuuccuguauggugauaucauauguaacauuuacuccuguuucugcugauuguuuuuuuaauguuuugguuuguuuuugacaucagcuguaaucauuccugugcuguguuuuuuauuacccuugguagguauuagacuugcacuuuuuuaaaaaaagguuucugcaucguggaagcauuugacccagaguggaacgcguggccuaugcagguggauuccuucaggucuuuccuuugguucuuugagcaucuuugcuuucauucgucucccgucuuugguucuccaguucaaauuauugcaaaguaaaggaucuuugaguagguucggucugaaagguguggccuuuauauuugauccacacacguuggucuuuuaaccgugcugagcagaaaacaaaacagguuaagaagagccggguggcagcugacagaggaagccgcucaaauaccuucacaauaaauaguggcaauauauauauaguuuaagaaggcucuccauuuggcaucguuuaauuuauauguuauguucuaagcacagcucucuucuccuauuuucauccugcaagcaacucaaaauauuuaaaauaaaguuuacauuguaguuauuuucaaaucuuugcuugauaaguauuaagaaauauuggacuugcugccguaauuuaaagcucuguugauuuuguuuccguuuggauuuuugggggaggggagcacuguguuuaugcuggaauaugaagucugagaccuuccggugcugggaacacacaagaguuguugaaaguugacaagcagacugcgcaugucucugaugcuuuguaucauucuugagcaaucgcucgguccguggacaauaaacaguauuaucaaagagaa

SEQ ID NO: 192325 - RNA, 95829 nt, Homo sapiens
gacgguggcggcucucggagccggcgcgaauccggcccccgcagcgggacccggguggguaucggggcccggacggggccgcgggggcgggguccgagggguccaccgcgcagcgagcagcgcccccucggcggagcuggggcgggggcgcgcggggcgcguggggcgcgugggccugcagccgcgggaccggggaggggccgggguccggccgccguccucggggugcggggcgccagcaggagcgggagcguugugggaggaccuggaucacggaggggcaccuggggacuuuuccccgcggcgagugagggcgcccgggcccggaaugggccuaauucggggagacugguccccgccugucuggagcgguggaccggggaacuugcggucuuugucuggcugaaucggcggagcagacggaugagaacuuguggggugccggcgcgcgcccacacagccuccaaagugugcguccccccagcagcgcgcgcucagcuuucccggccugucgggcuugguggucugggcuguuuaagauccgcgugucgggauacucacuuccguuccgccugggcucccuuguucuuuccuuugggaaaaaaaaaaaaagaaaaagaaagaaagaacgaaaggaaggaaagaaaaaaaggaaaggcaacugaagauugcuaaacauaaccuaggggauccugccggaagccgcugaauccugaaauccugugauucccacacucggaagcuggugucguauauuggccacaaaguaguucagauuugauucagaaauaggaaaugaauagaaaagacauaacaaaaguuagucucgccuuaugguaaaguuuguuuuacugucugggucaaguucaaaugagaagcugggcugauuggccagccucugcgacuugauccugaagaucugcuuucuuuucuaccagaaggcuccuaauucuuuuaucuggaauaaaaagggaacuccgucuuaaagaugcucacgugaggcggcauauugccagagggugggcgcaaagacugggggcuggagauuccauuccaaaucuguuacugauugaucagaacacuuuuucaaauccaugccucaguuuuagaaaauccucauuagaaacgcuaacaguaaaauuggugaauacuaaacacuuuuaagaaccaugaaagcuuuuguaaauaaagaauaaagugaggaguaacuuuugguauuaacuacaaaguucauuaauggauguuguuugcauccugagcgugguuauugugcgcauauuuuuuuguaaguggcauguuuauggugagacuauggcuaacgaaaguuuuuauggcgaaaguuuuuauggcugggcgccguggcucacggcuguaaucccagcacuuugggaggacgaggcgagcggaucaccugaggucaggaguucgagaccagccuggccaauauggugaaaccccccauaucuacuaaaaauacaaaaauuagcccggugugguggcgugagccuguaaucccaguacucaggaggcugagacaggggaaucgcuugagcucgggaggcgaagguugcagugagccaagaugugcaacugcaccccagcccgggugauagagcaacauucuaugucucaaaaaaaaaaaaaaaaaggaaaaaaaaaguuuuuaucuguggaauuauuuaauccucuagcaauuuuggugauugcguuaguaguuccuaauuaucaugcaugaauucacuuaacccacaaaacaagcucaugaagucaggacugcaguuaugcccauuuacagaugggaacacugacgcuuagagaaguaacuucccaagcucaugcaguuaggagugacagaauuaggccuuaggcccaggacgucccagcuccagaaaaccguuguacaacuuugcccucugucuuacagagggugcccaccauucauauacaaacauucuuccaagugguucauaacagugcaaggaggugggacuaaucccaugucaccacuagcugcuaaucucaguucacuucaguauggaaagcaucccccaggcuucaggauaaagccauugaguuugcagaaccuaccuacaauugcacuggucucuguccacaguuuuggguaauaaggugcagugguuaagaacauggcguagaaagauggacugcuggcuucaaauacaaauccuggacugggcauaguagcucacaccuauaauccuguauuuugggagaaucacuugagcccagaaguucaagaccaccuuaggcaaccuagagagacccuaucgcuacaaaaaaugaacaaauuagcuggacaugcuggugggcaccuauggucccagcuauuuggguggcugaggugggaggauagcuugagcccgggaggucagggcugcagugagccaugaccagccucugcauucuagccugggugacagagugagacucugcuuaaaaaaaaaaccuaaaaaacccaaacaacaacaacaacaaaacaacaacaaaaaccccaacuccucuggcacuuaguuaauucuccagugccuuaauuuccccaucuauacuaccuacuucagagacuuugugcaaggauuaugaaaagcauugaauuccugacacauccugaguuaccauuuaggaugugguaaguaaugucaaaugguaacauuuuaacacuguuauuaaugaccguuauuuggauuuuccacauuuaacuagauugacacaaaacauuuuguuuuugugcuuugacuccucacuccccuuugugugguccaugagguggaaagugauuccaggcagauguaggauuuacuauuugugcguauguguacccuuaucuuuacaacuugaccgggggcugggucccugcaggaugcuauggggagcagagcugaucagguugccuggcaacaccaccuccugugaaaauuuuagcuccccuucuucccuggcugagggacccugauuuuugucacaggccuaaauucucuuguaagauuagcuacuuuguuucauccagcauuaagcaccgggggcggguggcucugggaugugaaggugacagcgcagaggaugauuuuaugaucgaauuguacaccauuuguauugcauuugcauuauauugcuguuaaugaggccagugcacaggagagagcacacauuugcacccuucccaaaaauauggggcaaugauguuggaggccuuuuuccguucaccucagcggcaguguuuuuuauccuguuggcuuuguugguguuuuuauccuaucuguccuuugagcaccugauguugcaucucuaauaaaucugcuuuuaugagcugucugguggcaucugauuugaaauacguucuuuacucugucuucggaacuuacauaaccauccucaaaggaugagagaaaucgggccacuguaagacuaaguucgauuucugcccgugguggcuucugacacaugaauaacagaaagaaaagagaaauaauccaaauccacuguccagucggaauggccugcccuucuguugcugagccuugggcggugagucugugcaggcguuggaaggugauacaugugucugcuugccuguaugggcugcagacgcugagauguggcaguauuuucuccguggucuuucuggauuggucacuaugaagccaacguacugcgggugccaagcccgcauccaugcuggcuugcacacuucagucguguacugcuuuuugcauguugagugagccugaauucaaugcuccaauauaguucaucauuacucuagccuucuggaagugggggaaagggugaacuuuacagaugucauuugacagccuuuugccuuuucuguaacuaaaaugcuuuccaaagcaagaucaguuguguugcuuuuggguguuguuaauauguccccccaguuucaguuuuguuuugcggugcauucacugcuccuucacugacagaugcugagaagcuuuaggccuccauguuuacaggcacagcauagaaguaggagguaccugagccagacucagggcaguuuuugauuuccuggcugggucugcaucuucccuuacccuuuguguuuagucuuuccuuagucccagauccaggcucaccucugaguugaguuucuucucccaggccugaccuccuuggcucuuugcgggggaaaugggauuuuacaaucuacuaucaagggugcacaaauggcagauggucucuccuuggaggcagaggcuuugggguuuuccagggagugggugcuaaucagggugaccgcuggacaguugcaaaaggagagucacagccacacaggccaccagguuuucccucaccaccguuuuggugaugguccugccccguuauagccucucagggguccucuuucccuaugguccaagaucccagcacugcagugaaugcccuaagcccuaguuucuucauuuuaaauacaacuugaugucccguucucgcuucugcauagaggcucaucuuugggccccaggcuuuccggguguauccugaauguggcuucugugugcagccaguaucuuuauuuucucaauucauccuguaacuugaaguucagcgcagcugcgaggagaaaucacggcggccccgcaggggauuauccuccugaugagacugaaggagcuaccuuccccaagccugcugcccggggacuggguccugauccuggcugccuacaagauuccauaucgcccuuugacccgcaaagccagggguucccaggaagauggguagggccccugccuggcucugggcagguggaggaagcuggggccucauccaaggcaugccagcagcagacguucugcagcgggggcaacgcgauccuuguuugcgugugucuggcucguguuuaauaaggugucgcuguuucccuguucuuuguugcuugggcuuugagggcaaagcagaugaaccaguuucugccggccaugugccaggugaccgggcucagugcguguugcuccugagcagucuggcagugacauggccaugggaauaaucgguggugggcugcgucccguggcccccacacccugccugccucugccucugccccugccugucacuagugggcaugggcugcgucccucuggugagugggaacugccagcuccauggguuuccaggaccaggucuguccugcugacugcugcauccuggccccuaacccaagguggcccugaggccggugcacggcacagagugagcaagagaagaggcuggggugauaccucucuccuaguggcuccaggcuaccuccaggaggguucuggaagagacuuuugcaccucuguucuuuuuguuuuccuguuugggaacugaugaagcccuuuaggccaggacaggaaacuaagaccuuagguggaggcagccuccacgggcagguccuggucaugaaccuguagcccaccuguguccauucucgcugcccucacagggacgucggggcccaggcgugcuccucuccuggguucuaggccucgguccucauccuacugcuaaaagaguagucacucugcgugggggguucaccgucagugggugagcaggucagaggccgcccugcgaguuggaaaucagcuccuuacaguguccucgguuuggugugguuggcagaagaauggcccccaaagaugcccauguccuaauccagggaauuuguaaauaugguauguuacguggccacggauucaaguuggggauggaauuaagguugcucagcagcugaccuugaaaugggggaugauccuggguuauaugagugggccugaugcaaucgcaggaucaggcaggagagucagggucagagagaugagguaugagaaggacucgaucggccacugcuggccuugaagaugcaggaaggggucgagagcaaggagugugggugaccucuagaagcuggaaaaagcaagaaaacagacucucccuuagagccuccaggaggaaccagcccugcugauaccugguuuuagcccugugagacccauuccagauuucagaccuccaggacuguaagguuaugcauuuguguuguagcugguaaguuugugucauuugucacagcagccguaggaagcucauacgcguggaaugagggcuuucaaaaggagacaagaggggagacgguugugucauuucuuuaucuguguuugcucauuucugguuuucuggugacuuugccacuuucuacauugaggaggacucucuuuucuaggguauaagucaccaaaucuugggcagugaauuuuggguaguagauguccuaaccucaugcccugugaauauuugcuagagaagacccacccccacugcucacacagugagucaccaaaucuuuggcuguuccaggccaaguuucaguggccaaguggcuccuaggggacgggaagggaacaugugugguuaacagcaggcucacagcugcgcccugugucagcuccaacccaacagccuggccaguucccaacagcauugugaaagaauagaucugcugccccucuccuccccugcccgccccucucuccuuagggcuucugagguuucccacgucuucaccuugcaggcagcucccccuacuccagcccccucaaagcgcucucguccuggaagcagacuucagcuaccuuuaucaccaguuuaacaccccugccagcugcaggugcugcgacuccaugcuucucaauggugcucuaauucuuaaagaguugcagguuucugggaaagaaugacucucugguggaggaguuucugcacaguuuuuuguuuuaugagccuguguauuuuuguugaggaauggccaaguuguucuuuccuuucgaauuacacaauggccuauuuugcagaaaucuggcccuaccuacuggucaccaauggcuuugagcagcacagaaaucaacuggucggcucggggcgguggcucacgcguguaaucccggcgcuuugggaggucgagguaggcggaucacgaggucaggagauugaaaccaucuuggcccacauggugaaaccccgucuauacuaaaaaaaauacaaaaguuagcugggugugguggcgcgcgccuguaauuccagcuacucuggagaauugcuugaacccaggaggcggagauugcagugaccuuagauugcgccacugcacuccagccugggcgacagagcgagacucugucucaaaaaaaaaaaaaaucaacuggucaucaugccccggucugaugguuuagaaucagcauugacgcuuuuacuuuuugccuucuaaaaucauucuuuuuuuucuuuuucuuuuuugagauagagucucgcucugucacccaggcuggagugcaauggugccaucuuggcucacuguaaccucugccuccuggguucaagcgauucuccugccucagccucccgagcaacugugauuacaggugugugcuaccaugcucagcuaauuuuuguauuucuaauagacaggguguuaccauguuggccaggcuggucaugaacucccgacuucaggugaugcaacugccucggccuuccagagugcugggauuacaggcgugagccacugcgcccggcuauucuuuuuuucuuuucuuuuuuuuguacacucaagcugaugcaaauuguagaucuuggcuucaauccaucugugaauucuuugugccaacugccaaguuggcauugcuauccuuuccaucaacaaaaacaaggcauuuggaaccuuaacgaagauggcauucugggaggcacauuauaaaaggagcgucucggaggugucaugcacucgggagcuuauuauugaaaacacaaaccaacaaggacaucaccguuucaaaauacaaaugugaaguggaugcauuugaggagaaugggggguucuuauugucaaggaucuacccuuagcugcuucucuuuuuuuuuuuuuuuuuuuuuugaguuggagucuugccguguugcccaggcuggagugcaguggugcgaucucagcucacugcaaccucugccucccggguucaagcaauucucccgccucagccucccaaguagcugggauuacaggcgccugccaccaugcccagcuaguuuuuguauuucuaguagagacgggguuucgccauguuggccaggcuggucucaaacuccugaccucaagcgaucugccgccucagccucccaaagugcugggauuacaggcaugagcuacugcacccggccucuuuuuuuuuuugagacagggucuugcucugucacccaggcugcagugcaguggcgcaaguacagcucauugcagccucaacucccagggucgagcgauccucccaccucagccuccugaguagcugagacuauaggcacaggccaccaagccuggcuaauuuuuaaaguuuuuuuguagagacaagguuucuccaugucccccaggcugaucucgaacuccugggcucaagcgauucucuugacucagccuucugaguaucugggacuauaggcacaugccaccaugcccagcuaauuuuugcuuuuuuguagagacgggguuucaccauguugcccaagcuggucucaaacuccuggacucaggcgauccgcccaccucggacucccgaaacuguuaggauugcagacaugagcuaccgugcccagccuccucagcuucucuauccaucuucaucucucaggauuuggggaggggauuuguaauaauugccacaaggugcuuugagcaucuugcauugcuauuuugauuuugaugaacucugaguccuuccuauagauuggaaaagccuggugucuguucuuugcugcaggccugucucagcucccuuuccaguguucacucauuuugugucuuaggaguucugcuggcugcccccgccucuguucguguacugaugagaaggcaucuggccccuaggaagagccccaggcccgcagaagggaaccuggaugucccccuugcucugaguuccauacuggggcagccuuccugacauccagcuuccuugccucccaggacgaaugguuuucuuugccccccucaaaccccgcaggacuccaggucccuaaggucaugggcaucaacugcuccacacugcugugggcaagggccauucaaagucuugcaucuugcagauucaaggacauuaggaaacucucccaucagacaacuugggcugccggcagcuggguucucaguccaggaaccaaacguugucuuugacucugcucuguucagccugccucuagugccugccuguucucggcauugguccacacaacuccacccucguccacgccuccuccacaccucuuuggaugcaagcuuccugaucucaagccucuuuuuauuuuaaacuaauagauuccccccucccccagaagaugauguuuguuuguuuuggagagagagucucccucugucacccaggcuggagugcaguggcacaaucuuggcucacugccaccucugccucccggguucaagugauucucgugccucagccuccugaguagcugggauuacaggcgugcgccaccaugccuggcuaauuuuuguauuuuuaaauuagcgaugggguuuugccauauugaccaggcuggucgugaacucuugaccucaggugauccacccgccuuggccucccuaagugcuaggauuacuggcgugagccaccaugcccggccgccccuuucuuuuuaguauuaaauaauccuccauuauuuagguguaucacaguuuauuuauuuauucagcuguuggagaacaucucgguugcuucugaguguuggcaguuaugaguaaagcugcucucaacauccgugugcaguuucugcguggcggacuucauuguuuagagcaguuuuagguuuacagaaaaaugagcagaagguacagagugcuguaugugaggagauagggggcggggggccacugcuucccuguggggcuuccugucucauggauugagaguccuuaaggaggccuggacgccauucucuguaccucuguuccugcugugugaagaaggaaccgugugacaccgacaggugaaccuuccagggucccugggucuuagggacacaaccaagggacagaaguggaccagaagucacugcccugggcaagcuccuggccauuaggcagcagugucucccuggcacucuagcaggagggugcuccuggguggggguggggggcuccuggcaggggggugcuuccagcaaggaggugcucccagcaggcggcugcucccagcaggcgggccccgaagcccaggugccaggacugcugcaaaacucuccagggcucuccgggggcauuugccaggccccuuauucagcccucagagccuaggcgcccccuccuccagcucacagagccugcacuuccugccgcccggugacagguggcugacuuguguuuauggacccaagacagaccagcaugggggcuggguagggaggcuccugcggccccggauccgccuggggcuucccuaauccuggagacagcugggaaggaguggggcccaggcagccucuggcgugucaacacuggcgcugucggagaacagaggcaaagcugguagagcagaggguggcuguguguggugugugucauggggugcgugugugucaugguaugugugugucuaugguguguguguccugguguguuugugugugccuauggugugugugugucugugguguuuguguguauauggugugugugugucaugguaugugugugugugucauagugugugugccugguugugucaugguaugugugcaucuguggugugugugugugucuaugguguguguguagaguguggugugugccuacgggguuguguguguggugugucuaugguguguguggugugugugucuaugguguguggugugugugugauguuuaugcagugugccuaugguauguggugugugauguauguaucuguggugugugucuacgguguguauguagugcgugugucuaugguguaugugccuaugguuuguagugugugguagguaugugugucuaugguguguauguagugugugugucuuggugucugguguauguguggugugacuauggugugucguguguggcaugugugucuauggcaugugugucugugugucuaugguguguaugucuaugguguguguggugugugugcuuaugguguguggugugugugucuauggugugugguguguggugugugugccuauggugugucgugugugguguguguguauaugguguguggugugugcauggugugcgugguuugucuauggugcguguggugugugucuaugguguguggugugugugucuaugguguguguggugugugugucuaugauguguagugugugugucuauggugugugugguaugugugucuaugguguauggugugugugucugugguguguguugugugugguaugguguguggugugugguaugugugucuauggugugcgugguguggggucuauggugugugugcuucucggccucugacuccuccggggugggagcagcaggcaugggguuugggaucuccaaggggcugggguccguggggcgugccccgcugcaguccugccuggugggcugaaguggggccucugguuggggccggggcugcggguagggccgggcaggaccgucuggcccggagcugcgcuuugucgcggaaagccaaaagccgcuucugcuuagccggccggcgagggauuugggccccgcccgcacucgccgagggcugcguccuuaccuucugcgcuugguccuccaaccucguccuggaggggccugggagcccuguccgccggagcucuuuccucccgcucuucugacaggaucggguuaaacucagauuucucuucucuggcuggagggcuccguggagcugcagaaugagggcgcugccaagguggauuuuggacccugaauggaaauucacaccagggcuggaggcgccagcugggccugggaggugggagaugagggcggccugacacaacccgcugugacuguggccgggguggugggagggaagcccacagcggggccaggcgggccaccgaggagcagggccaccccagccacgcccugagccggugggggggggcccggcagcaguucucgcuccuggccugcaccgaggugaggaaugccuggaagggucccugggugugcacagccuggaccagugggcugugcgcucuaaguggcacugagcgucucuuucagcaguggccacacgaagcaggauugagauucggggaagaaguggccgcaggggcugugggccuccgcagggaagggucucugacgagcuugcccugggcucauggggaacuguggcuucaugcugggacugcggggcggaaggagggcauggagggcuguggcugcccggguacugucccaugguagccuccgagcagcugucgcuggagcccguucgcaauaccccuggagggccgccugcccauaaaggggaggggagcagcugggcuugaucuuuggaagggacaucuggugaauuucugaaaacguauuuuauugcaggugcuuucagcaggguggaggggguggccuggggaggaaguuaaaaugaccccgccugucccauuucgcgguaaaucuugccugugaugagccauuacucucaccagagcgugugauaguaugagaaccguggaucucacacacguguuugucacaugugcagcguugcggcagcugagaggguguggaccaugaggugggccaaaccacauaggccuccgggucacggccaaggcaccucuuaaaauuguccauaaaguuuuauauaauaaauguccccggccagucaugguggcucacgccuguaaucccagcacuuugggagguugaggcgggcggaucaccugaggucaggaguuugacaccagccuggccaacauggcaaaaccgucucuacuaaaaauacaaaaauuagccagguguaauggcaggugccuguaauccuagcuacaugggaggcugaggcaggagaauugcuugaaccugggaggcggagguugcagugagccaagauugugccauuucacuccagccugggcgacagugugagacuccaccucaaaaaaauaaaaacagggccggacgugguggcucacgccuguaaucccagcacuuuuggaggccaaggcagguggaucaccugagggcaggaguucgagaccagccuggccaacguggugaacucuggugucuacuaaaaaaauacaaaaauuagccaggcgugguggugggcaccuguaaucccagcuacucgggagucugaggcaggagaaucacuugaaccuggcaggaagagguugcagugagccaagauagcaccacugcacuccacuagccugggcaacaagagagaaacucugucucuaaauaaauaaauaaauaaaaauaaacgucccagcuuuauuaauuuaucauagauuucaguguuuuugucagauaacugaguaagcaauaaaaacagggccuagcaauaaaaacaacauaaacacucaaugaacugcucgauacuuuaguuaacaugugagucccuuucagguaaauauaugcuuugaauuaggcuuuugaaacauuaaaaguaguucauugaacauagaagaaaauauagaccaauguuuaacgaucuuuagcuuggaaaggauuauauuaaguauaaaaguaauaaaggaaguuacuaagaaaaaguuaccaucaauuuacauaaaaguuuuaaaccuccguaugucaaaauagguaauauaaauaaaaggcaaacaacaaauuaggagaaauacaugugugucaugguauguguuugugugugucauggugugugucaugguguguguuugugugucauggugugugugugucauagugugugugccugggugugucaugguaugugugcaucugugguggaugugugugucuaugguguguguguagaguguggugugugccuaugggguugugugugugaugugucuauggugugugcagugugugugucugugguguguggugugugugucugugauguuuaugcagugugccuauggugugugccuaugguauguggugcgugauguauguaucuauggugugugucuaugguguguauguagugaucuuuacuauauaaagaguucuuacauaucaaugaaaauuccaucucagcuuaaucucuguauuaaaaauaauaagaauuccaccacgccagcagaaaaauugucaaagcacaccaacagauaauucacaagugaacacaaaugucuaauaaauauaggauaaucugucacccaggguggggugcaguggugcaaucauggcucaaugcagccucgacguccugggcucaagugauccaccuuagccucccgaguagcugggauuacaggcacacaccaccacccccagcuaauuuuuuagaagugggaucuuguuauguugcccaggcugguuuguuuguuuguuuuuguuuuuugagauggaguuucacucuuguuuccaggcuggagugcaauggcacgaucucggcucacugcaaccuccaccaccugaguucaagcgauucucaugcuucagccucccgaguagcugggauuacaggcaugcaccaccaugccugucuaauuuuguauuuuuaguagacacgggguuucuccauguuggucaggcuggugucgaacucccgaccucaggugauccacccgccuuggccucccaaagugcugggauuacaggcgugagccaccgugcccggcccugcccaggcugguuuugagcuccugggcuugagcaauccucccacgucagccucccaaauuguuggaauuacaagugugaaccacugugcccagucagaaaaccauuuuucaguucccagccugguggagauuuaaaucccuggcagcacucuuacauuucggggaacccacugggcaauacgaguugggguccaguuuauccuccuggggaaacaguaauccuggaaauaaugaggauacagaugaagauuuauguauuaaaauguggaguuuauuauuucaguagccacuaguuggaagccagaugccuagcaauggcggcugauucuaugaagauggaggguuggcauuuauaauuuuuauuuuuauuuauuuauuuguuuugagauggagucucgcucugucucccaggcuggagugcaguggcgccaucucagcucacugcaaccuccaccuccugaguacaagcaguucuccugccucagccuccugaguagcugggacuacaggcacccgccccuacgcuuggcuaauuuuuguauuuuuuaguagagacaggauuucaccauguuggccaggcuggucuugaacuccugaucucaggugauccgcccgccucagucuuccaaagugcugggauuacaggcgugagccaccacaccuggccuuauacuuuuuaaauguguuaauaaugugguauauuuguuugcuagggcugcccuaacaaaguaccaggguccagguggcuugagcaauagaaaucucucugacagcccuggaggcaggaagucuaagaucaaggugucggcaggauuguuuccuuaggaggcugugagggaggggcugcuccaggccugcuccuugcugguagguggcaucauuguauucacacagcacucuccuuguauauaggcaccugcuaccaacuuccucuuuuuauaaagacaccagucauauugaccucaagguaacuugaucaccucuauaaagaugcugucuucaaaaacaguuucauucuuggguacugggguuuaagacuucaacacaggaauuuuaggggauguacuucaacccuaaaguuuguuauaucauaaguauacuucaccugggaaaauauauuuaugauccaacugaaagcaagauaugauauaauuccaaggaguggguuuuucauuaacucauucauuauagggcacaaaauauaguagagaauacauaaaugucuuaggauuaugugauuuaagggacacguauucuuccuuuuccuucucugaguguguuucauaacuaaaaaaaaguuuuaaaaaaugggccaaggauucuccacuucuaguuugcuggugaccagagguugggaacuagguuggauuucgaugaaauagccucuugcgaaacagcaaaugcacuuuacaaauaaggagaauuguuuuuagagagcaaacaguccugucuaauguuuaauagacaugcuccauuucuccaaaaagagcccagucucuccagaacaaucugggaggggcggggggggguuguccuggugucccagguggcgggugauggaggagccggaguucugcacgugggggacgaaggucucacgcugcaggguuucccgcucacgaaaugacccugaguggucagaaccugucuucuccuccguaaagcugcacuguugggacgcaccucgcagagccacagugagguucugccugucaugguaugggagaaaaugcuguauuuugaacacuuguauuucggaaucuccuuuaaagcuuccagcacauucuuuugauuauccucagugcuggcaaaacauuuucacuuaaagaggguuuugauuuggggaagcagcugagagcugugugcagccagcucuggcaacuggagcgaucacacugaguagagccauuugaaacacagaaggaggugggcuccagccccgcugcggccuuguccaguguggacaccgcgcaggcuacagagcacccaaaacguggcugagcagaacuuugacgugcuuaagugcaaaaugcacagcagacuuuggagacuuuaaggacauaaaauaggccaggugcgguggcucccgccuguaauccuaacacuuuggaaggcugaggcaggaggaucacuugaggccagaaguucaagaccagccugggcaaaaaagugaaaccucaucucuacaaaaaauaaaaaaauuagcgggaccugguggcaugugccuuuaguccaggcuauuugggagacugggcaggaggauuccuugagcccaggaguuucagaauacagugagcugugaucacaccacugcacucuagccugggugacaaccugucucuaaaaaaaaaaaaagaauguaaaagauuucauuaauaauuuuuucaggcugggcacgguggcucacgccuguaaucccagcacuuugggaggccgaggcaggcggaucacgaggucaggagaucgagaccauccuggcuaacauggugaaaccccaucucuacuaaaaauacaaaaaaauuagccgggcaugguggcgggcgccuguagucccagcuacucgggaggcugaagcaggagaauggcgugaaccugggaggcggagcuugcagugagccgagauugcaccguugcacuccagccugggcuacagagugagacuccgucucaaaaaauaaaaaaaaaauaaagaaauaauguuuucauauugacuauaugcugaaauaauaauauuuuggauauauuaugcuaaaaauuauuaaaauuaauuucacuuuuuuuuuuuuuuuugcuuaccagaaaauuuaaaauuguaucuaugucuccugcaguguuucuguuggacauggcuggucuagaggacggcgagcaauuuucuugcagggcuuauuaacugaccuugcaauucuugaagaauucuugaauucuuaaacuauucuggauaacauuagaacagaacauagcuuuuccaugugauuauugggaaggacaauauguuuuuugauuuguaguuugcagugugauuuuuuuaauuaaguuucgucacuugguugucauaugccccugugugggaugaaguguuuaggccaagaguggccagaaggcuuccuggagagguuggcagagagcugguuuggauagguggagaagaauccccuggauuuggucagauggucuaugccagggcacugccaucugcaacccacaggccaaagccagccuuccaccuguuuuguacagccugugagcuaaggaugguuuuuacuuuuuuuuuuuuuuuuuuuuuuugagauggagucuugcucugucgcccaggcuggagugcaauggagcgaucuaggcucaccacaaccucugcccccuggguucaagcgauucucccgcuugagccucccgaguagcugggaucacaggcaugcaccaucacgcccggcuaauuuuguauuuuuaguagagauggaauuucuccauguuggucaggcuggugucgagcucccgaccucaggugauccgcccaccuaggccucccaaaguaccaagauuacaggcgugagccaccgcgccuggccgguuuuuacguuuuuuaaggggguugaaaaauggaaagaauucuuuuugagacacgugaaaaaugaucuagaauuuaagcuugagugucugucaguaaagcuucacugucacagucaugcccaucauuuacugucuguggcugcuccugcacuccaagggccgaguugaguggucacgacagagacucuccggcccagagaguccaaagcauuuacucucuggccuuuugcagaacaaguuugcugaccccugcaccaaggggucgacuuucuucugcagccuucauuggacauguugagggagccuaaaaaggggugggcuagggagagcugaguggaugagggcccuggagacgguugagaucaggcagagggcgucuguggcucaaggcugaggaggugaggaucugagcuggguccccacccccagaacuggugauuuucacaagugauguugacgucgggaucucugagauggggagaugggggugauggaucugucagaggaaagacaugggaaugggaaggccacuccugggcuggcuggaacaucuuuggaauauugugcuugggaagucagcagccauggagacaauuggaaauacacaaacagggcugggggaggcugaagcauggagggggucagaggagaggaacccagagaggcagagagcgcugagccgccugguccugggaugguggccaucaccacugacaucugcccccugccuccugccaggcugggagccaguucugcugagccaguggggaccccuccacccacccacccacccucugucccagagccuagccaagugcuggaggugaaagggacuugauuuagggaccacccucaaccagcucuggaucuuuggagaaauguaaaaaaugcagaaaguucaaagaacaagaucauauacccggagacccuccacuaauagauaauuuuuaacuuuuuuauugugguaaaauacauauaacauaaaacuuaccacuuuaaccauuuuuaaguaucagguucagcggcauugaguacgaucauguuguagagccgccgccacuguccaccuccaggacgcuuucauccucccaagcugaagcucugucccccuuaaacaugaccucccuauuccccccaccucacccccuggcacccaccauuccacuuccugucucugugaaccuaacugcucuagggaccucacacgaguagaauccuacagugcuugucucuugugacugauuuguuucacuuagcgcaauguuuucgggguucauccaugcuguagcaggcgucagacuuucuuuucaaggccaaauaauauuccauuauacuacauuugguuuauccacucccaguuacuaauucuuuuuuuuuuuuuuuuuuuugagauggagucucgcucugucacccaggcuggagugcaguggcgugaucucggcucacugaaaccuccaccuccuggauuuaagcgauucuccugcuucagccucccauguagcugggacuacaggcacaugccaccacaccuggcuaauuuuuguauuuuuaguagaggcgggguuuugcuauguugaccaggcugaucucgaacuccugaccucaggugauccgcccaucucggccucccaaagugcugggauuacaggugugagccaccgcucccagucagaauuuccuuucuuuuaaggccaaauaauauuccacuguaccacauuugguuuauucacucccaguugcuaauucuuaucauguuggcuucaagucuuuucuuccuucaaagaggugaaggugaagccccucuguggcugucgucucccagcccccugaccucugcagacuuuugugaagccggccugcacgcagcccagcuguggucagaguccuggacaucccccaucagugaucaggaugcagcguggcucugugccugucuuuuauuuuuuuuauuuauuuuauuuuuuugagacggagucucacucugucgcccaggcuggagugcagugacucaaucccagcucacugcaaccuccaccucccggguucaagcaauucuccugccucacccucccgaguagcugggauuauaggcucgugccaccacacccggcuaacuuuuuuuucuauuuuuagucaagacgggguuuugccauguuggccaggcuggucucgaacuccugaccucaggugauccaccugccucggccccccaaagugcuuggauuacaggcaugagucauugugcccagcugugccugccucuucacugacacggucguuccuuggcguggcuugguguguguguuugugagcuccauguguguauagaagucuaguugguucucaucugcuaucuagagguuuggugguuucauuuuuguugguagaaacuggcugcaaagcauuugauuagguguuuccuuggguuccuccaggcagagucaucacauguuucaggucacagcgcauuauauauacauuucauacgucccaggucgucuuacccacaugaauguguccucacggggcagaaguucucugacccagugcugagccuaccuauggccaggguucaagggcauuuucuauuuuuuuuuucuuuuuuucuucuuaugcugguguugacccacuaaauugauuucaggaucuaugauagggcugcaaauugcaguuugaagaaccacccucagguauuuccuaagggaggaauuucagggggcuuugggccuucucaguggugccagauucugccauguugcucccgcauuggaggagacaggacuggugacagcuccccuuucccucauccucaguauuuuuugacuuaaaauugcuuuuugcugguuuguuggguguugaauuuuuguuuggaacugagaaucucuuuacauauuuaucaguucuuugguuuuccucuuguguggagcacccauuuuuuucuguugagauguugcuccuuuucaccaugaauuuauaggaguucuuuauauauucuguauacuaauccuuuaguuuauaaauuuuccuucuuucuuuuuuuuugagacagagucucgcucuguugcccaggcuggagugcagugaugugaucucagcucacugcacccuccgccucuuggguucaagcgauucaccugccuuagccucccgaguagcugggacuguaggcgcccgccaccgcaccuggcucauuuuuguauuuuugguagagaugauguuucaccauguuggccaggcuggucucgaaccccuuaccucaagugaucugucugccucagccucccagaguacugggauuacaggcgugagccagugcgccuugccuguuuauuucuuuuuaaugaauuagaagggcucauuugugcugaugcaggugggaaacugagaaaagaaaacguuuuuuuuugugaaaaaaacguuuuuguggagguuuuugugaaauugcuaaggugggaacagaguuucuguagcuuagugguucuccuugggagggauuuugcccuccagggcacauuuggcaaagccuggagauguucuaguuuucguacugggaagggaggugcugguggcauccacagguugaggcgagggacgcugcucagccuccugcgauggacaggguggccuggccaagauggagaacguggccuacccuguacagagcuguucaccagcaggacacgcuccugugguuaaccagaacccaccgggugccgaggcgacacguacugcugugagacagaacgcaaguccacaaccuugaccaucuccucucucuuccucccccaggcaggucuugacgagcccugcccgggccgacgcaugcggaggauggaaacacuugcccggcaaugucucugggccgccuccuucgcagggccuccuccaaagccucggaccuccugacccucacccccgguggcagcggcagcgggucccccucuguccuggauggagagaucaucuacuccaagaacaaugucugcgugcacccgccggaggggcugcaggggcugggggagcaccacccaggugagccagggcaggcgaggcuccagggucgcacagcccagguuauuuuccgagccagggcucuaaaggcccugggccacagcacgugagagugcauuugguuccucuuccagaacguguaacuaacagcagcuguccucccggaaggagggucugggggguguuaagucuggcucauggcaggcugggugagucccucagcccugcugcuuccaaagggagggacaaaagauggguuagugaucccucaggccugccuggccccuugucauucgugugaaugacuugcaacaaauaaaugcauugcuuuguucaucuguugcuuuauuuaauuugcacaacaaccucaugggaguggccagggccccagcaggccucuuagguggguaaggacgcugguguucagagaggcugagcgacucucggcugcacagugccagugugugguggagguggggcugcagggcagucucuggacucucucuucucauuucuuccuguugccguccccuucccuggcugcuaaaaggauguuucagggccccaguguccugcagccuggcuguggccugccccggcacacccuaacauuugcuuggcuugggcaagaguacagacagaagucccagacaagauggcaaaauaguaaaguugucaucugggcgaggugguucacaccuauaaucccagcacuuugggaggcugaggugggaggauugcuugaacccaggaguuugagaccagccugggcaacagaguuagauuucaucucuauuaaaaaaaaaaaaguuauaaauuacagugagaucugggcacuuuaugcagauuauguuucaaucgaauacugaauaaauaaauuuuuaaacaagacaaaaguuuaaauuaugccaaugaaacauuuaaagagaguguucugucccccugccuugauaaguguaucuuuauagccaccggcugguuggcugcggcugugugggcaggggcuucccuggagugcccuagaaaggggugcagguucugggcgaugcggccccucgacccggagguugccuggccugaggguguucuagagagagagaccagggaguagccaccucggacccucuugccgaucucaaaggauguggaaacacuucucagccucaggcucauguuauccuaaugcccagcuggcugacauuccccaaauuucccagccuguuuuggcaacaggagcagugcuuaggagauucuaggggucugaguuguagaggccuggagagugggugggggaggcccaggaaucaggauauccugaaacugcguggugcuggguuaggaaaugccaccuccccccagaacugagcacccacccacuugcucuggcccaggagaaaucccuccucccaugucaccagcaaccccgugugugacaucaaugcucaucugcaaagguggccccuuccucaaacaaucugcauuaaaaaaaugccaugagugccacugaugauuggaaaaggcccaaauaccacccagcuuggaugaauuuuuuuuuuuuuuuugagacggagucucgcucugucauccaggcuggagugcaguggugcaaucucggcucacugcaagcuccgucuccuggguucacgccauucuccugccucagccucccaaguagcugggacuacaggcgcccaccaucacgcccggcuaauuuuuuguacauuuaguagagacaggguuucaccauguuagccacgauggucucgaucuccugaccucgugauccacccgccuuggccucccaaagugcugggauuacaggcgugagccaucacgccuggcuguaugaauucuuuuugugaaacagaaugaagucuccagccuccaucccuccuaacagugcuguaaagccaugaagcugggcaccugggccgcugggcucacacagacagggaggcugcaggcaggugagcccuggggccagggucagggcucugaacacagggagagccccugguguacuuggaaaggugcauggcaagccugaguucguggcucaucgccuguaauccuagcacuuugggaggcugaggugggcgguucgcuugagcucaggcguuugagacuagccugggcaacauagugaaaccuuauuucuaccaaaaaaaaaaaaaaaaaaauuagcugggugugguggugugcaccuguagucccagcuacucgggagcugaggugggaggauugcuugagccuaggagguggggguugcaguaagcugagauugugccacugcacuccagcuugagacacagagcgagacccugucucaaagaaaaaagaaacaaacccaaaaaccaaaaagaaaggcgcauggcaggccggugcuuggggaccagugcccccuggaucugccggaaguguguguucuuaaaaaacacgcauagcuggaauucauuucaagcuccacaguuucccucuaguguuuuugcucagggccaggcuguaucugaggccggacuggcacuuuacuaaagggcaguggccucuccgagcagcucgccaaagguaccacaagggccucauccacagccuccuggccucuaacgugccaucccccuggcuccucacagguuaccugugcuuguacauggagaaggaugagaugcugggagccacccucauccuggcauggguccccaacucucgcauccagaggcaggacgaggaggcccugcgcuacaucacacccgagagcucccccguucgcaaggcaccccgcccucggggccggcgcacccggagcucaggagccucccaccagcccuccccgacggagcugcggccuacccugacccccaaagaugaggacauccuggugguggcccagaguguuccagaccgcaugcucgccagcccugcgccagaggaugaggagaagcuggcgcagggcuuggggguggauggugcccagccagccucgcagccugcuugcagccccuccgggaucuugucgacggucaguccgcaggaugucaccgaggaggggcgggagccgcggcccgaggccggggaggaggauggcucuuuggaacugucagccgagggcgugagcagagacagcuccuuugacucagacucagacaccuucuccucgcccuucugccucucgcccaucagcgcggcgcuggccgagagccgcggcuccguguuucuggaaagugacagcaggugaguuccugguucugggcgugggcucucgggaggcccccaaggccugaccugggcaggaagcacucaccugcgucaccugugaugccaggugagcgcuggaggcaucugcccgaccugcccgcggcuguggccguggcuguggcaggagccccucccugaggcaagggcuucagcagggaguccccacuuuacaccccacugagaggacugugaagggugcgucgggguguccacauucuucucucuccuugagacucacuaggacuaaacaggcccuaccaggucugaugggcccaugaccaaggcuaagcccccgggaguccuggucccuucuguucccaucaccggaggggcaggagauuuucaguccccaagcgagugcccaagaggcccggguggcaucauuaggcucacgcacagggcuggcccaagcccagaugugcuggucuccagcuccccgcucugcccugcagcccacugggcacgugaccuggcccccugugguccccggaggcuucagccucccucuuucucauagcuguggaggauggauguagucccggggcaguguugaccauauucacccgacuuggcagccgcuaugcacccuggggaguccagccagaguaucuggacuccuugcuggccacacuugcaggagcuagaguugggcccgugcccugcgguggguucccugggccuuggaacccaaagagaccuuccugaguggggaggguugcauggugccacgagggcccucauggccuuggggugagugcccguguggucgcauaagcccggagccccagagccagcacagggggccugcauccgacuuccacagccccuuccuaugccccggcugugguccuuacgcucauuagauuucugggcaaauaaugguggugaccacagacaacaguaagagccgacaucagucagcgagcaggucauuaacuguugagcucguggugugagccgggcgcaugcuggacguggguggucugggucucgccugggcgcuggacaccgugggcuauggaugguacgugugugcuuuccacagccccacgccccgugaggugggcccuccuauuauccccugcuaucgaaggggaaagggcggcucggagaaggucagcagcuugccaggggucucccagccagugcccgggccaagcugggaugugaacccagcugggucugccccagggcugcagcauaaaaggucaccccaggccgauuaagccggggagugguggggcaugaaguaaggacacaggcuuugcuggccucagcaggggugacugugggacggguucuucccugauuuuaucccuccaguaaagaugcaguccauuagagccccagggugaaccgauaacauucaucucaguuauuggagagugcagauaaaaggaagccgugagccguaacugaggacuccaggugccaggaggcuugcugagcuggguggcgucaggcgccagggaacccgaggaggugugggggaggcggggcccgaacucugguccuggccugggucccgcaggccggacucagucggagcucccccugguggugccaggccaacagugcagcagaaccugcaggcguccccgugucccugcauccccagggcccaggcgaggggaaggucccaguugugucucagagagguggugggguuggcccacggucuuggggcugaggauucuguggcagaaccacaaccagaagcuggccggucagcucucugucccgcagccccaucucguagggagcucaaguuuaggaguuagggaguugagugccgguugaguccuggcaucacugguuagugugaaccugggaaauucuuucuuuucuuggagccucgguuucccuguuuguaagaugaggcugguaauauccacuuucuggggguauugugagaaugcaccccgguucgcuuuuccccgcccuucgccuugcugguucuucaaccuggcugcauguggggguuccugggggagccuuuagacgcugaugcccaggucccuccagguucuucuagagcagugauucucacccggggccgagucugugcccaggggguguauggcaaugccaggagacacuuuuuuuuuuuuuuuaucacaacugaggguggggauguauuggcaucagugggcagcggacaggcgugcugugcacucacucuggaagccaggcugucccucugccugggacccaccgggggccgcccaucauuuucaggaugaagcaccaucuccuucacucgggguccaaggcccaucaccaucuggcccugcugagcgaugcugccugccuccccaccccccacugugcacaccuccaaguucgucguccucucugccucuagaucuuguggggcucucucugccucaugccuuuggcuagggauccccucuaccuaggcuuccuccuuccccucucuccuaaccggccagcuuauauguuugagacucagcuccuggggcgaggcaccuucaugucagcuuuugggggaggcuucucuauucccccgaacccugggcugaggagggcccuccccauggcccccuucucugcucugacacucgaguccccacugagacacccuguccgccuguccguccccagcugcugggaggcagaugguggugaaggaguaaauuuugggguccgacagaucuguuuccaguccuggcaucauccugaguuaugugugaucuuguggccauuaccucccacauccaaaacgcagaugccucacgggugugaagugcggccaagaacccccuuguagggcagagucggcgugaggguugagcaccagccugggguauggggucagcgagccuggccugggacucguccccacccggagaccgugcuggggggugcuuaccacagcccggcccugcuccugaugaaggcucagaaaaugccucuuggccacauggccgcgggcucgguguggcucgcaccucaggccugugucagcccgguccaggggaggcucgcugaacguggcgaguugcagcuuugugcugggacgagguggauguggaugggacucuccccaccccgccagaagcgugugcuucagugcaaggcuggagugaaaacagccugucuccaagacagacugcugagagcuuucuuuuuauuuuuaaaaaguagauauggaggccgggcacugugacucacgccuguaaucccagcacuuugggaggccaagguggguggauugcuugagccuaggaguucaagaccagccuggggaaaauggcaaaaccucaucucuauaaaaaauacauaaaaauuagcugggcauaguggugcaugccuauggucccagcuacucaggaggcugaggcaggaggauggcuuaagccugggaggugaaggcugcagugagcugugaucaugccacugcacuccagccugggugacagagagauacucugucuggaaaaaaaaaaagaaagaaagaaaaagaaaagcagacauggauucugaaaggggcugggcgagcccuggaaucugcauuucccuggucuuuccuugcuccugugcgcuucuggcccccaccacaugguagacccaggaagcagagguggugcuccuugccccauccccaucccccggggccuucguaugaugggacuggagauccuuggcuaaggugguuaauuguccuagacgcuguagagcaggcguccccagcccggcugcccaugagaaugcccugggcagcuuuaaaaauccugaugcccaggcugcacccagaccaauuaaacuaggaucgcugggguggcgcccaggcaugggaauguuuugaacuuccuggggguuucugaagugcacguagcguugagaaccccugcugugaaggggcugagagagagagagagagagagaaagaaagagagaaagagagcgagagagcgagagagagcgagagcgcuccuggugcucugggguggggaggggugucagggccgaggaccccagaugacuggccaucccgccaggcagggguguuggugaggacucgggugcacccaucgccacucugagcgguggggcgucuauuaauaauuaacccggaguugaguccccccggagggcagagcagguaggcuggcucgaggguccccucuagugguggaucugaagaacugcaugugcaggcugcgugucuggcugagauuggccaggagggacaacucccccaccccaccccgggggccuagggucccccagguauaugguuauuuggcaaguaguucacagaagagcuuagggguuagaaauggcaguaucccccgggcugcccacauucgugugcuaccuguagaguauggccagguggggucugcaugcuggaaggugagcccaccuacuaaacccagaggucuccuuuggaagccccaggccccaggccccaguccagcgacggccuggaaauccuugaccaagugaguauucgaggcugacuugggggauggggugauacggagagcugcugucgccaaugcgucguccugccuccccgcccugagaccccaagacccugagcuuccccgagccgggggugagcccugggcuaucuugguccugugcccuccucagugucagaaagcaaggcucucgggugugcuggggagggugaccaccaagcgcgacuggucauccugcccuugguuucugugcuggaagcuaccguccagccuaaaaggccaguugggcgaggguguggaauaacggggcgccauggggcugguaccguguccacugacccugccccggggaugugcauuggugaccuggauaaagaacugaaacaagccugggcaacauagcgagaccccgucucuaccaaaaagaaaaaaaaauuagcugggugugguggugcacaccuuuaauccaagcugcuacuccggaggcugaggcaggaggacugcuugagccugggagguggaggcugcagugagccaugaucgcaccagugcacucaagccugggugacagagugagaccuugucaaaaacaaaaacaacaacaacaaaaacaagaacaacaaaaacaccagauucugcucccuaagugaaaaugucuccucuggaccucauccuaagaaagaauccaaauuacagauagaaaggccaaaguggccggcacguggcuuaagccuguaauuccagcgcuuugggaggcuaaggugggcagaucacuugagguuggcaguuggaggccagcguggucaacaccguaaaaccccaucucaacuaaaaauacaaaaauuaguucagcaugguggcacaugccuguaaucccagcuacuugggaagcucaggcacgagaaucgcuugaacuugggaggcagagguugcagugagccgagauggugccccugcacuccagccugggugacagagcuagaccuugucucaaaagaaaauaaaaguagaaagacaaacgcuucugcaugaagauguucaucgugguauuccuuacaguggggaaaaaggagcagaacauaagaauccaacggcagaggagguggaccgacuaaggucccucuaaggucccucuguuggaucagggaguuuucaaaccugggcucacgaaccccugagaucuuaccccacuuuuuuuuauaugaggaggaggcaccaucugacuucccagaaggucugugaccuguaaaacguucagaagcucggugcugccagauaggagaagaugugguauugacaaggacugucaaaugguccaugcaguguugcaguguggaaauuuagagugaaucagacgcaaagcaggaaacggguuaugauucugcccguugcaguuaaacucugugaagaggccugaggugcagaugaggcucucagggcagggcugcccagcagagcuucugccagggcagacagaacccaggucugcgccgucccgcacugcggccacuggcuucaugcagcucuugaacccuugaaauggcgcaagugcaacugaauuuuuaauuuuacauaauacggauuaauaaaauuguuuuuaauuuuaaaauguuuuuaaguuucguuuuuagagacagagucucaccguauugcucaggccggcauacgguggcggcagcacaaucacagcucacugcagccuccaccucccgggcucgagcgauccucccaccucagccucucaaguagcugggauugcagacaugcaccaccaugccccguucauuuauuuuauuuuuuagagacagacucuugcucuguugccuaggcuggucucaaacuccuaggcucaagugacccuccugccuggaccucccaaagugcugggauuacaggcaugagccgcgugcccggcccugaugaauauaaauguggauagcgccuguggucaguggccacggcaguggauggcagagguugagaggaaggugugcccacguguuagccuagugugauuaugagcacuuuuuuuuuuuuuuuacuuuucuguuuucaaaaauguuauucugugauuauauuaagcuuagaaugaaaaccaauguauaaaaauagacagaaggggagaaccugcacauuuggggacgcuaagcaucucccacugcgcugcacgcugcuaacuagugaagaggccuccagggcgagcuggucacugagguccuuccagugacaccagugccgccggccugccaccuugggucccgugccgccagcggggccucccccuggggaagugaguguuucguucucucucucccuggguccucuugucauucccggcaugcguucccgggguggccagccuaggcaagaugguguuuggguguugggaugggcuggguggccuggccucagaguuuggccacuuguuacugugguuucugucaugcaguuccugccaggucagacucaguccaagcggguuggcgcggccacaggugggcaagggccaggagcaaugugcugcccaccugggggugcugccgggacccccugcccucccacuuuccucuugcccuuuccugcacacacacugggcacuucaccccaagcauagccgcuucccaccuugcugcccgcagcuggaauguucuccucucuccugcugaauccccagcccaccugcagguggaagagacuuucuucuccgugaccccugcugggaccugagcuuucucucuggagagcuccuaucaaggccgcgugguguucccuacgugcgccaccguucccgggugcuuccucacaggguccucccagugccugggccagcgccgucagcagagcguccugcagugcacgcgguccugugccugugccccacuguguguggccaccacgcccuagaaaugcagcagauguggccaagcaacuggacuuuggucuuucuuuaucuucaaugaaugugaaguuugguggucacagcgggaggccuccaugccugacagcacaggucuggacggaauguuccugggaggauggaagguggacccuagaaacguagcgacccucccagcaggacaggcccgaaaaacucucuguccaaaguaaugggggaaagacgagaugauaagacaaggccccucuacucccucaggguggccccugucaugggggcgauggcacaaggguucaccuggagcuggccagugcuuggacagcagaccccauggggcggccgcuccccaccucacauggcuucccuggcaggugccagcccaccccgcagggcgugcgaggcaguaauaaacggcaucuaagugcuuucugccuuuaggaggaaaaggcuccuugucgaccgaguaucagcggcagcggcugaauuauuaacggcguuaucguucaucguugguguaauggccccuguccuccuacacggcacagaggacagaaaugaggcucucggggaagaguccagucucugagaaugagcuagagccagugcgcuuggugggccaggacccagugcugggaagcauccuugcaggagcucccacggaaggcccugggggugucgcccuggacucacaaagcucugcucguuccggaucccuucugcguuuccugccguuccuuuucugcccaacccuccaggcaagcccgaggaggauuagaaacuccuggaggugggcgaagaagugagcgguggcacacgaaucaggacacacuuugcccuucccgucuuuguuccggggcgcagcagcugcccagcaaaucagagccuggagcaggagacggggacacaaagcaggggaugaggaagggagcaggaggcgggggguggagggaagggcaugugagaggguccagggcaagagacagcagggaagggggcaaggggugaguggggagggugggccgugcgugucuuaggggccacuccagcagcagcagggaccaggggcaggugcagcacagauauccaggagcugccgccacccaggggagggacaacugggucccagagagaccucggaggugggauggccaggagcugggagggcugcauccuccauuccucccaaauuucaggaucaaaccccugaucccggucgugggccaaccagggcgcccggggauaccccgagagcgcccgccgcccccugaggaugcuccaggaacccccgcccaccccuccgggcccagcgcagccuggcagccgggaagccagcagcuccugaaggucuguuguuuggguuuguuugugcuucuguaaccgggagcugagauuuauuucuuuaaaacaucccauugcccgacacccugcaaucuguucugugugucguucagacuaaucucgucuuguuucuguagcacuuggcaggcucuguguggcguuccucccucccccagacuccccccugcccaagccaagguggccaccaccagcugcuccgccugcacccagagaguggccgaugccaggggucugagggaagcuguuacgggaagggcagcuggcuggucagagccccaugaacuggcauguggccauagucagucuagaaauggccacaggacauagccucgccccagcagucucacugucaggcggagaagccaagcaggcgcccagccgagcacugguccccucccuggcugccccucagcucugggagcuuggaggggcugccaaagaauucgacugggaugccaccgugcccagcccucuggugugcaacuguggcauggcuguuuggcucacacaugaugucuaggcagagaaggggcuggcgggcuugguugggugaggccuguaagugagcuuuggucagagacccagcugugaauccaagcuccacucaagacccgcaggggguggccuuggacgguguugaaccacucuguaccucaguuuacuccucugugaagugggggcauuguggggguucaggaaggccgugcguguaaagcucugcacagagggcucaguacagggcagauagacagucaucaucacuguguaccugacugaguugccagccccguuggacgugcucguaucaguguccuggggcugcugugacaaaggaccacaaaccgggugcuugaaacaagagaaauguauucucucacaguccuggagccagagguccaaaaucaaggugucugcagagccacgcucccucuggaaggucuaggggaggguccuuccuggucucuuccgguuugaguggcugcaggcauuccuuggcuuguggccacaucauuccgaccccugccucuguugccacauggacagggugugucccuuugugugcccucucuucuucucauacggaugccagucauuagauagggccuacucaaaucuagggugaccucaucuuagcuuggugacaucugcugagacccuauuucugaauaaggucacauugggagcuucuguguggacaugaaucuugggggagcacuguucaccgcggcauaugcucuaugggugccaaccugaaucccagaaacagcucccgacaucaguguggucaucaccccguuuuaggaaagggugacgcagagcucaagccuucagcacaagugauggcugagcagugacucugguuaaaaacaaaaagcaaaaaaccaaacacaaucagggcccugagaaacuccuuguuucugucaugucaguugcuccucauggcccagccucgucgaccccuagagcugagcgagugagucuggucaggagucccagacagguugcuggggccccggcaaagacacuauagaaaugggcuuccaaagagacaaaagagauuguguucauuuuagaaauucgaggguggccaggccugguggcucaggucuguaaucccagcacuuugagagcccaaggcgggcggaucaccugaggucaggaguucgagaccagccuggccaacauagugaaaccccgucucuacuaaaaaguacuaaaauuagccaggcguggugguggaugccuguaauuccagcuacucgggaggcugaggcaggagaaucacuugaacccaggaagcggagguugcagugagccgagaucacgccacugcacuccagccugggcaacagagugagacuccaucucaaaaaaaaaaaaaaaaaaaaaaaaaaagaaauuugggggaaaggcagaagggaaauauuugugaucuuugaucccucugguguugccguuaucauuuugguugguuuucuuccuggacuuucaaaguugggaauuguaauugucuauuccagggguuggcaggugggccagacagcaaguauuuucugcuuugggggccagaugguuuuggcugcagcuuuucaauucugcccuuguagcauggaagccaccacacaauguauguuaauuggcauggcuguguuccauuaauuuuuuuuuuuuuugagacagugucucacucucucgcccaggcuggagugcaguggugugaucuuggcucacugcaaccuccaccuccugaguuaaagcaauucuccugccucagccucccgaguagcugggacuacaggugcccaccaccacacacggcuaauuuuuguauuuuuacuagagaugggguuucgccguguuggccgggcuggucucaaauuccugaccucagguaauccccccgccucggccucccagagugcugggguuacaggcgugagccaccgcgcccagccccauucacguuuuauuaaggauacugaaaguggaauuucauauaauuuucauguguugugaaauauucuccucuggauuuuuuucaacauuuaaaaauguucaaaaccauccuucacaugaaaccugcacgcagguguuuguaaccacuucauucauacgggcgcgguggaagcagucaggauacccuguggugguggguggaugugcgaacgguggcgcuucccugcaagggaauauuguuuauggauaaaaggaaaugagcugucaagccuugagcagauguggaggaugcugaaauguacauugcuacguggaagaagccaaucugggccgggugcgguggcucacaccuguaaucccagcgcuuugggaggccgaggugggugaucacuugagcucaggagaccagccugggcaacauggugaaaccuugucucuacaaaaaaaaaaaaaaaaaauuauaauaauaauacaaaaauuagccgggcaugguggcucacacauguagucccagcuacuuggggggcugaggcaggaggauugcuugagcccagaaugcggagguugcagugagcuuagauugcaccacugcccuccaaccugggucacagagugagacccuaucucaaaaaaaacaaaaaacaccagucugaaaaggcugcaagcugcaugauuccagcucuaggacauucuggaaaaggcaaaauugugaagacaguaaacagaucaacaccugcugggggcucaagaggagaaaaagauaaaugggcagauacuggauuccaaaggcagcgacacuauucuuuuuccuuuucuuuucuugucuuuuuuuuuuuuuuuuuuuuuugagacagaguuuugcucuuugugcccaagcugaagugcaauggcacaaucuuagcucacugcaaccuccaccuccuggguucaagcgauuuuccugccucagccucuugaguagcugggauuccaggcucccgccaccacacccagcuaauuuuuguauuuucaguagagacgggguuucaccacguuggccaggcugaucuugaacuccugaccucaggugaugcacccuccuuggccucccacagugcugggauuacaggcgugagccaccgcgcccggcugcagugacacuauucugugugaggcugcaaugauggacgccugccacugugucucugaaaccccauagacuguacaacaccaagagugaaccuaguagaagcccugaacgucaguuauuacugauaauguaucaauauuggcucaucaguuacagcaaauguaccacgcaaaugcaagacauuaaugguaugggaaaguguguacauugaggggaaacucgcuguacucugcucaguuuuucugugaaccuaaaaucgcucuaaaaaagaaagucuauucauuuaaaaaagucuucguucaugggcuguacagaggcagagggcagccucaauuuggcccucgggccaugguuuguggaucccccgguuuaggcuaacagugcccaauagaaauguaacgugagccaccucugugauuuaaaauuuuccauuagccacguuuaaaaguuuuuauuucgaaguaacuacaggaaguugcaaaaaaaaaaaaaguaccgggaggcccuauacacccuucacccacuuccccccauggugacauccugcauagaagcauaguacacucuccaaaccaggaaauugagguugguacaguccacaggucucacggguauuacaggcacccaucugugcuuguguguuuagaauccugugccacugggauacauguagcuuccggcaacuacuaccacuagcuagacgcagaaccacucccccaccgcaggguuccuccacgcugcccuggcacagggcaaccacuccucuguaagaauuuuacguaacuggaacccugcaugaugucagcuuugagauggacuuuuuuugguucagcaucauccugugaagcucuauccaagcuguccugugugucaagaacuuguuccuuucuacugcugaguagcagcaccccacgguccacgcgcucacggacugauggacaugaaccauggcuucccauucaggggcgacugugaauaaagcuacuaggaacauucaugugugggguuuuguuggaaccuaaguuuucguuucucuaggauaaauucccacaaaugcacuugccgagucauauguggauugauugugugauuaguuuuuuaaaauacguuuuuuaucuaguaaaaauagagacaggguuuuugccauguugcucaggcuggucucgaacuccugggcucaagcaauccucccgccucggccucccaaagugcugggauugcaagcgugagccaccguucccggccuaugugcuuaguuuuuaaagcaauugcuaaacuguugcauagaguggcugggccguuuuacacucccaccagaaauuuacgagugccuuguuucuccacauccucaucaguauuugagguugucacuauuauuuuuuuuaagcauccugauggguguguagugacaucucauugugguuuuaaucagcauuucccuaauggcucgugaugucgaauaucguuuuguguguuuauuugccauccagguaucugauucuuuggcggaagaucucuuugucucuuaagcaucuucuuauaucuuaauaauauauaucgaaaggcuuauggggacaaccuuugguuggaggauuuuggaaaaagucauaauaugauuuauuguggcaaccagaagcgauaauauuguucuagugacagguaacaaccugcuuuuuuauuccuguuaauacaugauuucuuuugugacuguaauaaaacaauguauacaaacgauucacugcaaugaagacagauacccaaagagacaaagagacaucgucuaauccauuuuuuguuuguugacuacugaguuuugagaguugauuauacacucuagaaacuaguccuuugcuagauaugaggauugcaaauauuucucccagucuguaguucuuuuuuucauccucuuaacaggaucuugcacaaagcaaaagacuuuaauguugaugaaguccagguuaugaguugugccuuuuaugaaucauacuuuucaugucaagcucaagaacuccugaccuaguccuagauccugaaaguuuuuuucuuuuuuuuuguuuuugagacagaguuucgcucugucgcccagguuggagugcaggggcgcgaucucggcucacugcaaacuccgccucccagauucacgccauucuccugccucagccucccgaguagcugggacuacaggcgcccaccaccacgcccggcuaauuuuuuguauuuuuaguagagacgggguuucacuguguuagccaggaugaucuugaucuccugaccucgugaucugcccaccucagccucccaaagugcugggauuacaggcgugagccaccgcgcccggccgauccugaagguuuucuccuguuauuuuccuaaaaguuuuacggggucgagguuuauuuauuuauuuauugccuauggaugugcaaugacucccgcgucguuuguugaagaggcugcucuuccuucauugagacgcuuugcucuuuuguccaauaucaguugggcauauuugugugggucuuauagguacaauuuuuuuuuuuugaaacggagucucaguuugucacccaaacuggagugccguggugcgaucucagcucacugcaaccuccgccuccuggguucaagcaauucuccuaccucagccuccggaguagcuggaauuacaggagugccucaccacacucagcuaauuuuuguauuuuuaguagagaugggguuucaccauguuggccaggcuggucuugaacuccugaccucaggugauccgccugccuuggccucccaaugugcugggauuacaggcuaugagccacggugcccggccauagcuacauuuuuacaagucaaaaaacaaaaagaaaacaaacaaaaaggugaaaauuuuuguaaauuacccagcuuguucaaaauaguaucauuccaaugugggaucaguauacacggccgccgaugggaaguguuuuacauucucucuguuuaccaaguccugggaauuucgcguguacuuuacaccuagaccacgucucaagugugaugccacauguggcuuggggucacugccuuggccagcacgagucuacacagauuggcgaccugcuuuuuugaaaaaacauucucggccgggcgcaauggcucacgccuguaaucccagcacuuugggaugccgaggcugguggaucaccugaggucaggaguucaagacaagccuggccaacauggugaaacccugucucuauuaaaaauacaaaaauuagccgggcgugguggcagacaccuguaaucccagcuacuugggaggcugagacaggagaauugcuugaacccaggaggcagagguugcagugagcugugaucacgccauugcacuccagccugggggacaagagugagacuucgucucaauaaaaaaauaaacaaaacaaaacaaaacaaaauauucucuggccagcccuucuucauggacucccucuuccuuuguccuugaugguugggcagccucuaggaggaggggguuucauugccucuugucggggguucacagcccuggcacccccccggcccugagcugggauucuagaagucaccagccagguaugucccccaagggagcuggauucuaaagagaugggggcggagccagugcaucuggugggccgucuuaaaccaugcuguuauugacugucuuccgaaggacugacagcucuuuaaaaagcugaccuuucuaguaaaacugucaggacagggaggaaauaagugccucaaaccuccugaaccaaaaagaaggaaguucaggcuccuggagaggcagugcuccccagggaugggcgcucccugcaucaggagggcuguccaaggucagggaaaugaaacuugucagccuuuuccaccgcagcucagaaaccauugacagcugcuccgggaggccuugacgcaaccccggccggugguugcaugggggcugggggcuccuggugcucucgaggggcugagcugcucugaauacacagagcugcccuugggaggcucccgagccccagcucuugcaucaacagcccuggcaggggccucacaggccacgugagcuucugagagcucugagcaugaggucacgggcucccagaggcagugauguggcagcgccugucucccggugaguuggggagcucacaccguaccucuggggaaccacgccuggcuguugcaauguaacccagcaccugaugaaaucuucccugaaaguugcagguagugggggcaaaggaccuuuugucuugcggucgaaagacucccguagcugguucuguuuggcuucauauccuucccagcagaguaaacagaaagggcauuuucacguggcucuuccuuccagucugaacaauguucccuaaacaccugcaaggcagaggacacagggcuccuggugcccguccaccuaagugccuccuggccucagggaaucugcuuuggggaccugaaaguaagguucccugaccaucaagaacagacagacacucagccacacuucuggaaaccuccgcccuuugaaagggacuggcugguggaagcaggcggccuggggcauaucccugaccuuauuacccccagguggugacagagaugaucuuuaagugugggagccuggagccaaguccuuggccacaucccagcucugccuggcugugugcugguggguuauuacccucauugccucaguuuccccucugcacaauggggcuggcgcuagugcuccccaccccauagacugucaugagaaguagcaucuggacaggcccugagagcagugcccaucucugugccauccgcugggacugguguuggccugguacuguaccgucucacccuuguguccccaggaggggaguggggucgagaccagccccagggguuacauggacaaugggguuacauggacaaaugccucuuguuacauuuuguucacugguucccaaaaugaggugcaggcucugcagagaaagcaggcuuuccccgaggggcucuggagcagaaagagcugucucaagguaggugcuggggcuggggugaugugagagcagaguuggaagugggaauguucuggaaggagggagagggcuaguggcagauauguggucaccggaggaggagcccugcgauauauaucaggcagggacagggagaggagaggcgaccugggaccccgaaaaccggguggguggucgcuguggccucuccugggagccucggacuggcgguuagggcagacuccaguagauuguaaaggcaucaggaucugucuugcuucuguaaauauuuaaacacugggaggauuauuuuugguagcuacggucucucuccgagccuggcgggcugccgggacgggugucaagugacaucgggugcaaggauaccccacccccuggccccaccggccccaggcuccguguguucaccuuuccaacggccacaguuugaugugggucacgguuuccccuucuaggagacgcagagagauggucucgggcgcgaccagcagggauuccucguccacacaguuuccugacagcgguugaaagggacgggucuacgcaggccaagaacagcagcggaguguggggucaggggcccagcggggggcaccccggggaggggccgccuccgccagacccaccccgggugaaaggacgcauugugugcccgcagcaugaggggagccugcagagaggcgucuuuguaggguccacgagggggaaagcgcuucccggcaggcggagcacacaagccagccgguggccacggccgggacaggcuuguacgcaggacauugagguccggcgaggaugggggggccaccaggcccccggcccuuugcagaguguugcucguuuucucccaccccagaauugggcuuggccaacacggcccccccaaccauccccccacccccgccagcugcccggagccucugugaagauggcggcaccgccccuugcaaacuccaucugcguggagguggcacuccugcuccgggagggaucccggugcccagcagauggcaggcuuccccuagaucagcccagggcuggccgcugccugcggugcacgcccccgcccucccccuccccgccccgccccgccccacccccaccugccuguggcuggagggcagcacugccugcgcgccuccccaccugaccucccucuugccucccugccuccuuccaagcagauuuuggugaauccuaaaucacguggauauuaacucgcaagugccugcaagcaguucugagggccgggcuggggugcacacucacuugggccaggucccccuggucagggucagccagacgccacuccugcauccuguccacucuuagcagccuucugccuucccugcugacuuuccgccucuucucugggugucugguggguggagagguggagagccuccagcacaaccucaccccaccccaccucgcgucagccucagccuccccugagacuacacggaacccagacacguuugaccucuggccccaaagcagagaugccuggcugaugggaugggugggaggccugacacagccagaugcagccugcuuugugucauuccugcucucccggcguggacgcagggaccgcccccgggacagcccagcugggucuccaggguggcuuugucuggaauuuacuuugugaaccucuugcuugucaaaauuauuucauagaugauucaugguuauauagaagugucagaaauaaagagaaggagcucagauacaugaccaccccugcccauagcagcaccguccacaguagcccauggugaaagcguccaaguucccccgacgggugacuagagaaacgcgguguguucacacacauguuccacacacacccagcggaacguucagccuugggaaggcaauucugacacgcgccgcaacacggaugaguugaggacguuacgccgagugaaaugagccagacauaaggggccaaaucugugugauuccacuugugugcgaccccuggaguugucaggcucagagagggaaagauuggggugccaggggcugagggaggggacguuggggagcugguguuucauggagacaaagcuucaguuugggaagaaggagaguucuggagauggguggugucaugguugcacaaaaauaggaaugguauaaugccacugggcucgacguugaaaacgguuaagguggugaauuuuauguuauggacauuuuaccacaauaaacagagagaaggaaaaaucaguuaagaccuuuuaaggugacugggacugugagacuggugcacguuuucccauccuuuugagaacugccuucuuggauuaggucuguaagccuguguagguuguccccaccccagcaauuggucgugaacuucaagcauugggaaaucacgugggagguggcugcccaggcucaccucugcccgggcugcaacaggaggcucucauggggcaggugcugcgcuguggccagagugcuggccgggggcgugggcucccaccaccuggagccggccccucgcuggcugggcgcccgagacccgucaccgcacacgccuugugagggcuacggcugcuguccacgcggcuaguucaggcugaguugaagccuccguccgagcagcugaaagucaaaucuagucguuagacucugaaagcugguucaugucagagaccugacauggagugugggaaaaccuugacggaagcuuccagagccuggcaagauuagaucaggaaguaacacuuuaccuagugagcuuagaaaaauagacucucccuguugucuucugggaacugggaaaucugagcgcagguuucugggcauggaugcugcacacaggccugccccugggggugggcagcaacaccccagccaccccaggaggguggggaccccucggcugacuuuugggaauccagagggggucauuacagaagggcuggcgcuagaguggccaugaggguacagugggucccucuccgcaccccuugaccccagucaucuuuucaauaccguucucuggugggacuugcgagggccgaugcugaggcugcucugcuugugcagagaggacauucguguauuugaggauguucguguauuugaacaaagguuguagugucuuggccucucggccuuuggcauugccagguaucugggcagaaccagcuagagcugcuggagaauacaugagcaguaucuagaacaauuccgaacuccacaaggccaguuugccaugccagacuguugggaagaggcaacgacaacucguauuuaugacucuguccauggcaggcaaagcgaaccguggcuuuucauccuggaaauaccccagcacaguguuuuugugggagccuguuacucaaagcaggcacagaguggaaaagggcccgaucaaggccacagugugggagcugucagagcagggcaggcccgaggcccagggcucugcugaaccaaccaccagugagaggggcuuugaugcguccagugauaaaacccgucgggcagguccugggagggauucuggcuuuggggacuuugcugugcuuaagucaugggcaaaaguuccugcgcuggccaauuuuguuuucaucgaauguggggaucccuguucagggggcacacggugcugcauuugagggucuugagugguccuccacauuugggguguccuuugggccauguggagcccugagaaggauugacagguguuugggaguuuguguuuguaucuuggacgauggaggaguuucccuaaucaugguguuuuuucaaguuaagaaacuuccuuuggagaagccguuuucucuuuuacugaugaaaggcuucuucucggcaggaggacugaaggugcuggguccugagggagggccuggggccggcgggcaggugcggguuggggaggguggcaccguccagcccagcagagcccagaagacgggaccaggcugaggacuuccacggggcuggccgggcuacacagcaccaugcuuagcgggauuggacuuugauuuucuguggcucuaacugauaaaacaagcaggggccuucuaaguuuugcuuugagguugacugccaauuaaagagccaacaucuggugcauaggacccuccagaaaaagucuuuuugcccuuaauguuaauuuuuuccccuuuguuggaguugauuuguuaaguugcugguguguguugacaacuguuugguacagaacgcaggcacgugcguucaccaggacccuggcuugccgagcgggagguggucgacuguggacucugggcgcguuugacuuucagccauggucuuaugauugggcagcuuccguccgguugcugcccccucugccccuugggcauacgcccaguggagcuuggaccugacucauagcucucuacagucgacaaaaggaaaauguuucaguuuggguaaaucagccacagcuggagccagggagaggcccaugggcuggugacuuuucaggguggugguguuuguucagcguguuguuuugcucugugacuuuggagagugcaucaaaggcucggcggacgcccacuugccgaggagccacggcccuggcugguggccaggcaagcaccucccagguaggcgucaggggaagcauccaaacuaguaaauaaaacggcuucuggcaggacgugcuaucaucccccucucccuucuaaacacacacacgcuuucacagagaagaacuuagaaguauuucguuugaaucagaaggaaauauugaauaucgucucauucucccccaccuaauuuuuuuuuuaaaccacauucagaauugcugggcaaccucauuuccccacauuuaggauucuucccucgaaaucucaugcaggcguaaaauccgagagccucggaggguuuuucugagccucugcaucucccagcaccccgcccccacccagcacucauguguuugucugcuuuaaaagcuucaggaugggaaauuccucaccagcccguaagccgcuguuuguaggagccccuaaacucuguggaacccaaaucucccaguacugacuuaauucccuuuucccugagaaccagcucccugcagcacccaggguucugcccgcagagggaggcuguggcugggaguggaaaaugcccagccaggggcuaccuucauggggacauucccuacccccauccccaccuucauucggaaagagucaugacuccuggucaccaggcaaacuucuguaccugcuuauucugguuuaaaaauaggucaggcaugaugacucaugccuguaauccuagcacuuugggaggccgaggcaggaggagcgcuugagcccaggaguucaagaucagccuggacaacauagcgagaccccaucucuauaaaaaauaaaaaauuuagcugggcgugauggcgugcaccuguggucccagcuacucgggaggcugaagugggaggaucgcuugagcccaagagguggaagcggagguugcagugagcugugaugucaccacagcacuccagccugggugacagagcaagacccagucugaaaaaaaaguaaaaaaaaaauuccuuaaagaaaugcuuauuccccgcucccacccagaccgagacgcucuggaacaauuuucuccagugcuugaguuugggaugagggccuggaaagaccauccagucuccugccccuggugggcagccaguucugccuugggcagcgacacugggcacagcccgugacccauccuggcccugaucucuucuggcucucaagggagguucuguggccccaccucaaaauucagggucccucuguggaaacaaaacauaucccagauggauuugcuacaaggccaucccgggaagggagccaaguaaacacagcagcagagaccggagggcgcgaggggacggcugaccgcaguccagcuccucccaugcaucacgcccucccaccggcccggccucaggcuucucguucacccccaucuucccguggaccugaucggaggugucaucucccgcugcgggcugaggcucugaggagggccggguguguagagccuuccuuggaagggaaaacccaaccaggauguugguuuccgagaggaagcccguucacccaccaugguggcucugcccuuuaauaagaggcaaagaacucgggugcugcggguacuggucacucugucagggcagacauaccccuugccguucauccuucaaaggccaggcuucggcagggggcggcacguguggucucucuuuggccuuuucugguggaagguccugggguagggaguccucacgugguugcucugcagggaggggcccuccaaaaauaaucccggggccucuuacccaccacugcaacgcugacgauacugcacugaggaauccacucuugagcuuugcuuugaaacgcugcacauuugcgucugcccagacuucugucuaagaggugcucagagaucaccuugcguuuaugaagcgaacguggccuugggauauagaccuggggccccaaguccaagaccagugaauaaagugagagauggcuuugccccaagugggugagguggacccagcacccaugcuugccgccuccugcccucccucccgcacuuugggaccacgaggaaauuggcacugcagugauucaugcagcugcuaaucaaaagcuuuuauuuccugauuaucucuccguuugagggauggcagaugccagugcagucaaaauauaaacagauucuagucaggaccuuucaaagcagacaccagccguucugaagagcggagggccgcgccccuuaugccgccuggcagaagaguuucguugggaaaaaugguuuuucauaaccuuucugcuuucuuauuuaaauuaagcuuugccgggagaguuugguaguagcagagggccccugauuugguccccuuugaccuccacagccuugauuggcaguuuguugugggcauugaaguuguggcugcgaggugggagccagcagaacaaauacucuaggacagcugggcauccccgaggacccagccgaggggggagugugcgcaauuagagaggucuucacacagaaaguuaauuagcuacuaaauggcauuuagcacaguuuaugagaauugcauguuugaaaagcaaauggagaucaaugcggaauggcugccaccggauggggacccuuggacccagcaccagucucagggccugggaugccccccaccccgagcgugagugccaggccagugcccgcugagacuggacugggagaugcuccucgaggaccugccuggccuuggggggcaguccugcuucgcacccacagccgagcuucccuguccaaaaaaagugaguaaacacgucuucaguuucggggaacugugucugccguggccuggauagugacucccuuccccgcaaauucauggccacucagaaccucagaaugugacuuuauuuggaaauagggucuuugcugaugggaucaagggaaggauccaguugaggucuuccuggauuaggguggcccuaaauccaacggaugucuuuaaaagacacggacggacacacagacacaggaggggcagggagauggaggcagagaugggagugaugcugcugcaggcuugggggcuuccaggauccaggacgagcaccuccagcuggaagaggcaggaaagacucuugccuggagccuucagagggggcgcggcccgacuagcaccuugacuuugaccuccagaacugccagacaauacauuucuguuguuuucaagcuucuggucugugguccuucauuacagcagcccugggaaaugcugugucaccaccaaaacgcagcccccaaaacauagccccagcuccaucgcagggcuguguccgaagcuggaggaugguggggugggugggggggagccagagggaggccuuaggaccugcuuuuuguuucuguuaugaucugaggucugacuucaguguggucuuuucaccugcuugucuuaguucccuguugauccuauggagggauugcuuggggcuauuuuuguuuuggggagggugguuuuugcucuuuuuaacuguuuuuuuuuuuuuugccuuuacuguuuuccauguuuuggagggcuuuuguuugucuccuuuccuuccuuccuuccuuccuuccuuccuuccuuccuucacucccucccucccucuuuucuuucucuuucuuucuuuuucuuucuuucucucucucucuuucuuucuuuuuaauuauaaaaguagcaccugcuccuaaggaaauucugggagauagggaaaagacaaaagaagggugugaagccccaccauacccagcucaccaccguuaacuuuuugguguauuuccuucagccuuguguuuacuuuuauuuuuuauuuuugcuuccgaugccuaaguuauuuuacagaguuguagacaggcaggcuguauauaaaauucacuuucuugguuuaaaauuuuuuuugauuuuaggccaggcacagugguucacaccuguaaucccagugcuuugggagacugaggugggagcaucacuucaggccugggcaacauugugagaucccaucuuuacaaaaaaguauugaaaaauuggcugggcgugcuggcagaugccuguggucccagcuacuugggaggcugaggcaagaggaugggcuugagucugggaguucaaggucagccugggcaacaaaugagacccccgcccccccaccccgccaucucuguaaaaaauacaaaauaaauagucaggugcuguggugccugccuguagucccagcuacucagggaggcugaggagggaggaucccuuaagccugggagaucaaggcugcaguaagccgagaucauaccccugcacuccagcaugggugacagagcaugacccugucucuaaauaaauuuaaauuuuuuuuaaauuuugucauauuugauacaugccaaagaauauuuguagcauguaaaccaugaaacacaaucauaaaugaaccccgugacccagcgcccccugugucugaacuagagcuuccuaggaggccagugcuccacuccuuccuccccagucuggucguuccgugccccggucuccagaaggaaccaccuuccggaaugccgugggcggcacuuccuugcucuccuaaagcaggcuuugcacacaugugcacuucucaacauucugccuugcuuugagcccuaggaaagcguccccgucuuuguagccgucgguggcucagcuccccgugccugaggugcugcgggugcucacuccaauagggggacacugucuccauggcuguuccccagguuguccacacuccuguugaugaccaugugguuuaguuuggguuuuucucugugaaugaugucaccuugacagcuucugugcacaccuuuggugcagagggacaggagccccuccgaggggccccugggcccugcaaugugcacucaaccuccuaagacacaccgacugcauuuccugggguggggccagcugagagucccugagauuacauggucugucuugccauucucaauucaugcccugccauaaaccccucccgcgcugccacgucuucugaaccgccacuggguuucacgccugcacagcggccuguuggugagggacguagcauuucacuugcccaugccccuuccauggacauggagcuguucccggcuucccgcuuguccuugaugaacacgucugugcuuggagcucugcacacagaggcucgggguggaugcgugugcacacacacagggauuccgcacaaacguggaugacgcagguucaguauuuacguguacacacauaugcaugcacaaagaaguucaaugucauauuauuuauuuuacaaaaaaguggaaugaguaacaucccaauucuugccuacagggaauuuuuuuguuuuguuuugagacagagucuugcucugucgcccaggcuggagugcagugacgugaucucggcucacugcaaucuccgcccccuggguucaagucauucuccugucucagccucccgaguagcugggauuacaggcaccggccguuacacccggcuaauuuuuguauuuuuuuuuuuaguagaugcggaguuuccccauguuggccaggcuggucucaaaguccugaccucaggugauccaccugccucagccucccaaagugcugggauuacaggccugagccaccaccacgccaagccucagggaauguuuaaagagaugcacgguaccuguacacacgugcacacacagguucgguguauugugugcagacgugaacacacaaaaguucaaugugauauuauugacuuuacagaaaaaugaagcugggcacaguggcucaggccuguaaucccccuacuuugggaggcugagguggguggaucacgaggucaggaguucaagaccagccuggccaacauggugaaaccccgucucuaccaaaaauacaaaauuagcugggcuugauggcgggcgcauguaauuccagcuacucaggaggcugaggcaggagaauugcuugaaucugggaggcagagguuguggugagccgagaucgugucacugcacuccagccugggugauagagugagacucggucucaaaaaaaaaaaaagaaaaaaaaaccacacaaagaaaaacgacaauggaaacaacccaagucuuugucuauaaggaauguuuagagaaaacguggaagcggcccucaaaaagaggugcagcuuaucccugcauaccgacagggcuaaggcccuggauauaguaacugaaaaauuccaggcguaacacaauguugacagcacaaucucacuuuugcuuuaauacaugugcaugugugugugugugcgugugugugugcgcacagggaagccccggagggccgcguccugcuguucccuggcgcgcccuuggaggagugggauugagguugggccgaggcugcugcugcagggacggaugugggucugcuucgugcccguggcagguucagcguuaugugcagugagcacguucuugcugagauuacagaagagccgagggagccgcuccgaggguggcgcgucccuugccuccggugugggaggugcuucuuugacuguagcccucccagcuuuggagguuuggccuccccgcuuuggaaaacgaaguguugcugguaggauggcuuaaaaaucauguucaugcgcauuucuuuaucaccgacgaucuugaauaugucucugcgugcuuguucaccuggugucuucuuuugugaagugugugccaaagaaggaagggguuaaacuugucgggggcacccagagcuucccuggcuuccucccuucucuccggaaagcucugaggagguauuagaggauugcuggagguggaggcccgaggccuucucccagcagggcccgggcagauggagggucuaagaacauacccgccgcuggugaacagccauuuugcucuaagaauuuucugucggccagggccccaguccugguuugcgucaaauccucugagccgggccaagcagugcauuggugcggaagaugcuggcuccccugaaacuaggcccaggggaugggaaaagccgaguggagauuaaggagggagcgaggaaacgaugccuaaacaaguucuguccuuccgucacugcugccacgaggggcuagauacagaauucagcuuugcugugacaaguguguggauggaauuuaaaugaauauaaaugaguagccaaggucuuaucaaaggauguuggugauugguaucaugacuguuugcccuuugggguuggggugcuggagaguacccaccaguucccucagggccucccggggcccaggucacgucacaaccccuagccauggucccagcagcucccggucagcucuggcucaacucacaggcuccccuuccagccugcaggaacaguaacggggaccagggcacagauucgggcagucccaggugugccacugaguccgagaagauuuuugggaagcaccagucaguccugcacguuacgucucugcuguuggggugcgcggaggcgguucgagugaacccuggggggcugaaaggcgggaccaagccaugugggaugucacaaagcccagcagcucagaaucuagaagguucuggcuuucuguuccccguuccugccacccacugugucucuucgccagucccuacacugucugcaccacaguguccugguuagggagaggaacagacugggccuggugaucuucaggguccuccagggccugcggguucugugucuuuuucuggacaaacccugguuacaccaccccacaacguagcggcccagacucccacugcauguuccccugggaaccucuucuuagugucuuguuccuccgggaaggaaggaaagcuccggcuuguuaggcggaauuugcugacccuacaugguggucaagaagcccgugccgugaagccaagagagaaggggaauuugggcugcaagccugaaaaagaguucaugaaauuuaaucagaugccuaaggggaacaccuaaauuuagucaaauuauuaucaguauucacuccauuuuuaaauugccuaggggaacgucacggaaaaguugggaagccaccagccuggguggugauuauucuguuucugcagagcagugggaugcgcugggaggcucggaggcccagaugaaccucgcggccacccuccacggcacggugagcugcuccuccaggugcaaggaugggcugcccagagggucuggggaggcaccggugcccacagccguguugggcaggccugagggcuucuuguguuuggccauaauggaugugucugggaccuggaccuuggccuccugcgccccaagcucuggcccgcagagcccaccaccuggaagccagagcccacccauagcaaggccucugucugugaagaccccuccccuccuugcuacuugguuauucucuggccucagucucugcuugguucucuagucagggugagcuuuugguggaugugaagggagaccaggguccuuuccugcuccuagugagaaccgugggauuugcggccugacagguuacauuccuuuccgggcugaugucccagcuguguuugcaggaaacagugaaggucgacgugugccuuuuuauggcaccgaauaaccuggaccugcgacaggaaccgugagcgucuuucuguccccuaaaaguauuuggauacuaauugacuguuugguccugcagagaugacacagggacgucuucacgcccagaugcauuugcagcuaugcgguccucccgccucccgcuucaggccucucccaucuccccuggguuuccacacagugucgcagcuucaccucgagagggccacgugauuggcggcacuggggaugccugagcccuugaucccucugcugggguccagggcgugggugugcaucccuggagcgugugugcucugggcgugggugugcguccccggagcgcgugugcucugggcgugggugugcauccccggagcgugugugcucuaggcgugggugugcguccccggagcgugugugcucuggccuucccugcccagcuccuauggcuccuccuuucccuagguugggcagaaucucccaggugugcugcugauggacaggcugagagcguggagcccacgagggcgcuuugguuuagaaucaucucauugguuugcccacguuaagcuccuauaaaaucuaggggaaaaaaaauaaacauucuuuuuggguucagaaaaaucucuuggcuguuuucuucccaguaauguguauuucaaggacgaagucgagagggaaugaaaacagaacgauuggcucucaaaagccugguucaggagcaacugggaguggucucuagacugcuugagcuauuaauuauuuugcuuuauuuauuagauguacccagcgucccuuugccuccaagcauauuugcaaaugccuuaagggaaaaagaaaaacaaaugauuccugccaucagagucuccagcccuuaaugaauaacaccguguaaucacgcugaauggaaaaagcccaguacggcaucacgugcacguccugagucuaagucgucacagucguaaaugcacgggacccacggaagcucagaaacucguaacagcugugagaucuguucaguggaauuuuucuuaauuucccugggaaauccacaaggucacuccauaugacuaagaaaaaauuaaaacagaaacagcacucaaaggccugguacauucucuccuccuaccugccgcggauuguugcccgcccgccacggcccccaccccgcccccacggcuggcaaaggaacagaagaaaggccgggccugguuaucuuuuccuaaaccgugcugguaaucaaccugaaggaugugccugcccgcuuccucccagugauuuacaccuucccuaauuagccgugauguugcagaucggcagaguuaaucgccggagcggagacccugccuucccaguucccagcagcucuggcucugggagugugccgcccaugccgcgaggagcugcgauucauccccgccccgcuuggcccuguauuuuccggccuugcugcucccagucccucuggcuggaaaagccaggcugucucggugcaugcgggaugucggcgcucccgagcucgaccgugaccauggggcagguucuaggccugggauggcagaauccggccggcugugcgcccaucacuuaacauugccacuuaugucagaaauggcagcuugagccuaauagagccagcuucccgugggccccccucagcauccaggccucugaaaagcuuaggggucccaccccggcagcagaaggcaccgcagucgccgaggcuuuauugcucugccucuucgaacuggcagccgcaucaaucgcccucccgugcacagccggcugggcucugcgagcagacuccagagcugggucuggcugccucuguggucagcgggaagcuggcagaguccagccucucggcuggaugaguccaguaccgccgugugcacaugugugugugaugcuaauuaugccagacgugcuucaguuuugcugggaacaguuagcuuacugugcauuuuagaaacugccaggauuuuagagccuaaugggguuccuagagaucguagcguccagccaacucaucgccgucucacaggugggggaaggaaggugcggagagcucucucuccuccgucacccccauccugcugcgugccaggcccuguggggcaaggguugcagagauggcugagacaucacccuugccugggggaccaagacacaccaguggguugcagaugcugggaaggggccagguggagggaugaggcgucagggaagguggucucugccucguuggagucagagacccggagguggaggcugcugcuccacacggaccccuucccaucccauccccuccucagccuuguaaucugugugaccugcacgucccugugcaccgggccgucucugggauggggcggggcuccaugcaucuucccuucucuucgcuuacugagggugguggaggcaguggggcuucaggaaagcuuuggacguugggcugggguucgccucguuggggaaggcgugaaaugacccaggcaaaguaggauauucugguggacggaucacugaaaaggaugaauucaugggcaacagagaugcuuggguugaaugcuggauuuuauuccucccuuccuccugccagaggcuccugacacuuuuguuuuaagucaccagagcagcucagcaggcagguagaaacugccccaucccguguucccuguagccuucugcagggcaggccucaccugggcugcgugaagcaggagaggaugggaugagaggggcugggauggagcagcagccuccaccucuggggaccgauuccauagagaggaguccuucagaguuuguuucagaugaauggaaaggcacugucaacggaagaggcuucagaaaaaucucaagcuugcuguucccuuuggcuccugccucgggggacuuaaacccuccaggauaaugacguggagaagaccccagggcccaguguaucagggccaguuugcauccagcaucccugcugagucaggagcggcgggggucuugcuguuuggaucucuggacauucaccagaauccccuaagcuggucuuugcacgguguguuucccucacgcuuuugagcucaucuuuguugggaaggaugugggcacaccgcacaugugaccgacgcagucauucguuucaggcguguaaacacacacacgugcacacacaauaccgugacucuagccuuccuccauccucuucucucuaaaacuccucuucccaaauguccagugggcuucuugucugugggccaacauuggaaagcccugcgugagaaaaugccuuaugguuaaaacauaacagaggcuaaagagccauuuucccuugcugcaagagagacagccugggacagugcaggggccggugugagcaaugaccagaccucucugagccucagucucggcaucgacauguaggguaccaacagaggagcagggcucuugcauaagcuuuuagaguaaucacugcccaguauagguugguucuuauuugauuccaucucgcucccagguuugccuagacaaggguuaguaaggccgaggucacagguugaccuggaugugcaccuguucugccuggcggggacaagagagaacuuggcaauggccaagucugacacugcugccuggcguccccaugcccugacuggcuccguugccuggggagccgcagaagcugugagggugcaggaaggucugugcccaucucguggccuggagagccgccugccggagcugcugcugccauccugaagcccagagcucugcccggucucugcacagaccccgucauuccaaaguggggcucaugcucugcaggugugggcagacgcaggcauugccugaauuuguauuguacuaagggcugcugggagcguuagugggcagccagcgacagguuugggcuggcugggggucccgaagcugugcacaguugguugcaaacuggaggaaaaaugauauuugucuuuucacuucaggguggaccuguugugggcgguggcugucuucaugcacgacccccccaguccccaacccucugucacucguugauccuuugaaaucaggagcugggucuccagagggcauugcgguugcucccggucccauucuuuugagcaagcuuuuuguguaacugaucaaggaaucuucacaggggcuuaaagaacaccuggcuggcucucagcagccuuuuaaguaggccauguaggaggcaaggguucccaggaaaccucacagccagcuggggccaagggugugaauaggaccuggcagaaauuccagucggccagagcucaggcuguacaaagcugggcguuccaauccagguagauuacaggagaucggguuuguuuuguucuuccuugaaucccaaagacuagcuuuccugacacggaguucaccaaaugcaaagggaaaaacaaaacaaaaugaaacagaacucgcuguccaaaaauccaaagcccugcuggagggugaggagugacgcggccuggcggauuguuccggguguuuguggccuugcaaguaacguugcgcccacuggcaguggggacggcauggcgaggaggugacggagcagagggcuucuuccuugggccuucuuaccuauagagggcgcaguggcugcggggguggccccaaccccaggucaaaggcaaaaaccgaggccaaaucaggaaucggacagggagguagccacaaagucacucugaaagcaaggcgcccaggcuucucccucuuucaacguuuuugaaccuauuccacaaacuccucagcaucauaagauaaaccugagcgugaacccagccuccuaccagccccaccugugaguuggugcagccuuugcuggguccccaggguuagcuagcccuacugugugggugccacgccugagaagagccugggagagccagggaagauaagggaaugugcuuuaggguggaggaagccaagaaacucuaugguucaccuguuuuuugguuuuuaguugcaauaaaauacauauaguccccccucacugcagcuuugcuuuuugcaguuucaguuacccucggccaaccauaauccaaaaguauuaaauggggcugggcacaguggcucacaccuguaauuccagcacuuggggaggccaaggcagguggaucaccugaggucaggaguucgagaccagccugggcagcauggggaaacccugucucucuaaaaauacaaaaauuagccaggcguggugguguaugucuguaaucccagcuacuugggaggcugaggcaggagaaucgcuugaacccgggaggcggaaguugcagugaaccgagauugcaccacugcacuccagccugggcaacagaugagacuccgucucaaaaaagagaaaaaaaaaauuaaauggaaaauuccagaaauaaacaauucaugagcuuuaaauugcaugccauucugguagaguaaugaagucuccuacccucccccuccaucccgccagcugucugggugaucagaucggcugcccuaggaucucagugcuuguguucaagucaccuuuauuugacugaauaauggccccacagcaccagagcagugaugcugacaauuuggauaugccaaagagaagccauaaagcgcuuccuuuuagcgagaaggcggaaguucucaacugaauaaggaaagaacagaauucugugcugagguugcuacgaccucugguaagaaugaacuuuuauuacaguauauuguuuugggggaggguuuugguuuuguuuuuguuugagacagggucuugcucuguugcccaggguggagugcaguagugugaucauggcucacuguagccucccaaguagcugggaugauggcaugcaccaccaugccuggauaauuuuuuguuguaauuuuuuuuucuuuuuuuuuuuugagacagagucucgcucugucgccugggcuggagugcaguggcgugaucuuggcucacugcaagcuccgccucugggguucaugccauucuucugccucagccuccugaguagcugggacuacaggcgcccgccgccacaccuggcuauuuuuuuuguauuuuuaguagaaacgggguuucaccauguuagacaggauggucuugaucuccugaccuugugauccgcccgccuuggccuuccaaagugcugggauuacaggcguaagccacugcgcccagacuuuguuuuaauuuuuuuuauaaagacggggucuaacuguguuacccaggcugguuuugaacuccugggcucaagugaccuacccgucucagccucccaaagugcugggauuacaggcaugagccaccgcgcccagccacuucuauuuuauuauuauuguuguucaucucuuacugugccuaauuuguagauuaaacuuuaucauagguguguauguauagggaaaacauaguauuuauagguuuuggcacuauccaagguuucaggcaccaacggggguauuggguuguauuccccuuggauaaggagguaccacuauaacauaaaauuuaccauuuuuguguuuugagacgaagucucgcucuguugcccaggcuggaauguagcaggacgaucucggcucacugcaaccucugccucccagguucaagugauucucccgcuucagccuccugagcagcugggauuacagguaggcaccaccaugccuggcuaauuuuuuguauuuuaguagagacgggguuucaucauguuacccaggcuggucccgaacuccuaagcucaggcgauccacuccugccucggccuuccaaaguacuagaauuacaggugugagccaccgcacccagccuuaaucauuuguaagugcacaguugaguggcaguggguauauucacauuguuaugcagccaucaccauacucuccaccuccagaacuuuuucaucuucccaaccgaaacucuguucccguuaaacaacuccccaucuccucucccccaagccccuggcagccucuauucuacuuucugccucugagauugacugcucuggggaccugauaggaguggaaucaugcaggguuugaccuucugugucuggcgucuuucacuuagcguaacgucaggugucauucaugcuguagccugugucagaaucuccuuccuuuuuagcagggcgcaguggcucacaccugcaaucccagcacuuuuuuuuugggaggccaaggcggguggaccacgaggucaggaguucgagaccagcguggccaacauggugaaacccugucucuacuaaaaauacaaaaauuagccaggugugguaguacacgccugugaucccagcuacucaggaggcugaagcaggagaaucgcuugaauccgggaggcggagguugcagugagccaagauugagccacugcacuccagccugggugacaaagcaagacucccucucagggggaagaaaaaaaaagaauuuccuuccuuuuuauagcuaaauaaccugccauugcaugcagggacaacacuuucuuucuccauucacccaucgauggacacugggcugcuucagccucuggccaucaugaaugaugcugcugugaacacgggguacacauaccuguucgagucccugcuuucaguucuuuugagcgacccuuuuuaaaaaucaaugccagggccguuuucagagcacuccgaccuguccuccgcagaccuuccuugucccugcacccacucaggcucuuucuuccccacaaagacccccacagccagcccccaugccaccugcuccgagaggaagccuuccagagcccccaucccuaccccgugggaugcuccugucugacaccucccagcagcucacaguccaagugguguccaaauuauccacauccucagcucaccuccuaugagguccaugucuccuggugggucgggcaccagcuuccucaggucuuccuugagagaaguugacuguuguagagaagagugauugacucuacuuuuaugagucaaguugaagaauacguuaaagacucuucuuuucuaauugccccugagccauuauuccaaaauggugucuaccagcaacaugggaagauaccuucaaguguguguaaaccugcagaacgaacuuuggaagaagagucacucaacugcugaccaggaugaccugggggacagggcuuccagaccaggaugaccugggggacaggcuuccaaugccgauucugcacacuucagucuuuuuaaaauuuuuaaccacaacgugaauuuauuuaccacuugcaaauguuaagcaacuuaaaaaauacugggagugugggccgggugcggugccucacaccuguaaugccagcacuuugggaggccgaaguggguggaucaccugaggccaggaguuugagaccagccuggccaacauggugaaaccccaucucuacuaaaaauacacaaauuagccgggcuugguggugcacgccuguaaucccagcuacucaggaggcugaggcaggagaaugccuugaacccgagagguggagguugcagugagccgagauagcgccacugcacuccagccugggcaauggagacagacuccaucucaaaaaaaaauaaaaaauaaaaauacagggaguguauauuaauguaaaauuauuuacaauaugagaucacuuccauucccacacugggaggaacguaaaacucaacaaugcaagagcaaacugcaucucuguuuccagaggguggcgcuguuuuugcaccgggcugacucuccguuuccaggguggcgcuguuuuugcacugggacucguacaaggacuggugcuuucucugaugugcuuagcuuauuucaggcaugcauuuccccugggcucucugcuagcucuucaccuuucugcaggcuucacugaggacccccagguccaccucucuagaguggccgugcccagccccuccaccucccacccugugcucauucccuuagagcaccccaugacccguuuaccguuugcugccugacuucccaccacaaugaagcucuacacagguggcaaccuugucucguugucugcagguugagagggugggggacacccagaacuuuuuauugcagaacaaauauuuucugaggccaugcuuuguacaagacccuuuggugggagauguacaagauaaaucagacgggagagagcgggugcauagugaccuuuuauucacauagcauaaaagucacccuuuuaaaguguacaaugcaguggcaguuaguacauucaugaagcuguguaaucacaaccugauuccagaacauuuucauccccccaaaaagaaaccucauacucuagcagucacagcccagcccuuccuuccccagcccuggcagccacuaaccugcugucugucucuauggauuuaccuauucuggauauuucauauaaaugaaaucauagaacacguggccuuuugugacuggcuucuuucgcuuagcaucguguuuucaggauucauccguguuguaacaggccgguacuucauuccuauuuauagcugaacaguauuccauuguauggaugccacgauuuccuuaucuggucaucaguugaugggcauuuuucucuuuuuggauaugaugaauaaugcuacuaugaacauguguguacauguuuuuauauagacaucuauuuucuuuucuuuucuuuucuuugagauggagucucguucuguugccuaggcugcagugcaauggcgugaucucggcucacugcaaccuccgccucccggguucaagcgauucuccugccucggccucccaaguagcugggauuacaggcaugcaccaccacaccuggcuaauuuuuguauuuuuaguagagaugggguuucaccauauugggcaggcuggucucgaacuccugaccucaagugauccaccugccuuggccucccaaagugcugggauuacaggcaugagccaccgugcccggcccuauuuucuauuaucuaggauaucuaccuacgaguggaauuacuuggucaaauguuaacacuguguuuaauuuuugaggaccuaccaaacuguuuuccacaauuggcugcuccauuuuauauucccaucaccauggaaugaggguuccgauuucucuaggaccuccucaccaacacuuauuauuucccauuuuuuuauuauagccaucccaguggguguggagugguaucucaacguuguuuuugacuuguauuucuuuuuguuuguuuguuuugagauggagucucacucuguugcccaggcaguagugcaguggugcaguguuggcucacugcaaccuccacuuccuagguucaagcgauucuccugccucagccucccgaguagcugggauuauaggugugcaccaccacacccggcuaauuuuuguauuuuuagagagaugggguuucaccauguuggccaggcuggucucgaacuccugaccucaggugaccugcccaccuuggccucccaaaguacugggauuacaggcgugagccaccacgcucggccuugauuugcauuucuccagggaauaaugauguggagaauuuuucaugugcuuauuggccauuuauaucuucauuggagauaugucuauuuaaauuauuugcccauuuuuaaauugagucauuugucuuuuuauucuuacaucuuaaguguuuuuaaaaaauauuuggguacuagucccuugucagauauaugauuugcaacuauuuuccucccauucuaugaguuguauuuucacucuuuuuuuuuuuuuuuuuuuuuuuuugagacggcaucuggcucuguggagugcaguggugcgaucucagcucacugcaagcuccaccucccagguuccugccauucuccugccucagccucccgauuagcugggacuacaggcgcccgccacaaugcccggcuaauuuuuuguauuuuuaguagagacaagauuucacuauguuagccaggauggucuuaaucuccugaccucgugauccaccugccucggccucccaaagugcugggauuacaggcgugagccaccgugcccggccucacucucuugauaguguugaguuuuaaauuuuuaugaaaucagauuuaucuauuuuuuucuuugguugauugucuuuuuggugucauaucaaaguaucuauguuuucuucuaagagauuuauaguucuagcucuuacacuuaagucuuugauccauuuuaaguuaauuguuguagacagugugagguuauggucugacuucauucuuuguauguggcuauccaguugucucugugccauuugcugaaaagacuauucuuucacccgguugggugcagcggcucaugccucgaaucccagcaugccuauaaucccuuugggaggcugaagcaggcagaucacuugagcucaggaguuugagaccagccuggccaacauggugaaauccugucucuaccaaaaaauacaaaaauuaacuggguaugguggcgcacgccuguaaucccagcuacucagguggcugaggcaugaggaucccuugaacucaggaggcggagguugcagugagccgagaucucgccacugcacuguagccugagugacagagugagacccugucucaaaaaaauuuuuuaaagauuauucuuuuaucaauugaauuguuuuaccaagcuuguuggaaacaauugaccauaaacuuguggauuuauuucuggacucucaauucuauuccauugaucaauaugucuauccuuaugccauuaucacaccauauugauuaccguagcuuuguaguuaaguuuugaaauuaggaagugugaguccuaauuuuucaauguuguuuuggcuauucuggguccucuguauuuccguaugaauuuuagggucaaccugucaauaucugcaaaaacgguagcugggauuuugauaggaacuguguugaaucuguguaucaauuuggagaguauugccaucauaacaauauuaagucuuccaauccaugaacgugggaugccuuucugauuauuuaggucuuuaauuuguuucaacuuuuauagucuuaaguacacaagucuuguacuuguguguguacguguauugugaagagaauuguuuuauuaauuuuauuuuugugucguucauugccaguguauagaaauacaauuaauuuuuagacauugaucuuauauaaugcaaacuuacugacuucauuuauugguuucaguggguuuucuguguguguauguguguagauuccuaaugauauucuauaugcuagaucaugucaucuguuaauagagauaguuuuacuccuuuuuuuccaaucuucuuccuuuuccuuuuuaaaauuuuauuucuuuuaaagauuuuauuuuuaaaaucuuuuugcauuuuauuucuuuaucuugccuaauuucccagguagaccuuccagcacaagguugacuagaaguggugagagugaauaucuuugucuugucccaguuauaugggggaaaacuuuuagucuuucacacuuaaauuugugggguuuuuuuuauaguuguugguuuuucauagauaacauuuauuagauugaggaaguuccuuuccguuuuuaguuuagugaauguuuuuauuuugaaaugcuguuggauuugucaaauguuuuucugcaucuguugagaugaucuuguguuuccugucuuuucuuuuacuaaucuagugucuuacauccaucuauuuucauauguugaaccagucaugcauuccugagauaaaccgcacuuggucaugguguacaacucuucuuauauguuguuggguucagcuugcuaguauuuuguugaagauuuuugggucuauucaaauggaucuaaaguuuuauauucuuguaaugucuucgucugguuuuuguaucaacaaaugacuuuuauacaaagucaaaagcaaaacacaugaaaaaaaagacugauaaguuucuaaggauuuuccaagggauaaagggaaauuagcauauguuggaccugcuguauguuucagacacuuugcuuaguggcuucccuggggauugaagggaagcaaccuggaggaaguaguguuugagcggggccuuggagagugggaagaauuagaagagagagagaggcagagcaggccgaccagagagagggacccacauaagcaaauccuggggagaggagguccugggguauggaaaggaagugagcugucauguuugccugugaucuagugggggcaugguaagggguauacuggauugaagaguguucccucaaauucauguccaccuggaaccucagauugcaaucuuacuuggaaauagggucuuugcaauuaguuaagaugaggccauucuggauuaggguggucucuaauccagugagugguguccuucuaaguagagaaaacagagacacaguagacccauauacagagggaagaaggccacgugaugauggagcagagacuggagugauacagcugcaagccacggaaggccacagauugccaggaacugcccgaagcuggggggacucaaaggaggagucuccuagacuuucagagggaguguggccugcuggcaccuuggcuucaggcuucugucauccagaagugugagagagcacauucguguugcuuuaagccaugcagcugugguguuuccugcagcagcccuaggaaacucaugccagggaaaacaaggaaagaggcgaccaggccaauguguggggcgggcucagugcccaucuauggaugggagcuugacuggcagacaaagcugacuguugauaguuucugagccaggagcaggggugaaggggagaaguggacacaguuucagaggcauucuuucauagauguuguuuuuagaguguugucuucuuuuccaguugaugugacugcugucucuggaaggcauaugccaaaagagucaggaaugugagcuucccauaggucacgccuagcuguccauccugcccugcugugggccauucugaaacccggggacaugauuccuggccucggucuccuuagcuauaaaauggagugcugucucacccacaagguuuauguaaggaagucuucaaagcaauuaggagagcuccuggcacacaggaagcuccaauaaaugguagccaugacgauaauugguuauuuugccucaccuuuuucuuuucuaaauuauuauuuuuuuguuuuauaauauuaaaagaaacacaggcuucuuuuuuuaaaaauuaguacaggccaggcgcgguggcucacaccuguaaucccagcacuuugggaggccgaggcaggcggaucauuugaggucaggaguuaaagaccagccuggccaacauggugaaacccugucucuacuaaaaauucaaaaaaauuagccgggcgugguggcacaugucuguaaucccagcuacuugggaggcugaggcaggagaaucgcuugaaccugggaggcggaggcugcagugagccaccaagaucacgccacuguacucuagccugggcgacagagcaagacuccgccucaaaaaaaaauuaauacagaaaauuagcuuauuauuucugauuaucagaaugauacauuaugccuuuuagaaaauucuuuuaaugcggugaaaguauauuauagacaugccaucuagauaugaucacauuauaguuuuaguauuauuuucuacuucuacacuugcauagguauaaaauaccugucaauauauauuauauauaaaacaguauugauaguauauuuuuauauaguuuugcaaccuacuuuccucauucagcauaacagugugaggauuucucuggucaucacauacuuuuauuaaauauuuuauaagugcuuaauggcguuguaucauaugaaugugccacaauauauucaaauauucuccuaugguugaaaauuuagcaauaguacugagaguugaauauuggugguauuuuuuacaaguuuauugaaguauaacuguacaaucaacugcacguguuuaaagugcacaauuugaucaguuuggacauaauauacacucauggagccgucaucacaaucaagauaaugaacagauccaucacccccagaaguuucuucguguccccccaaugucuuaucugcaauuuggcaaugauuucuuggcuaugacaccaauagcacaggcaauaaaaaaaauaaacuggaccucaugaaaaauuuaaaaaugugcgcaucaaaauauacuaucagcagaguauaaagaucacucacagaaugcgggaaaauauuugcagaucauguauguuuaauaaggaauaauuguccaggauuuauagagaacuccuaaaacucaacaacaacaaaaaacaacuggccggauaugguggcucacgccuguaacccagcacuuugggaggcugaggcaggcgaaaucaccugaggucaggaguucgagaucagccuggccaacauggugaaaccccgucucuaccaaaaauacaaaaauuagcugggcgugguggugcaugucuguaaucccagcuacuugggaggcugaggcaggagaauagcuugaaccuggaaaacagagguugcugucagccaagaucaugccacuguacuccagccuggacgacagagcaagacucugucuccaaaacaaacaaacagacacacacaaaaaacaaccaaacaaccaaacaaacaaaaacaaaccccaaacaacccaauucaaaaauggucaaaggauuugaaaagacgugucuccaaagaagagacacgaaugcccgauaagcacaugaagguacucaauaucauuaaucaucggggaaaugcaaaaucaaaacuccaaugaaauacgaccucccacccauaaggauggcuacuaucaaaaaauaaaaacuaacaagugucggugaggauguggagggauugaaaucccuaugcauugcuggcgggaauguaaggugguacagcugcuguggaaaacaguauggcaguuccucaaaaaauuaaaaauagaaugaccauaucauccagcaauuccauuucuggguauauacccaaaagaauugaaagcagagacacagagauaucuggacaccauggcuucacagcauuauucacauaagaacauagagcaacccgucaauugguggaugaaaagauaaacaaaacgcgguccauccguacaauggaauauuauucagccauaaaagggaaggaaauucugacccacgcuacggcauggaugaaccuggaggacauugugcuaagugacauaagccagucacaaaaagacaauacuguauaauuucacugagauuaggugcuaggaguagucagauucauugagacagacaguugauguugcuuggagugugaggggggaaugggaaguuaucgggcuuuuuuuuuugcuuuuuuuuuuugagauggagucccacucugucacccaggcggcagugcaguggcacaaucucggcugacagcaaccuccaacuccuggguucaagcacuucuccugccucagucucccccaaguagcugggauuauaggcgcccaccaccacaccuggcuaauuuuuuuuuuuuuuugagauggaguuuugcucuuguugcccaggcuggagugcaauggcgcgaucucggcucacugcaaccucugccuccuggauucaagcgauucuccugucucagcugggauuacaggcucaugccaccacaccuggcuaauuucuguauuuuuaguagagaugggguuucaucauauuggucaggcuggucucgaacuccugaccucaggugauccgcccaccucggccucccaaagugcugggguuacaggcaugagccaccauuaauuuuuguauuuuuaguagagaugggauuucaucauguuggucaggcuggucacaaacuccugaccucaagugaccugcccaccucagccucccaaagugcuggaauuacaggcaugagccaccgcgccuggccuggaagcuauuguuuaauagguauagagcuuuuguuuuacaagaugaaaagaguucuggaaauggaaggugaugaucauuguacaauauuagaaauauauuuaauaccugaacuguacauuuaaaaaugguugagauggggccggguguggugggucacaccuguaaucccagcacuuugggaggcaaggugggcggaucaccugaggucaggaguuugaggccagcuggccaacauggugaaaccccaucucuacuaaaaauacaaaaauuagccaggcgugguggcggguaccuguaaucccagauacuugggaggcugaggcaggagaauugcuugaguccgggagguggagguugcagugagccaagaucuugccacugcacuguagccuggccaacagagugagaugacucugucucaaaaaaaaaaaaaaaaaaaaaaaaaaaauagguugagaugguaaauuugaugauaaguauuuuuuaacacaauaaaauaauuggaaaaaggaaaaaaguugcaucugcuuugcaucacucuagauuuguuugccuuuucuagaauuuuauguaaaugggaucaugcaguaugugcuuguuuuuuguccugcuucuuucaaucagcauaauaauuuugucaugcguccaugcuacugcguguuacagcugaguaguaugccaugguauguacagaccacgauucauuacugcauuggcuguugauaaacccuggguuguuuucaguucuuaucuauuuuauuuuauuauuuuuauuuuuauuuuuuugagauggaguuuugcucuucuugccuaggcuggagcgcagucucgugaucuuggcucacugcaaccucugccuccaggguucaagcaagucuccugccugagccucccgaguagcugggauuauaggcgcccgccaccacgucuggcugauuuuuuguauuuuugguagauacaguguuucaccauguuggucacacuggucucaaacuccugaccucaggugauccaccagccucggccucccaaagugcugggauuauaggcgugagccacugugccuggccaguucuuagcuauuuuagauaaagcuguuacacacauuuaugugcaagucuuugcacguggacauauguuuuuauuucucuugguaaauacuugggaauggaauaacuggaaacaggcauguguuuaauuuuuaagaaauuacugaacugcuuuccuaaagugguuugccguguugcauucccaccagcaguccgugagaguuccaguuccuccauguccucagcaacacuugcuaugaucagucuuguccacuguagccauucuaauaggugaguaggaguaucucauugugguuuuaauuugcauuuuccugacuacagaggaugcugaguaucuucucauguagccuuuugugucuggcuucuuucacuuaacauaauacaacugagaugcuuccauaucgucaugcauaucagcaguuugcuccuuuuuauugcugaggcguauguauucccuuguuaagauguaccauuguuuguuuagccauucaccagcugaaagacguuugugucauuuccuguuuucugcaaugaugaauaaaacugcuauaaacauucacacacagauuucgugugaacauuuuccauguauuuuggguaaauaccuagggggcauugcugagucauaugguaggggugugugugacuuuauaagacacugccaaacaguucuccagagugguucugucauuugacuucccgucacauuguaggagaguucuguugcucgccuccuggccagcacucacagugucaguuucauuccuucguuuuuuuuuuuuuuuuuuuuuuuuuuuuuuggguuuuuguuuuuuggguuuuuuugagacagagucucacucugucgcucgggcugaagugcaguggcaugauguuggcucacugcaaccucgccuccaggguucaagugauucuccugccucagccucuggaguagcugggauaacagaggugcacugcgaugccuacuaauuuuuuguauuuuuagcagaaacgggauuucgccauguugcccaggcuagucuugaacuccugagcucaggugacccacccgccucagcuucccaaaaugcugggauuacaagcuugaacugccuugcucguggccucauucauuuguuuuuuagucauuccaauagauguguaguggaucacaucauguuccuuuagauugcauugagguuucuuucuauuugcauuucucuaauaaugaaugcugucgagcaccuuuucauaggcuucuuggccaucugaauauccucuuuggugaaaugucuuuucaaaucuuuugcccauguuuggauuguguuuucuuauuacuguuuugaggaccuuuucuauauucuguauagaaugaugauuuaaagcauauuacugacuuauaugauaagcccuuuaucauauaagcauuuggcaaauaucuuuuucccagucuguggcuuaucuuuuuauuuucuuaacaauaucucuuaaagaguagaagguuuucauuuuaaugaagauuaauuuuuuuuuucacuuauggucauauguuggugucuggucuaagaaaccuuuguguaacaauaguauuucauuuuaacaguuucuuauacauacucuggauacaaguuuuuuguugacuauauguuuugugaauauuuucucccagucugugacuugcauuuuuguuuccuuuaauggaguauuuugaugaaaaaaaaaagucuuuaauuuuccaauuuauuauuucuuuuacaguuuguauuuuuuguguucuaucuaagaaaccugggccuauucuaagguuacacagguuuucucuuacggauucuucuggaaguuuccuaguuaagguuucacaucuagguccgugauccguuuugaguuaauuugggggagugaugggagaaaagaguugauguuaauuuuuuucaugcagauauccuguugauccaguaucguuuauugaaaagccauccuuucuccacugaauugucuuugcacuuuuguaaauaaucaauugauauuuuuggacucuguuauguuccauugauuauuugccuauuucaccauaguuaucuuuucaccaauaccaaacuuucuugaugauagcuauguaggucucaaagucagaugcauccuccaacuuuguucuucuuuuuuauagucgcucugguuauacuagcuccaaauuuuagggucaacuuaucaauuuucacuaaaaauuccuguuggaauuuugauugggcuuguguugaaucuguagaucaguuuggcaagauugucaucuuaaccaaguugacgguuuuauucuauggacauggugcauuucugcauuucuuaagauccuauuugacuuaucucagcaauuuuuguguuuuucaguaugacguucuugaaugucuuuugucaggcuuauuccgaaguauuuuauguggggauuuuuuugcuacuauaaauuuaauguuuuauuuauuucauguuccaauugugcauuguuacuguuuaagaauacaauuaauuuuucucuauuaaccuuuuauccugcaguuuuaugaaauccaguuauuaguucuaaagauuguuuuauaaauuccaugagguuuuucagaugaacaguuguaucaacugaaaauaggggcaguucuguuccuucuuuuccagucuuuaugccuuuuauuuccuuuucuugccugaugcagaggccagggccucugugagagcauggacuagaaguggugggagcagaggcauucuuaccuuguuccugcucuugggggaaaacaauuccaucuuuuaccauucaguaugacgcuaacgguggaauaucugugggugccuuuaucagcuugaggagcuucucuuccauuccuaguuuguagacagguuugucauaaaugagcauuggauuuuugucgaaugcuuuucugcaucugugcauguaugccuuuauugugggcaccucuggcuauguccuuaggauucauuccuaggaauggaagugaaaagucaaaauguauaaacauuuuuaagccuuuggcaucuuguuuccaaauugccauucagaaauauuuggucagggcugggcgcgguggcucacgccugugaucccagcacuuugggagacugaggcaggcggaucacgaggucaggaguuccagacgagacuggccaacauggcgaaaccccaucucuacuaaaaauacaaaaauuagccaggcaugguggcaggcgccuguaaucccagcuacucgggaggcugaggcaggagaaucgcuugaacccgggagguggagguugcagugagccgagaucuugccauugcauuucagccugggcaacaagagcaaaaaacuccaucucaaaaaaaaaaaaaaaaaauuggucaguuuauauucuuucucccccugagcugaaugagaaugucuguuuccccaaauccuuuaccacacuagauuuuauaauuuguuaauugaugccaauuucauaaaccauccccccaccauguuaucccguuucuauuuccauuuauuucauuacccugggccuggaaauuuuauucauuauuuguauuuauucucuacuaaauuuuuuuauuuuccuuuugccaguuuucuguugggcauuuauauuuuucuuuuuaauuuacauacuuuuuuacauacuaaagauguuaaucuuuaucauauaugugucccaguuucuuuggcuauucauuuguuuuguugguuuuuuuuuuuuaauagauguuauuuuuugaagcuguuuuaguuucacagcaaaacugagugaaggguacagagaauucucauccacccccucccccaccacacgcacagccucccccaccagagugggacacauguuacgacucaugagcccacacgucauugucacccagagucuauaguuugucggcauucacacucggucuuguacauccuaugggucuggacaaauguauaaagacaccugucaccgugaccacucuggugucaugccggugugucacugcccuaaaaguucuccgugcuucaccuuccuaccuccccgccagcuccuggcaaccacuggucuugucacugucuccaugguuuugccuuuuccagaguguccuagaauuggaaucccacagggugcagccuugucacagugggucccuucacuuaguaaaccccuucguaagacgcacugaaguucccuccguguuguuccacagcucgacagcucauuucuuuuuaaugaugaguaauauauucccuugucuggcugcaccacaguuauuuaaacuuauuuauccauucacuaccaaaggacaucuugguggcuuccagguuuuggcaauuaugggggaccaccaaagggugucauucuuuccagccuccucucccaucacagccuccucucccaacccagcacaccgaacacgcccugcucacuccuccaauaccuacacaucccucccagcauacugugucccacccacccuacagggcagggcaagguuuccagaaaccagacagaacacagagacucgcuuuggcagucacggguggagggcccccucccugcugcuguggccacagaagacugguccccuggagggccagugccaguuucuaucuaggcaagaguccuggacccaggagccaccgcacaccucccccagcaacgugccuccaggcagaaguuggcuuaaacccucucacaaccccuuaggggcaaauuauuugcauuaauuaauggauugauucauuaauucaggacacugugcuugggaccuacagcuggguucucaucgacuuuuuucagcaaacuuaaaaggcucaggaugaagaaaagcaagaggaaauuuagcaguuuagguauuuuaaauaaugcuaaaaucuggcccugguaaccuugagaaccacagcucaauauguuugaagguuucuuccuccccuucaagcuuuuucugagagcuggcuuguccugcgugugucagugauccguugcugugaaacaaaccgcccucaaacucagcaacuuaaagcgaccaccgggcccagcgugguggcucacgccuguagucccagcacuuugggaggccaaggcagacagaucgcuugagcucaggaguuugagaccagccugggcaacauggcaaaaccccaucucuauaaaaaauacaaaaauuagccaaaugugguggugagugccuguagucccagcuacuugggagacugaggcuggaggaucgcuugagccccggaggcugaggcugcggugaguuguguuugcaccaccgcacuucagccagggggauagagggagaccuugucuuuaaaaaacaaacaaacaaacaaaaaaccgcuucuuugcucacagaccuuugguuugggcugggcugggacaggcuguugcgcugggcucccuggaguucacucaggucgcugcagccaccaggaggcuugggugggcggagggucuggaacggccuccauugacaggugucggggcucuggugcugacugccaguugcgugucucucucaugagcucucgucugucugucuugccugcacugugccaagaggaagagugaggggcugccuaggccccagaacucaccuaacaccauguuugccacauucuauuggucaaaaaaggcccaccuagauucagggguggagagacaggugcuauccuugauaagaugagcugugaagaauuugaggcccuuuuaaaucucuaucucuguaucugacauggcauaguuuacugugguggagggagaacccaguguuuguguuuguuuuccagugauagugcugacuuuuuuucauuacugcuuuuacauuugggugaucuucagaaaaugauagaaaugaagaacugcuacauuucuuaaaguuuagcgucuucuaguuuuaugugugagaucuuucuaauguaauagcaucuugggaguuaucgccugcaaaacccauccuuuuaguuccaaugcaucacauaauuuuaugaacaagcuaaauuauuugcagcauauaugaauauucuuaaaacuaaauugcuuuacguguguagaaagauaagcaaaaauaaaacacuguacauauuucguuuucccuguaguuuauuuucuuuaaacauuuuuuucugugacuucaaaauucccagacacuuuacauuuucacuucaggcaugaguauuaaaugucuguguguucugcgccaagccagggcugggagcugaagaugaagagacacgaugcaacccccaccccacagcagccggccucgaggggcaccagaccucguccuccaugaccacacagggccugggguaccugccagacguaccccaaugaaagcgaacugaggucuccaucaccuucgcucuaguuugagcuuauggaaccccagcuguaggucccaagcacaguaucuugaauuaaugaaucaauccauuaauuaaugcaaauaauuugccccuaagggguugcgagaggguuuaagccaacuccugccuggaggcacguugcugggggaggugugugguggccccuguguccuggacucuugccugguuugaaaucggcuccggcccuccaggggaccagucuucuguggccacggcagcagggagggggcccuccauccgugacugccaaagcgagucucuguguucugucugguuucuggaaaccuuggccugcccuguagggugagugggccacagugugcugggaggaacaagcagguuugggggauucugcuguugggugugguaagaaggcugggggaggaggcgggaaaggauaccacccucugauggccccacugggugggccgggccagcaggcagcacacggggcagcagcucucacagucacagcagccccgcgguucaaugagcagaugacagaagggggcacccaugggugcgguggggccucagacucgagaccugcccuguguugugagcaacgauucugaagcgcagcucccgcaggguccacuugggaagaugucaggagcccucggucuucugggcccguccgcggcgcagccacggcaguucaggugauggccccacaugcccaucucugaucuaguuuuaccugacucaguuuccuugagagcccaggggccccagcagugggaggaccuguucggcugacuuccuuaggcagguggggaagaaaggccaccugccacucaccaggcccagggcuaugccugacgcaguagagggcucuagaaaggccagucagguuucucugugugaaguucccaguggggagggauugugcuggaacccuccaaaggagcuuuauuuacuuagaccuggugcuucuuggaggaggaagugccucuggauugauugccucuaauaguuuauguucugagcucaaacgggaaggcaggugcggugaaugcggcugagucucuguggggugcugcaguugggguccagagcugagucuugccuguacuccgguuuuauuuuagcagacauuugcuagacauuaaaucucaagagagugucaggcgcgauggcucacgccuguaaucccaacacuuuuggaggcugaggcggguggaucaccugaggucaggaggucaagacuagccuggucaacauggugaaaccucgucucuacuaaauauauagaauuagcuggucauggugguggacgucuguaaucucagcuacucaggaggcugaggcaggagaaucgcuugaacccggaaggcagaaguggcagugagccgagaucgcacacugcacuccagccugggugacagagcgagacuccgucucaaaaaaagaaaaaaaaaagaaaaaagaaaaaaagaaaaaaucucaagagacaagauuuaaccugugagguggcugaauccauauaauaagauauuuugcaauuuggaauguaacaaacucauaaaaaauaacagaauaaaugggguuguacugcugaacugcagacagcugcacaguaugcuggugagaacaugggccacaaagcuuggguucuaaucucagcucuaccacuugccagcugugugaccuugggcaaauuacuuaaccucucugggccccaguugccucuucuuuacaaugggguaauaccacuauucauuucagaggauuuuugugaagauuaauugcaauaaaagcaccugagaagcauuagcucagggccaggcccauagucaguguuuuaauaaaugcugaugauguuauuaauaguacugagaacccaaauguuuccuaaccaaaagcauaaacugaaccaguacuuuucaggaauacagugagcugguuuaaaccacgcggaagccccaugcuaucuaaaaucaucccaaaacaaccaguuuuaguaaagcccagccccacgcuguagggaaacccagccuuguuauucuccugccuucuuuauccaugggaaaacgaaggcugagagaggcuugguggcuuggccaaggucacacagcgaggaaccccagucagugugaccuuggcugucaggacgaugaugacuuacugccucuauugaaguggaauggaauuugaucaugaaaaugcuuucccauccaaguggaaguagaacugugcagugggguucauacauucauuuauucacagguguuuacagggcauauucagccgugccuguauguguguuuaagcuuggugcguagguuuaaaugacucccccaugacccccgucccccucuggguagugugggcagggagaaguguggcgaucaucacauaaccuguuccaccagccccccguccagcuccgacgccggccugcgguucccggacagcaacggccuccugcagaccccacgcugggacgagccgcagcgggugugcgcccuggagcagauuugcggcguguuccgcguggaccugggccacaugcgcucccuccgccuuuucuucagguaggaagcaucucugggcgccuccugggaguuggccuguguguguuuucccuggcagccugggcuuugcagccggugcagugcacggcuuggggacacagggcccuggauggagucuucccaagcgucugcuuuccucccucgcugaucuugugggcagugauuccccacugcagcucccugacaguucucaggcugggugagcuaccgaacucacuccccuaccuucagcgugaugguagccagcgguugcuugcaacucuggcuugggagaagaaaccaaaccagggcagaggguagcagcugccggcggcucugaucgccgggggaugcucuggagcucggccaccugugcgggacgggccgcagcuuuccggauggaggcucccuuccuuucgugaugggugggcgaugccuaguuuccugcagucauuccccacaccagauccuccuccuuauagucagggcugcccagccgcagacaucaccaaugagaggcccgggcuuagaagaagccggcguguccagaagcuggggggguucccagacccagagccacauuccagccuuucaucuaagggcagccggggcugggcugacagcacugacggauguuuacugaguuucccuggaggguucucccagaguuccacccacacgcaacgaaggaggucuguucccaggagguucucuuagcacauggccugccagggcucagaacuggauuccagggcacucagcguugggacccaggucucccggacugcagggaccauguugccgggcagggggugguggggagaaggccacucuggcaggucuccagagaggagcuccagggccccccaggaaggagcaguuuugccaucuucggcaaaggggguggugguuuuuguucgguguaguucuguccccucccgcuagcagccaacuccacugggacucacuguuuccugcuucugagguuggcgacaguggccucugauuauacuuggaaauaaaacccccguguuuacauauucaucgggcuucccucucccccuuccaauggcccuucagcgacgaggccugcaccagcggccagcuggucguugccagccgagagagccaguacaagguuuuccacuuccaccacggcggccuggacaagcugucugacguguuccagcaguggaaauacugcaccgagaugcagcucaaagaccagguagcccagcagacggccccagaaugcccagcgguugacacuccccaccccccacgggccccaucucccuccuggguccugugucugggguccccgggccccgggggcuuacggggugugacccacgguaguuuuuggccgucagagcagcaacuuuggguuugaaaccuuugcccagggcuuucgguaaagucagugcccugcacuugaaaaaucauguuuugacaagacuuccugccauauuuugcucaaucuacguacaaauguaauaagagcucuuuaauuaucuguuuaagguacuguaugugcuuauuagaaauggggccgauuuuaaaauucccuuccuucccgcagagccuccugcuggcuucccuuauuacaguagcauggcuuuuuuucccccuacauugaacaaccuuugauuuuugaauuaaaugucagcugcaguuuugcccuggauucgugacugcucgcggaggcaaucugacaggcuggcucccugcucgcagaacagcgaucccuuuguauguggccaaucacauguaauucauugcaggcccucccggcagagggaaguuaggccgaacgaggcauucauuccguuuuugcggcugggguuggagagaguggggggcggcggcacagugggccggggaggagagagccgcagagggaaaccgauuuuaagaugaagguauuuucauuuuaauugcgccuaauuacacucgccauuuagggguuuguaugcaggggacggcccuugcccuccuuucagaagagagagaggcuuuuauuccugggaaaagcacugcuggccucugaagccgcgcggcugagauccugaccuuugcccaguuuuccucccguccagcaggucgcccccgauaagacaugcaugcaguucuccauccgccgccccaagcugccguccuccgagacgcaccccgaggagagcauguacaagaggcucggcgucuccgccuggcucaaccaccugaaugagcugggccagguggaggaggaguacaagcugcggaaggugagguccggguccgcccagcuggccccgcggagagccggccgggaaccgggaacgagcgagagggaaggagggccggggccuggccgcccgcccgcacccacgggccaccuccucgugagggccccguuuucuugugugaggcucucugugaacacaccgauaaagcaaucaaagcugcugcguugaaaaaaaaaaacaaaacacaacaccucccucgaggguuuggggggauaccgugucagccugcauagaaggguuugcagugaaaugcagcauuuccaaaaccagggauuaggccaugacgugagaacgacacguuaaucugagcgccaccccagggggggcauugacauugaaaugagccggguuuguguccuguaugggaauugaaggccacugcuuuccccuuguaaauaugugcaaauugcagagaucugaaucaaggcgcaccaaaaaccaccaaaacacacaucucuggggauuuggggguucuuugagcugccccauuuuauccccuccccaacuuuugccgcuuccuccaggccauuuucuuuggcgguauugaugugucaauccgcggggaggucuggcccuuccugcugcgcuauuacagccacgaguccacgucggaggagcgggaggcgcugcggcugcagaagcgaaaggaguacucugagauccagcagaaaagguaaccgccggggccagcccggcccaccccgccgagccgcggaggaaaaugucauuugaaaaggcaauuugaggugcaauucagcauugauaauauguuucgugacccauaguuucuuucaaaaaugggucucccaggaacgugagugauagggugggauaagugcagucauuaaaccaagcacucgggccucggagcugcggggcucguuagcucacaugucaagguuuuagaauucucguucaacagacuuaacuaggcgcugacgucccacagcugaaggcuggggcugggagcagggccuggaggggugaaggcauccggagacugugucccacuugggaucugcuaacccgggacugggcucagcucucucuccaggaggcugggacugggugaagccccugggcugugcucagcuccccuccagaacgcugggccagggccaaggccucauuacccacugggcugcaacuugcucuccuuccugggacgcuggagacugugaggcugaguuaauaucaaggagagccuuggauacacgccacccauccgccgcauccggggagggucugcagccggcagcagccgcccagcucccguccagggaacggggguugggaggaaggguggcuuccugcagugugugcgccacacgaugccucugggugccacccgcugaccccggcugggugcucggcuccacacaggcucuccaugacucccgaggagcacagagcguucuggcguaaugugcaguucacuguggacaaagacgugguccggacagaucggaacaaccaguucuuccggggggaagacaaucccaauguggagagcaugagguacucccuccccagccagcuccuuucccaucugcaagucugcaagccucaccugaccgcucugggaaguggaugagcccccagcgaguuucugcaggggcucucuuccagguucauacaucaaagccccagaagugaaggauacgcuacucaugagcuacgucaguuggcaucucagagccauggcaucccagggaagccacccaggucccugcccacagagccccucuauccccugggcaccaccaagccuguccuugcuuggcucacacuaaccauggaccagcuuccccaugcacccccuccaucuccccguggguggucccguagucauacagccacacagagccagaggcuggcaucugugacauucugcuacagccuagcaaauaauugcacaaaauuagcagcccacagaaaugucccugccagcccaccccuugucacaggcaguccacccuucagaaaaucagagccauguucccccuuaaccccugcucucaagauucugggccuagacagcagcuaauagcaggccauuacuuuuuuuuuuuuuuuugagacggagucucgcucugucauccagacuggagugcaguggugugaucucggcucacugcaacuuccgcuuuccggguucaagcgauucuccagucucagccucccaaguagcugagauuacaggcgugcaccccaccaugcccggcuaaguuuuguauuuuuaguagagacaggguuucaccauguuggccaggcuagugucgaacuccugaccucaggugaucugcccaccucagccucccaaagugcugggauuguaggcgugggccaccgcgcccggccaggccauuaccuuuugcaaagcaagggucugugugucuggaagcuaagcuugggcucugagaugguggcacagcugccuuccacugaggugaaggcaagcgagggaaggcaggguccacggcccaggguucugcaggcugggcagugugccgcggugagggucauccccacccacugcugucuccaccgccucccaggaggauccugcugaacuacgccguguacaacccugccgucggcuauucccaagggaugucggaccugguggcgcccaucuuggccgagguccuggaugagucagacaccuucuggugcuuuguggguuugaugcagaacacgaucuucgucagcucaccccgggacgaggacauggagaaacaacuggugaggcucagggggaugggugcguccaagggcaugugagggcccguguugccucucccguuguagccgggguugccguggugaugcguggcuuggcugcuguaggucagugggcagugggaacgccaggauaggacuugcccgugggauaugggcggcuuagccuaucucggccuccggggauggcccucugacucccugcagguccagaggccgcguugugugggccgcucugguggccuuccaccccugcacgugacaaccuggcccaagcucccuggcuggcaaggaagacguggcaccaucacacccagcccccucugagccuuagaaaauggguccucaggugugucuaagcugcucccugcaggagucaacacagccagggcuucugagugcagacaggaagaggaggggcuccugaaacccccugaggucucuggggcaguccucacaccccaccccuccccuggggugcccugcugacaccucucccgucaaggccuccucaaaaggaccagcccuauguagaccaggaagcacugaaugucggugguggggcugagcccagcuggguaaggcagcgccggagggccagcgugugggaccgaaccagggcugagccagggcaccugcucacuguucucagcacacaucacccaugucaaccaagugccugccgggugcagucaccagacauucacccuccuggcugggccaggaagcuggcauugugagcagaggacgcugggugucggggagcacugugggaggugcccgugauaaggacaagagggcuccugcaccggggacagcuccaggguguguggggucuggcccugagugucgcuaaggcugggcugagcagagcagucccaguggugggacugagugaccuggucuuccuggaccagacccgucacaaguagugaggguggagcugauggagggccuugaaggccagggccacagagugugucucauagaacggggguccccacccccaggacacagagcgugucucagaaugggguccccaccccaggacacagagugugacuuguagaaugggguccccaccccaggacacagagugugacuuguagaacgggguuccccagccccaggccacggagugugucucauagaaugggauccccacucccaggcccaggacugguacugguccauggccuguuaggaacuggccgcaccgcaggaggugagcgguggacgggccagcgagcauucccgccugagcuccaccugccgucagaucagcggcugcauuagauucucacagaagcucgaacgcgagaacccuacugugaacugagcaugugaggggucuagguuguguacugcuuaugagaaucuaaugccugaugaugugagggggaacaguuucaaccugaaaccauucgcacuaccuuguccguggaaaaauugucuuccaggaaacgggucccuagugccaaaaagguuggggaccgcugcuauagacugacuguuagugggucgcugaugacaggcugggagagcugaugccaacagagaggauuugaaggcaaaggagcccaagcagggaggugcaggcaccugcacagggggcgggaguggagcaucugcaagggggucagccacacgagugggcuugaccuggccguaggccacagggcggagggcuggccgcacagcuucagcgcagucucccgugggaacaaugggccaccugugugggaagggggcauguggccccgagcucugccccaggauccccccagcugugaucuaacuccaccugggccggggggcugaacccagccaagccugcucacucugcaucaacgggugugugugacgucggguguccacauugcuuggggaggcaguuacaguguccaacgccauucgccucugacggcucauggcagcgcauggcugggugacucacugaaugcuggagauugauuuuccagcggcauugaugaagucagcggccugggcccgagugcugccagaaauagccccgaucuugucccacaucauugggagaugaccuuaauggcaggaaucgagcauccuggggcucagauacguccccuuccugcccuaaaacagcucuggaagaugauagaucugggugagcguagccgaagaggggugggggggcucccuggaugauccacucaccucaccaggaggaguggacgugggaaacagcccccaagugugcacugaggguggggagccuuccuggccauggagcggcugccagcguccugccacgcccgggcacaacacucugccucacccuggaccacaccacagccuccggaacagucagaucugggaggaacuggcagaggcaggugugagccgauuccagcggcggaauggagcguugggggggcaggcacaugcagcagguagaggccccugggugugcuuuuccaggcugggguggcccagggaagggccccagugggagugggcuuccugggcagcaggccgcaugggaccggagcuaacuaacgcgugacggccucacccccagcuguaccugcgcgagcugcugcggcugacgcacgugcgcuucuaccagcaccuggucucgcugggcgaggacggccugcagaugcucuucugccaccgcuggcuccuucugugcuucaagcgggaguuccccgaggccgaagcgcugcggaucugggaggccugcugggcccacuaccaggugaccagggcaggggccagggcuggggagguugggaccauggccccugaaccaccguggccacccugccugcugccccuguccgccucgccgccccccacccacagccacacauuagccccccauacggcgacugccuucccgucccacguggcuggcuucagaccuuacagcucgccuccccagucacugaaaucgaugcaaauugcccgcugacugcacucauuaccacuuucuggggcugagcucccuccugucacaaccaaucagugugagugacacuguggggggccuacacuaggccacagcagcccaggacgcuggugcccacgagcgugagccagcaccgcuccacccccucgggaccgcccugccacgagggccgacucacccguuacccugcugugcagagaaagggccugagaucccacuucccugucggccccuccagagggccccaaucagugauaccgacuuccacucuccguccaccgucaccagcaucuucucagcaaauuccccuuggagcacagcacuggcucugucacauggccuuaacgcccaaacuagggacaagcuggagaugucaaaagauaagcaagucucuuugaguccaucagccuuuuaaaaaaaaaacucacaucgacgcauccaggagggcuggacccuuuugcaggagcuggcucuauccaccacggcagcuccagcagccuccgucagagaacccugaagauggaggcaaacacccaucugcuggaagacauuugcgucagcgucuccuguccucacucacaccgcagggggcugaugucugaugaaagcgagucugaagccaccgagugccgguaccacacgccgccuuugcaugcggucaucggcucgccccuggcccgggucuagguuucccuccuggcucagccugcuggacguggacgugcaggguggacgaucugcauuaacgaagggaagcacggcauggacggucugagaggcuucauucccaccacucccgaauuaaaaaaaaucgugccucauugcacguuuucccaguggcagauuugccgcccucauuccuuuacguucaggcugauguuacccgugaacucagcgcguggcccggcagaugggucccuuucccauggacaccuacugugucccaaguguaaugagaucuagucagaauuccagcgggaggcccacgugacgugggaucucuguuggcugccauuguguuggaaguccacaaagcaaguuucuguuguuuucagacugugggcuugauuuagccacggucggucccaucccucgaucaauuugguaguauuacggggugggggugggggugggcugcugaugagcugagagugagcucuguggaaugggaagguugcugccaggugaggccuuuaacuguucagugaccccugagcgagaaaggcuuuugaugcuauccguccgcugucagcaugugguggggcuggacggcccuacgcccugccuguccugggaacugaaaucugccuaugcugugcaggcuguggagaucgugcccucccucucccuccccacauuccucucccagagaagcugggcguccaccuuccugcaaccccuccgcugugucucgcaccagccacaguucaaaucacugcaaaaggauccgucagagccaaaacaagaccgucccagauuaguucagaggaagcagccgggcagccuggugcauggucucuccaggagcaggcuggggcgugggagucaccuguagccucugcccucauggugugcuccgcucagccugggccggggacaccguuccgucugguuuguguggucgacgucaggagacuaaacauggacuucccagugcccccguccuuccugugccuccggaagcgcgugugcaucaaagguggcgugucuugaggcggccaggccggagagcacacaggaugcagccgucaggaccuggcgugggcuuccugcugcacacagcgcguugcuggcaggccccgugaggcggucuuuaaagggagggcugcggaguccucaaaguaugcccgaaaagaggcucaaggacagggcgaucauuucagccacccugugggugagcugcugugcccgcucuguuaggaucuucccacuuuucuagccacaaacccuagagucaucucuggggcaugauugggggguguggccuggagccaggaggacaggcugacccguggguggcugccagaggcgcauuccaugacccgcuggagugaguucugacccagacuuccgcacacaccguugcucaggaccauuacaaaugaguccuccccaugagcacaggccaggccuucugaggaagggugcucuuuguacccccccacccccacccugucauggagaccacccacaucaccacccaggagagcagcagcagcccgugggggcugagcucagcaucguccccucuggaugucacagcagccugggcaugcggguacugggacagaccccaugugcagguggggaaacuuagggccgaagaggcggugcagcuugcccagggccacacggcccccgagcugggcugugagcccagaccccucgcccuggagcccucacucgcacccuggcacucaguuucccccugagugcagggccuggggcucggucagagcccgugucugaacucuacccgccuccacagacggacuacuuccaccuuuucaucugcguggccaucguggccaucuacggggaugacgucaucgagcagcagcuggccacggaccagaugcuccugcacuucggaaaccuggccaugcacaugaacggggagcucguucuccggaaggugaggcugccccagaugugggccccaccccgccccgcccccaaagccccaccccaccagcucguucucagaaaggugaggcugccccagaugugggccccgcccccagagccccauccccaccauggccccccagcacgugcccucccccacccauagcacugggggcuccccacuaaggccucguggucagcaccugucucggccuggcugugucaccucacuuuccuggggugccagcccugacacaggagccucccucgcuggcugaggagggaacgaauucaccggggcugacggacaggacagguucccuacccugggguaccucgcuuacaacccagaacugggaacacugagaaggaggcuggaccuggggacaggguggccagaauacuggggaccuugggcuuuggcccccucccccacuucccagacgccuccuggagaugcugcccguuagcucucuggugguccucagggcacugagcgggggucccgaggucggugguguccucuggcacaggacacagauccugcaggagcugagaggcugcugggggugggggguggagcaaggugcgggggaagaagagaggggugcugccaaagggacaggugggcuuggcuggacgccacccggcccugugcugguguugguccuguucacccuccugaaugaagcccauucaagggccuuguucaccucgagccaccugugagcacagcccgagugccuugugggucccaucacugcagccaccuaagacccagggccccguggugccggugauggugggagaugcaggcagagcccucaguccaggacucggugagcccccgaggugcaggccguuguugcugcuguugcugucuuuggccacucccauggggacccuaggcugccaggcugucccccggccccuccucaccccccguccucugucugcaggcgaggaguuugcuguaccaguuccgccuccugccccggauccccugcagccugcacgaucuguguaagcugugcgggucaggcaugugggacagcggcuccaugcccgcgguggagugcaccggccaccaucccggcucggagagcugucccuacgggggcacgguggagaugccuucccccaagucccugagggaaggcaagaagggcccaaagacgccgcaggacggcuucggcuuccgcagauaggucgggcccccgacaccggacagggguugaggggaccuccucagaggcccugggcacgggaggggguggggcugggcgugaaggggacaggggacgguagaaaccuaaggaaaaugcuuuugggcaacaugagaggaaccuuuucauauuaaugacaaaauuagagucuggaagugacagaagucagaucuacagccacccagaggaaagucagcuccugaaacgcugcaguggaacgcgcagccaccgcaccugagacgcaggcuggcugggcucuccugcuggcugcccuggaggauuucaacaugucccaggauuugcuccacccucgagggcagccagacagcgucgccaggcaaugaggaaagcagagacaggagaggaaggccucacucacccacugcgucgagggcugcagaacacagcgggguccuguccaggcccagggacaucuuugcaagccagacacacuuccucuugagaccucguucucucggagugagccaaacacacuucccaaaacguccccagccacagcugggaugccgauggaaaggcaucugccauaaaagaaaagcaaaagauaaaaagcccaaccgauguggggauagagaggcggaagagcagucaggcuugaggagcuggcgcuuguaauguuuauccguuuaaacauuucguccuccugguacacgaagggaacugucugcccaggagccugagccucaggcuguuggagaagcaucugaugccuuuuucuuugcugggggucuucuacgugagguuccuuggcguuguuuaaggucaacuccaccaaauacagcaaccagcuggggcuugaa

SEQ ID NO: 192326 - RNA, 11970 nt, Homo sapiens
uaaguuacuagagaaggugguggcaccuuagaaguauagaguuuaugggaaaaguuuuaaauuuuuaaugaaaaagacuuagaacaauguauuauuuacauguaaauaagaaaagagagcagaauccccauauccucuucaaaggaagggagacggcaggccauuuaugagaagaaaguccauauaaaccccauuaaguagaaucuggaucuaaauacuuccaaacaggaguacacagcaggugaacagucucccucaucccacugaucugcugcuucagauaagaucagcaacugaaagugaagaaagaaacagauuaaggaacaacacaaacaaaaugaaaauuuguuaacguaaauuuaacuaaaaccucacaacagacuucucaaaacaaaaaacaggccagacauaguggcucacgccuguaaucccagcacuuugggaggcugaggugggcagaucauuugaggccaggaguucgagaccagccuggccaacauggugaaaccccgucucuacuaaaaauacaaaaauuagcuggcuauggugcacgugucuguaauuccagcuacucaggaggcugaggcaggagaauugcuugaacccaggaggcagagguugcagugagccgaaaucgcgccacugcacuccagccugggugacagagcgaaacuucgucucaaaaacaaaacaaaaaaacccacaacaacaaaaaaacaaacucaggugccccaaacuaagaauagggaaguucccucuacaauuacaguagagcuggacgauuuccuaccguucaucggcaucucaucaaucugaguggaauaguacugcucgauaucucugaggaugcggaugucgucauucuuuacaaaguuaauggccacacccuuccggccguaucgaccugaucucccaauucuucaggaauaaaauaauauuacaguuaguauauauaacaaucaagauuuaguaaaugugucacagaagugaagccaaugagagcuugcaccuuaccuguguauguacaauucucuguuauuagggagaucauaguuaaugaugagggacaccugagggacauccaacccccuggcccagacaucuguagaaauaagcacucggcugcaaaaagaaagaguguuugaggcgauuaaauuacucauacaaguguaagacuggacuugcuuccauugcuaauuuuaaggaauccuggcugcagguccaaaauauacgagauucuccucucucaacagucugucugcaaacgugaagccucagggacagcaccagaaaccccugugcagaggggcuguugguggauuuaguuacuucggucaugugcuccaucagauuaaaaaaauagacaucuuuuacuagacuaucuuuaacuuguuuaaucgguccuaaaccaauaauugggaaaaauacuucacuuuugccuagcaaaaaauuaaaaacgguaacuucagccgggcauggcggcggcuuaugccuguaaucccagcacugccagaggcugaggcagauggaucaccugaggucaggaguucgagaccagccuggccaacauggugaaaccccaucucuacuaaaaaugaaaaaaaaaaaaaaaaauuagccauuccagcuacucgggaggcugagacacaggagucacuugaaaucaggaggcagagguugcagugagccaagauugugccacugcacuccggccuggguaacgaagugagacugucucaaaaacaaacaaacaaaaaaagacacacacagcacauauguuaagcugaccacaaggugggcaaagaaggaagucugaaucaaguucaaaugaaugaaaccacccaauccacgcuuucugaccacuguggaauuaaacuaaucgaaacgaugaacagaaaaccccccuacuuacuggaaaagaagacacacgcuuguaaccaaggugaccaaccuggcuaguuaaggcuaguuaucaccucaaccuaaguauuacaggagcacagcggaccccuccuuaacuggaagguuuucugcucacccagggccucagcuuucagagcagaagcuuggcauccccccggguguggggccugcacuuaggcgguacauaugaagugcuuagacacagucuagcaaacccugaccugcagagccacagcauagcagacccaccuggcgcccgaccggaacuccuucaugauggacucccgcucuuucuggggcaugucuccaugcauugaggauacagugaaguuggcuucccucauuuucuccgucagccaguccaccuacaaauccaaucaacagaugcuacugcaagcuaguauaccaaagcagagaugugcauucgggacuuuaccgcaucauuugcagaaccaguaucaauauucguaagguaacugcucuuaaaacucagaaucauccuaacuggauguaaaaacuuuuucccagaaaauguuggggugcacucacaaaacccucuuacuucauuuucuccauauaaugacucuauggggggagggggccaggugugcucauucucauuugaaauuugaauuccaaucuuguuagaauguagcccaacuccuuuccuuucucaggaaaguggccgacaguucucaggucugccuccacauuaccaucaccuggggaucuaaaacuacucaggccuggguuccaccuucagccaacgaaaucugaaucuuuagggguggcugauaucgcuguucuguaaaugaaguuuuaauggucacagccacgucugaccguuugcauauugucuacagcugcuuuuacaagagaacacauacccugaaagcuuaaaauauggacaaacuggcccuuuacugaaaaaucuugauuuaugucauucagagacucaaucugcaguuucccuucagcacauggaugcugugcagugccucuuaccuuucuuuugguguugcagaagaugaccgccugagugauggucagugugucguagaggucacacagagugucaaauuuccacucuucccucuccacugccacgaaaaauugcuugaugccuuccagagucaauucaucacugaaggacaaagacaaauccuguuacauacucauccuuccuucuaggacuugagggugggccaagccaggauccagggagacccugguggaaaaggucacaccgugauaucuggugcagacccagcagccccagcccuguccuccauccuaucaccacuuccgucacacaggccuccauucuguauccuacuuaacauuucacaaugugcaccacauggaauacgauucuaaacgaaacacugauaaauaaauagucaccuaauuuuuaaauuuagaauuauugguucaaaccacaaugaggauuauaaaagauggguuguuuuguuuuguuugagacagggucuugcucuguugcccuggcugaaguacaguggcacaaucaaagcucacugcagccucagccuccugaccucaagcgauccucccaccacagccuccugaguagcugggacuauaggcaugugccgcccuaccuggcuaauuuuuuauuauugguagagauacggucucuauauguugcccagccuauuugguuuuuuaaaacaggaauuuuaaaagaauuugcaugcuuucaauuccuuuacacucaggcaagaggauagccugagguccggguuuugacacgagcuucagcaacacagccagacucuggcuauaaaaaguuuuugaaauuacgacauaaaauccuuuauaaaugcggcccaguguuuuaguaaacuugacaagaggggcuccuaccguuucaccaagaugcggauugggucggucaugaacuuguuggucaucuccagaaucucguguggcagcguggcacugaugagaaccaccuguguggcuggaggcagguaccuguauacaucguaaaucugcucuuugaaaccugggacagggagcaagacaggugagggauguuuagggcggcacacccagaaauggaaggugcacgcccaguguucccacuggguuagaggcagaguggugauaagguacguuugacaggaaaucucauuuuuacagcaccaggccacauccacgcguucucuccgucccuacuccccgcccaccggaguguuaucugguugagggaaucugguuucccuuuggugcuucuucaaucugaagugaucuagggaucaagaaacccaccccgagaguccuagauaccaaauaaaaagcaauagaggcuggccugagucacccacaaugaacaaauaaauaaaaucaagguaggaauuuuuuguucauaauugccaaggcacaauuguuuuuccacgaugaaaacacuauucacauucagaacagucacuggcuguuucaauuuuacacugugaaaauuuaagaacuaagaauuaugucaguagaagaguaauucuuuuguugcucauaccuuuauucaacauuucaucagcuucauccaaaaccaacauuuugauagcacguguccuuaggcuucugcgacgaaucauaucuauaacaugagauuuugaaauacuuacgacaaaucacaucuaugagauuuugaaauaaucacaccugaggcucccaagaaagagcucaucauuccacuggucucaggguuccagagaccuucccucuaccuccugcaagugacccaggugcaaaagucuaccgugcggccuaccaaaucgaaagcuguccuguaccauuuaagcacuucuuacaaauacuaccggcagcaccauuuuuagcgacaaaagugcuuaccaaaaacacgcccuggagugcccgcgacaacaugcuguccguaauccagcuuccugauguccucgccaacauuggugccuccaaugcaggcauggcacuggacauucauguagucaccgagagcaagcagccccugaaacaaagcacagguucacguccagggugggagagagaaacauccacguuuuccaaaaagaaagacuguuucuccuccgagaugaucaccgauuauuauuuaugccauuauuaucucgaaaccacaaaauucuccugcucuuuucucugacaaaaacaaguuaauuuugcuuuuuuuuuuuuuuuuuugagacggagucucacucuguggcccaugcuggggggcagcagcgcaaucuuagcucacugcaagcuccgccuccaggguucacgccauucucccgccucagcuuccugaguagcugggacuacaggcgcccgccaccacaccaggcuaauuuuguuuuuguauuuuuaguagagaugggguuucaccguguuagcacaccgugcugugugcacccuauauguguauucagagagucguuaucuccugaccucguaauuggccugccucagccucucaaagugcugggauuacaggcgugagccaccacacccggccugcugguuucuuauuacaaaagcuauaucauuaacagaaaagaauauauaaaauucauaaucccauccaccgaagaaaccagcauuaacaucuuaauauacaucuuuuuaaacauacaucuuuauacuacguuaaguauaaaauggguacaauuuauuuuuuuuuugagacagaguuucacucuucuugcccagacuagaguacaacggcacaaucucagcucacugcaaccucugccucccggguucaagugauucuccugcucagccacccaaguagcugggauuacaggcgccugccaccacgcccagcuaauuuuuuguauuuuuaguagagacaggguuucacuauguugaccaggcuggucucaaacuccugaccucaggugauccacccaccucgaccuaauuuauuuuuauuaaaauugauuuuucgcaaaaaaucuacauuucuaaggcuguaaaaaacuaccgagagcacacaagccacaccaaaaaugacuuaauacaaaccagcaauuuauauaaugauuaauggcaaaauguuaaucaggaagaaaauuuugagguaucagaaaacaggauuggauuaaauaaauaagucgguguuucacaacuaaaucacaaaagcaguacuuguuaaucggacaccgcuaucuuuagccaucucaccuucuggaucugcacagccaacucucuugugggagccaagaucaaagcuugaguuucacgaaccuggugaaauaauuuaucagaaaauagagaauccgcaguauuaucaaaguggauuguaguaauucacacucagaucuauaugagaaauacuaucucauauuaaucauacuucucaucucuuacagguuagcaaauauugucauuuaaauugcaaauccaacaauaacuuaaugugucagcauccucgucugcagacaagagcuuccucuaguuaaauagaaaaucaugacagaauauuagugcauauauuaguguacaacuaagacucuguguaaaaauuugcugagucaauacauacuagaaaauuuuaaauuguacuuuuugaacacuguaguuacagaagaaaaagcaaguauuuccuagaauuacauaacaguuuguuuuaagaauggcaaauuaccugaauauccaaacacuggaggacugagauacugaagguggcuguuuuuccugugccggacugagaccuauucaaggaaacaaaagcagugggauuagagggaggacaggccacgccacagcugcacuccaaggccugggcuccagaggcacuuagguaccuucuuccagcaagcccccguaccuaauaacaucuuaacugcgaggaggcaggacucgggcccagugucacagcuuguuaaguguccaugaagaaagagaguagacauggcuucugcacgggggcaauggagccacagacucucuaacuucaagagguguuucauaggugucagaaaaaggaggacuccccuuuaucuaaauacaacucuuuuccuucuaggauuuuggacuaacucucucuuccaaagaaauuuuuguguaaaugagucuuuuuugaaauuaggcaaacgaggaauaaagcuauuaaaagaggauuuguggugcuaggagauauggcuauauacaaguuuucauccauaguuccuggcucacagcucccauagcccuuauuacagucuuauuaaauugauggguuaggccucaggaaacaaucucucugaccuucugcucuccuuucaccugcuccacagcagggcucuaaucuucccugccuuucagauugugagucauaaagacccucaugucacggcgugguggcucaggccuguauucccaacacucugggacgcagaggcagcauuaauugaagccaggaauucgagaccagccugggcaauacagcaagagaccccauuucuaaacaaaacaaaaaacuaaccaggaacgguggcacauucuggcagucccagcuacuugggagguugaggcgggacgauuccuuaauccucgaaguuagagguugcagugagcuaugacugcaccacugcauucccgccugggugacgaagugaggccccauaucuuaacaaaaaaaauguuuaggccgggcacaguggcucacgccuguaaucccaaggcuuugggaagccaaggcagacagauugccaggaguuugagagcagccugggcaacacaacaaaacccugucucuacagaaaauacaaaaauuaauugggcauggugaugugugccuguagucccagcuacuugggagggugaggugggaggaucgcuugaggcugcuaugagcuguaaucacacgacugcacuccagucugggagacagaguaagacccugucucgaaaaauguaaaaaauuuaaauuucaaauuuuuuuuuaaaaagcauuaugguauuaucccagaaaagcuccugcccuauucccuuaugggggaaagaaugcugaccucauggaauuuuccauaaaaacccaagaggacuggguucgaagagcuucuagauggcugaacacagacaguggaacacaaggagguuccgggaggugaccacccgccccuuggaggcugcaccccuccccccauaucuguauccucugcaguacccuuuauaauaaaccacuaaauguguuucccugaguucuuugagcugcuguuccagcaaauuaauccaaccuaaagaggggauccugggaacccaacuugaagcugcuuggucagaaguucuagagauccgaacuuauaacuggugucugaaaagaggguagucauggggacugagccgucaaccugcaggauauggccuaucuccaggcagguggugugaguugaacuggaggacacccagcuggaaaagccccacaccucugcucacagaagucuucuucugugcugaugacuguugugguggugugagagcagaggaaaagcacagucuguuuuuccgaaauuguguuauauacaauuccacaugccagcaaaccacuaagcaaagcuggcuaagaaaaugaaagccuuggccgggcgcaguaacucaugccugaaaucccagcacuuuaggaggccaaggaggguggaucaccugaggucaggaguuugagaccagccugaccaacauggugaaacccccgucucuacuaaaaauaugaaaauuagucgggcaugguggugcaugccuguaaucccagcuacuugggagggugaggcaggagaauagcuugaaacugagaggcaaagguugcagugagccgagauggcaccacugcacuccagccugggcaacagagcgagacuccaucucaaaaagaaaaugaaagcuuuccacaguagagaacacaaauuuaaaaaaguauuaaacccuguggcuaaagucagggaaaguguuggaacugagcguguacaagcugagggaaacagucaucccagagcaucuaacugcacugcgcugcccaaauuuacauccagcccugcgccgcaccccaggacaacuuacugugcgaugacaucucucccuuugaugaucugcuugauugcucguugcuggauugcugaugguuuuucaaaaccugcaaauaaaaacaaaaaauuagcccucaccacaaugacagcauagaaacccuguacugugagcuccucaggggcagacaugguuuguuuuuugaaccuguccuccagccuaacccaguguucaacauagcaagcucucaaaacccaggggcucaaugaauugggcugagugauuucuacacuaacgugggauauuauuuguaaagaccaaucucuauuuuuaaaaaaccaccaaauuguagaauauagacaacaguuuuguuuaaaaaaaaaaaaaaaucugggugugcagcaucuggaaguguaagugccaaaauguuccuggcaguuacugcaguagagggguggaaagaaacuuacuuuuuacucuaauuacucccuuagguuugacuggauuacaaacaaccuauacuacuuuuuaaauuaaaaaaaaaaacaacaaaaaaacaggaaagucacucuagccauuguucucuccuacuagcuagcauuaagucuguguguugcugacaggucuacaacucuguuuaaccugcgugggucacgcugcaggguguccuauguuguucugucuggaugcagcucacuaacuacaacaccaucacaccaucucucuugcaaagcaacuacuacaccaaagggugaggcuauuuugaagaagaaccacguguuuuucaaguaaauaaaauuuuauguacaaaaacucuauuucaauuauuuuuugguagucucuuaaauguagcucugcucaguucuggggcauagcgaaaaauaagaaacaaaagaaaauguagcacaauuucccaucuuaacacaaaugcaaauauagcagaugauuuaaacucuucaugaagagcaagcacauagaugggaaacuaacaacagugucuuagggcagggacugccugagugccaggaaaccagguggggcugucagccucacugugaggcugccugagaugcuuuuucaccacgcauccucagcaacuucgcuucacuuuguccaaacuguuguggcaucaagaacuacaggauacggccaggugggguggcucacaccuguaaugccaucacuuugggaggcugaggcugguggaucacugaggucaggaguucaagaccagccugggcaacauggcaaaauccccucccuacuaaaaauacaaaaauuaguaggacgugguggcccacaccuauaaucccagcuacucgggaggcugaggcaaaggaaucgcuugagccccagaaguggaaguugcaauaagcugagaucaugccacuacacuccagccuuggugacaagagcaggacugucagaaggaaaaggaagaaagaaaaggaagagaacuacaggauaaaaaaugucccugucccaagcauuaaacacaggccauuuaucccagaugcuggucauucccaucuaugugcccaacccaaccucuucuccaggcucucccucaacuuccucacaucuuucaaacauaccaagagacagcuccugauucugacucucuggagugcugccuaccuagccaaauguuugcagcaucaaccaccgguuacucaaaacacuccaacucuccuccuucugucacucacguucaauccaucagccaaugcugucagcucccugguacuccaucuccaaggcagcacaauccucucuucccugaacugcagcaaaagcucccaacucucuuguuuccucuccugccuugccucgccucaccucaaaucuacagacacccagaagaaucuuuaaaacuguaaaugugaucgugucacauagcuacuuaaaaccuuccacuggcuucccacuagauuucuaaaugaaauucaaauuauucgucacccuacacgucuuugcuagaucugccccgacuagcucuccaaaaucccaccacaggggacuucuuucaguuccuggaaugcagcuggcuaagggcugcaaggcccuggcaccagcuguuccuucugccccaacugcucuucccucuucucauaacagucuccuucauccagaacucugcucaaauggcacccccuccugcgaacccccuuaccucucugcuuuacuaauucucuccuccuucccagucccacucuauucaauuaccccgcuucagguucuucagguugccugggcaaccugacaguaugcuuuccccccaaacgaaauucaaaacccguaaaggcgcaaacccuuccgguuuaccgccaaaaccccaguaccuagaaaagcuaauagguagaaaucaguuaucugcugaaugaaggacgcugaggugccucgaagcggcugcagcccccgacagacccagcgccgagcucugcacgggggacacacaccgaaagcgccgacacagccaggcgugagggcgaggacgggggugggggugggggucggacgucacuggcccccgagccucgacccugaccacgaccuccggagcgcagggccggcccgggagucaccagucuggcccucagcccccggcucgcccccgacucgcccccggcuggcccccgcggcccgcgcccgcucaccguaagcguagaugccccgcagcagguccucccgcaggcccauggugucgaacgugggggucacauccaccuccucgcuggucucgaauuccacuuuagucaugucuuccucuuugagcagccgcuuucgcgccgagcccgaggucgccaucguggccguggucgccaugauucagaguccgcggaagagcacagcgcgcgccgcugccgaccucgcugccgcugccgaccucgcugugccgcugccgaccucgcugccgcugccgaccucgcugugccgcugccgaccucgcugugccgcugccgaccucgcugugccgcugccgaccucgcugugccgcugccgagaacagacgccuuaaguaugcgaaagcgagagacgugcgugcgu

SEQ ID NO: 192327 - RNA, 11970 nt, Homo sapiens
acgcacgcacgucucucgcuuucgcauacuuaaggcgucuguucucggcagcggcacagcgaggucggcagcggcacagcgaggucggcagcggcacagcgaggucggcagcggcacagcgaggucggcagcggcagcgaggucggcagcggcacagcgaggucggcagcggcagcgaggucggcagcggcgcgcgcugugcucuuccgcggacucugaaucauggcgaccacggccacgauggcgaccucgggcucggcgcgaaagcggcugcucaaagaggaagacaugacuaaaguggaauucgagaccagcgaggagguggaugugacccccacguucgacaccaugggccugcgggaggaccugcugcggggcaucuacgcuuacggugagcgggcgcgggccgcgggggccagccgggggcgagucgggggcgagccgggggcugagggccagacuggugacucccgggccggcccugcgcuccggaggucguggucagggucgaggcucgggggccagugacguccgacccccacccccacccccguccucgcccucacgccuggcugugucggcgcuuucggugugugucccccgugcagagcucggcgcugggucugucgggggcugcagccgcuucgaggcaccucagcguccuucauucagcagauaacugauuucuaccuauuagcuuuucuagguacugggguuuuggcgguaaaccggaaggguuugcgccuuuacggguuuugaauuucguuuggggggaaagcauacugucagguugcccaggcaaccugaagaaccugaagcgggguaauugaauagagugggacugggaaggaggagagaauuaguaaagcagagagguaaggggguucgcaggagggggugccauuugagcagaguucuggaugaaggagacuguuaugagaagagggaagagcaguuggggcagaaggaacagcuggugccagggccuugcagcccuuagccagcugcauuccaggaacugaaagaaguccccuguggugggauuuuggagagcuagucggggcagaucuagcaaagacguguagggugacgaauaauuugaauuucauuuagaaaucuagugggaagccaguggaagguuuuaaguagcuaugugacacgaucacauuuacaguuuuaaagauucuucugggugucuguagauuugaggugaggcgaggcaaggcaggagaggaaacaagagaguugggagcuuuugcugcaguucagggaagagaggauugugcugccuuggagauggaguaccagggagcugacagcauuggcugauggauugaacgugagugacagaaggaggagaguuggaguguuuugaguaaccggugguugaugcugcaaacauuuggcuagguaggcagcacuccagagagucagaaucaggagcugucucuugguauguuugaaagaugugaggaaguugagggagagccuggagaagagguuggguugggcacauagaugggaaugaccagcaucugggauaaauggccuguguuuaaugcuugggacagggacauuuuuuauccuguaguucucuuccuuuucuuucuuccuuuuccuucugacaguccugcucuugucaccaaggcuggaguguaguggcaugaucucagcuuauugcaacuuccacuucuggggcucaagcgauuccuuugccucagccucccgaguagcugggauuauaggugugggccaccacguccuacuaauuuuuguauuuuuaguagggaggggauuuugccauguugcccaggcuggucuugaacuccugaccucagugauccaccagccucagccucccaaagugauggcauuacaggugugagccaccccaccuggccguauccuguaguucuugaugccacaacaguuuggacaaagugaagcgaaguugcugaggaugcguggugaaaaagcaucucaggcagccucacagugaggcugacagccccaccugguuuccuggcacucaggcagucccugcccuaagacacuguuguuaguuucccaucuaugugcuugcucuucaugaagaguuuaaaucaucugcuauauuugcauuuguguuaagaugggaaauugugcuacauuuucuuuuguuucuuauuuuucgcuaugccccagaacugagcagagcuacauuuaagagacuaccaaaaaauaauugaaauagaguuuuuguacauaaaauuuuauuuacuugaaaaacacgugguucuucuucaaaauagccucacccuuugguguaguaguugcuuugcaagagagauggugugaugguguuguaguuagugagcugcauccagacagaacaacauaggacacccugcagcgugacccacgcagguuaaacagaguuguagaccugucagcaacacacagacuuaaugcuagcuaguaggagagaacaauggcuagagugacuuuccuguuuuuuuguuguuuuuuuuuuuaauuuaaaaaguaguauagguuguuuguaauccagucaaaccuaagggaguaauuagaguaaaaaguaaguuucuuuccaccccucuacugcaguaacugccaggaacauuuuggcacuuacacuuccagaugcugcacacccagauuuuuuuuuuuuuuuaaacaaaacuguugucuauauucuacaauuuggugguuuuuuaaaaauagagauuggucuuuacaaauaauaucccacguuaguguagaaaucacucagcccaauucauugagccccuggguuuugagagcuugcuauguugaacacuggguuaggcuggaggacagguucaaaaaacaaaccaugucugccccugaggagcucacaguacaggguuucuaugcugucauuguggugagggcuaauuuuuuguuuuuauuugcagguuuugaaaaaccaucagcaauccagcaacgagcaaucaagcagaucaucaaagggagagaugucaucgcacaguaaguuguccuggggugcggcgcagggcuggauguaaauuugggcagcgcagugcaguuagaugcucugggaugacuguuucccucagcuuguacacgcucaguuccaacacuuucccugacuuuagccacaggguuuaauacuuuuuuaaauuuguguucucuacuguggaaagcuuucauuuucuuuuugagauggagucucgcucuguugcccaggcuggagugcaguggugccaucucggcucacugcaaccuuugccucucaguuucaagcuauucuccugccucacccucccaaguagcugggauuacaggcaugcaccaccaugcccgacuaauuuucauauuuuuaguagagacggggguuucaccauguuggucaggcuggucucaaacuccugaccucaggugauccacccuccuuggccuccuaaagugcugggauuucaggcaugaguuacugcgcccggccaaggcuuucauuuucuuagccagcuuugcuuagugguuugcuggcauguggaauuguauauaacacaauuucggaaaaacagacugugcuuuuccucugcucucacaccaccacaacagucaucagcacagaagaagacuucugugagcagagguguggggcuuuuccagcuggguguccuccaguucaacucacaccaccugccuggagauaggccauauccugcagguugacggcucaguccccaugacuacccucuuuucagacaccaguuauaaguucggaucucuagaacuucugaccaagcagcuucaaguuggguucccaggauccccucuuuagguuggauuaauuugcuggaacagcagcucaaagaacucagggaaacacauuuagugguuuauuauaaaggguacugcagaggauacagauauggggggaggggugcagccuccaaggggcggguggucaccucccggaaccuccuuguguuccacugucuguguucagccaucuagaagcucuucgaacccaguccucuuggguuuuuauggaaaauuccaugaggucagcauucuuucccccauaagggaauagggcaggagcuuuucugggauaauaccauaaugcuuuuuaaaaaaaaauuugaaauuuaaauuuuuuacauuuuucgagacagggucuuacucugucucccagacuggagugcagucgugugauuacagcucauagcagccucaagcgauccucccaccucacccucccaaguagcugggacuacaggcacacaucaccaugcccaauuaauuuuuguauuuucuguagagacaggguuuuguuguguugcccaggcugcucucaaacuccuggcaaucugucugccuuggcuucccaaagccuugggauuacaggcgugagccacugugcccggccuaaacauuuuuuuuguuaagauauggggccucacuucgucacccaggcgggaaugcaguggugcagucauagcucacugcaaccucuaacuucgaggauuaaggaaucgucccgccucaaccucccaaguagcugggacugccagaaugugccaccguuccugguuaguuuuuuguuuuguuuagaaauggggucucuugcuguauugcccaggcuggucucgaauuccuggcuucaauuaaugcugccucugcgucccagaguguugggaauacaggccugagccaccacgccgugacaugagggucuuuaugacucacaaucugaaaggcagggaagauuagagcccugcuguggagcaggugaaaggagagcagaaggucagagagauuguuuccugaggccuaacccaucaauuuaauaagacuguaauaagggcuaugggagcugugagccaggaacuauggaugaaaacuuguauauagccauaucuccuagcaccacaaauccucuuuuaauagcuuuauuccucguuugccuaauuucaaaaaagacucauuuacacaaaaauuucuuuggaagagagaguuaguccaaaauccuagaaggaaaagaguuguauuuagauaaaggggaguccuccuuuuucugacaccuaugaaacaccucuugaaguuagagagucuguggcuccauugcccccgugcagaagccaugucuacucucuuucuucauggacacuuaacaagcugugacacugggcccgaguccugccuccucgcaguuaagauguuauuagguacgggggcuugcuggaagaagguaccuaagugccucuggagcccaggccuuggagugcagcuguggcguggccuguccucccucuaaucccacugcuuuuguuuccuugaauaggucucaguccggcacaggaaaaacagccaccuucaguaucucaguccuccaguguuuggauauucagguaauuugccauucuuaaaacaaacuguuauguaauucuaggaaauacuugcuuuuucuucuguaacuacaguguucaaaaaguacaauuuaaaauuuucuaguauguauugacucagcaaauuuuuacacagagucuuaguuguacacuaauauaugcacuaauauucugucaugauuuucuauuuaacuagaggaagcucuugucugcagacgaggaugcugacacauuaaguuauuguuggauuugcaauuuaaaugacaauauuugcuaaccuguaagagaugagaaguaugauuaauaugagauaguauuucucauauagaucugagugugaauuacuacaauccacuuugauaauacugcggauucucuauuuucugauaaauuauuucaccagguucgugaaacucaagcuuugaucuuggcucccacaagagaguuggcugugcagauccagaaggugagauggcuaaagauagcgguguccgauuaacaaguacugcuuuugugauuuaguugugaaacaccgacuuauuuauuuaauccaauccuguuuucugauaccucaaaauuuucuuccugauuaacauuuugccauuaaucauuauauaaauugcugguuuguauuaagucauuuuugguguggcuugugugcucucgguaguuuuuuacagccuuagaaauguagauuuuuugcgaaaaaucaauuuuaauaaaaauaaauuaggucgagguggguggaucaccugaggucaggaguuugagaccagccuggucaacauagugaaacccugucucuacuaaaaauacaaaaaauuagcugggcgugguggcaggcgccuguaaucccagcuacuuggguggcugagcaggagaaucacuugaacccgggaggcagagguugcagugagcugagauugugccguuguacucuagucugggcaagaagagugaaacucugucucaaaaaaaaaauaaauuguacccauuuuauacuuaacguaguauaaagauguauguuuaaaaagauguauauuaagauguuaaugcugguuucuucgguggaugggauuaugaauuuuauauauucuuuucuguuaaugauauagcuuuuguaauaagaaaccagcaggccgggugugguggcucacgccuguaaucccagcacuuugagaggcugaggcaggccaauuacgaggucaggagauaacgacucucugaauacacauauagggugcacacagcacggugugcuaacacggugaaaccccaucucuacuaaaaauacaaaaacaaaauuagccuggugugguggcgggcgccuguagucccagcuacucaggaagcugaggcgggagaauggcgugaacccuggaggcggagcuugcagugagcuaagauugcgcugcugccccccagcaugggccacagagugagacuccgucucaaaaaaaaaaaaaaaaaagcaaaauuaacuuguuuuugucagagaaaagagcaggagaauuuugugguuucgagauaauaauggcauaaauaauaaucggugaucaucucggaggagaaacagucuuucuuuuuggaaaacguggauguuucucucucccacccuggacgugaaccugugcuuuguuucaggggcugcuugcucucggugacuacaugaauguccagugccaugccugcauuggaggcaccaauguuggcgaggacaucaggaagcuggauuacggacagcauguugucgcgggcacuccagggcguguuuuugguaagcacuuuugucgcuaaaaauggugcugccgguaguauuuguaagaagugcuuaaaugguacaggacagcuuucgauuugguaggccgcacgguagacuuuugcaccugggucacuugcaggagguagagggaaggucucuggaacccugagaccaguggaaugaugagcucuuucuugggagccucaggugugauuauuucaaaaucucauagaugugauuugucguaaguauuucaaaaucucauguuauagauaugauucgucgcagaagccuaaggacacgugcuaucaaaauguugguuuuggaugaagcugaugaaauguugaauaaagguaugagcaacaaaagaauuacucuucuacugacauaauucuuaguucuuaaauuuucacaguguaaaauugaaacagccagugacuguucugaaugugaauaguguuuucaucguggaaaaacaauugugccuuggcaauuaugaacaaaaaauuccuaccuugauuuuauuuauuuguucauugugggugacucaggccagccucuauugcuuuuuauuugguaucuaggacucucgggguggguuucuugaucccuagaucacuucagauugaagaagcaccaaagggaaaccagauucccucaaccagauaacacuccggugggcggggaguagggacggagagaacgcguggauguggccuggugcuguaaaaaugagauuuccugucaaacguaccuuaucaccacucugccucuaacccagugggaacacugggcgugcaccuuccauuucugggugugccgcccuaaacaucccucaccugucuugcucccugucccagguuucaaagagcagauuuacgauguauacagguaccugccuccagccacacaggugguucucaucagugccacgcugccacacgagauucuggagaugaccaacaaguucaugaccgacccaauccgcaucuuggugaaacgguaggagccccucuugucaaguuuacuaaaacacugggccgcauuuauaaaggauuuuaugucguaauuucaaaaacuuuuuauagccagagucuggcuguguugcugaagcucgugucaaaacccggaccucaggcuauccucuugccugaguguaaaggaauugaaagcaugcaaauucuuuuaaaauuccuguuuuaaaaaaccaaauaggcugggcaacauauagagaccguaucucuaccaauaauaaaaaauuagccagguagggcggcacaugccuauagucccagcuacucaggaggcuguggugggaggaucgcuugaggucaggaggcugaggcugcagugagcuuugauugugccacuguacuucagccagggcaacagagcaagacccugucucaaacaaaacaaaacaacccaucuuuuauaauccucauugugguuugaaccaauaauucuaaauuuaaaaauuaggugacuauuuauuuaucaguguuucguuuagaaucguauuccauguggugcacauugugaaauguuaaguaggauacagaauggaggccugugugacggaaguggugauaggauggaggacagggcuggggcugcugggucugcaccagauaucacggugugaccuuuuccaccagggucucccuggauccuggcuuggcccacccucaaguccuagaaggaaggaugaguauguaacaggauuugucuuuguccuucagugaugaauugacucuggaaggcaucaagcaauuuuucguggcaguggagagggaagaguggaaauuugacacucugugugaccucuacgacacacugaccaucacucaggcggucaucuucugcaacaccaaaagaaagguaagaggcacugcacagcauccaugugcugaagggaaacugcagauugagucucugaaugacauaaaucaagauuuuucaguaaagggccaguuuguccauauuuuaagcuuucaggguauguguucucuuguaaaagcagcuguagacaauaugcaaacggucagacguggcugugaccauuaaaacuucauuuacagaacagcgauaucagccaccccuaaagauucagauuucguuggcugaagguggaacccaggccugaguaguuuuagauccccaggugaugguaauguggaggcagaccugagaacugucggccacuuuccugagaaaggaaaggaguugggcuacauucuaacaagauuggaauucaaauuucaaaugagaaugagcacaccuggcccccuccccccauagagucauuauauggagaaaaugaaguaagaggguuuugugagugcaccccaacauuuucugggaaaaaguuuuuacauccaguuaggaugauucugaguuuuaagagcaguuaccuuacgaauauugauacugguucugcaaaugaugcgguaaagucccgaaugcacaucucugcuuugguauacuagcuugcaguagcaucuguugauuggauuuguagguggacuggcugacggagaaaaugagggaagccaacuucacuguauccucaaugcauggagacaugccccagaaagagcgggaguccaucaugaaggaguuccggucgggcgccaggugggucugcuaugcuguggcucugcaggucaggguuugcuagacugugucuaagcacuucauauguaccgccuaagugcaggccccacacccggggggaugccaagcuucugcucugaaagcugaggcccugggugagcagaaaaccuuccaguuaaggagggguccgcugugcuccuguaauacuuagguugaggugauaacuagccuuaacuagccagguuggucaccuugguuacaagcgugugucuucuuuuccaguaaguagggggguuuucuguucaucguuucgauuaguuuaauuccacaguggucagaaagcguggauugggugguuucauucauuugaacuugauucagacuuccuucuuugcccaccuuguggucagcuuaacauaugugcugugugugucuuuuuuuguuuguuuguuuuugagacagucucacuucguuacccaggccggagugcaguggcacaaucuuggcucacugcaaccucugccuccugauuucaagugacuccugugucucagccucccgaguagcuggaauggcuaauuuuuuuuuuuuuuuuucauuuuuaguagagaugggguuucaccauguuggccaggcuggucucgaacuccugaccucaggugauccaucugccucagccucuggcagugcugggauuacaggcauaagccgccgccaugcccggcugaaguuaccguuuuuaauuuuuugcuaggcaaaagugaaguauuuuucccaauuauugguuuaggaccgauuaaacaaguuaaagauagucuaguaaaagaugucuauuuuuuuaaucugauggagcacaugaccgaaguaacuaaauccaccaacagccccucugcacagggguuucuggugcugucccugaggcuucacguuugcagacagacuguugagagaggagaaucucguauauuuuggaccugcagccaggauuccuuaaaauuagcaauggaagcaaguccagucuuacacuuguaugaguaauuuaaucgccucaaacacucuuucuuuuugcagccgagugcuuauuucuacagaugucugggccaggggguuggaugucccucaggugucccucaucauuaacuaugaucucccuaauaacagagaauuguacauacacagguaaggugcaagcucucauuggcuucacuucugugacacauuuacuaaaucuugauuguuauauauacuaacuguaauauuauuuuauuccugaagaauugggagaucaggucgauacggccggaaggguguggccauuaacuuuguaaagaaugacgacauccgcauccucagagauaucgagcaguacuauuccacucagauugaugagaugccgaugaacgguaggaaaucguccagcucuacuguaauuguagagggaacuucccuauucuuaguuuggggcaccugaguuuguuuuuuuguuguuguggguuuuuuuguuuuguuuuugagacgaaguuucgcucugucacccaggcuggagugcaguggcgcgauuucggcucacugcaaccucugccuccuggguucaagcaauucuccugccucagccuccugaguagcuggaauuacagacacgugcaccauagccagcuaauuuuuguauuuuuaguagagacgggguuucaccauguuggccaggcuggucucgaacuccuggccucaaaugaucugcccaccucagccucccaaagugcugggauuacaggcgugagccacuaugucuggccuguuuuuuguuuugagaagucuguugugagguuuuaguuaaauuuacguuaacaaauuuucauuuuguuuguguuguuccuuaaucuguuucuuucuucacuuucaguugcugaucuuaucugaagcagcagaucagugggaugagggagacuguucaccugcuguguacuccuguuuggaaguauuuagauccagauucuacuuaaugggguuuauauggacuuucuucucauaaauggccugccgucucccuuccuuugaagaggauauggggauucugcucucuuuucuuauuuacauguaaauaauacauuguucuaagucuuuuucauuaaaaauuuaaaacuuuucccauaaacucuauacuucuaaggugccaccaccuucucuaguaacuua

SEQ ID NO: 192328 - RNA, 7176 nt, Homo sapiens
ggaaguggcuucgcuagggagccucccggcguggagauggcgggagcuggucgcggagcagcgguguccagggugcaggcggguccugggaguccccggcgagcgcgggggcggcagcaagugcagccgcuggggaagcagcgcccagccccguggcccgggcuucgcaggugacugcgcugccccgcgaggccgccacacuuccccagagaaggggacgccuugaaggcuccgcccgggacccccuagggagcguucgcucggaccccuuccccaggucgggcucagugcccuccucugucugugcccgcggcccacgcuccgccaggaucgguugaaugaauggaggcgcgagcgaguccuugguuuugccuuucccgcgucccagugucccgucuuugugguucuggacgaggucagggcggaaaggccuccugggcuuucggagugccuuucggccucgcgucccgugaggaagggguucagggacagccacugagugagaccgagaggaaagaucccugcucccuggacugcuggaccggcucgcaccacagaagccagauguggccccuguauagauagauucuuuuuuuuuuuuuuuuuuugagacggagucucacucugucgcccaggcuggaguguggagugcaguggcgcgaucucggcucacugcaagcuccgccucccggguucacgccauucuccugccucagccucccgaguagcugggacuacaggcgcccgccaccacgcccggcaaauuuuuuguauuuuuaguagagacgggguuucacuguguuagucaggauggucucgaucuccugaccucgugauccgcccaucucggccucccaaagugcagggauuacaggcgugagccaccaagcccggccagcccguguagauucuauugccagacccaacuauuguuucucuuacugauucugcuugugcuuuacuugggacgggucucacccccguguucuuucucccagcaaagagaagaagaaagugaacugcaagcccaagaaccaggacgaacaggagauuccuuuccggcuccgggagauuaugaggagccgccaagagaugaaaaacccgaucaguaacaagaagaggaagaaagcaggugugugcaggcccauacugggcggcagugaagcuuugugugucucaacccgcccaaucgcccaaauacuucagaacguuucaggcagaggaaauaugccaagacccggugcucagaaggugggggagcguggccaaagcuaaagcaguggcuggcagcugguggcgcugugguuccagacgaggcuuggaaggaggcuguggggugggcggggaggacccguuauggggccucaggauccaugcuaaggagcggcguuuuuuucuccccaaaaguagcgaagauucaucagaguuuuuagcagggcacggccaauucauguuuacucuaagcaaaaaaagggucaccgagcgaugauggagugagggagaguggaccuggcaacuggcggggcuacugccagggagaagccaugauucuugggacaagagugcugaagcaaugguagagagaaguggguggagucaggagcugaaggaggaaauuccaucaggccccucugagaagucuugccuuccucccccaagucuggguaggguguccacauguccaccgcugcaacccagagguaacacucugggcauguugggaaacggaguccacuguguguauauuuugcuuauagacacauuucucuucccaaacguggcacugguuuuacagcaaagcuguuuuauaauuuguguauaaacuguaggcuucuuguuggggguuauauggcugccaaagggauagugagauagaggugaggaaggugcagggaggaggcgcacuggccuggguagcacauggcacguucugaaccgugcugcauugaauuggcaccuuuguuuguuuguuuauuuauuuauuuauugagauggagucuugcuuccucgcccaggcuggagugcaguggcgugaucugggcucacugcaaccuccaccuccuggguuuaagcaguucuccugccucagccgccugaguagcugggauuacagguaacgcaccaccauacccagcuaauuuuuugugugugguuuuuuuuuuuuuuuuugagacagucucccucuagcccaggcuagagugcaguggcacaaucucagcucacugcuaccucugccuccccugucccaguuccagugcaagcaauucuccugccucagccucccgaguagcugagauuacaggcacacgccaccaagcccagcuaauuuuuguauuguuaguagagacgagguuucaccauguuggccaggcugguuuugaacuccugaccucaagugauuuccccaccucagccucccaaagugcugggauuacaggugugagccacugugccuggccuuuuuuuuuuuggagacagaauaucggcucacugcaaccuccaccuuccagguucaagcaagucuugugccucagcccccccaguagcugggauuacaggccugugccaccaugcccggcucguuuuuguauuuuuaguaaaggcuggguuuugccauguuggccagucugguuucgaacucuggccucaggugauccgcccaccucagccucccaaagugcugggauuacaggugugaaccaccaugccuggcaauaugcaugucuucacauauuuaugaacacaaccaccugccuggcacuguccgccuccuguguucuacacucgcccgggguccugcgcuugcguucucaguggaugucauaggucugcccacguuucuuuuuugagauggagucucgcucagucgcccaggcuggagugcaguggcgcaaucucggcucacugcaagcuccgccucccggguucacgccauucuccugccucagccucccgaguaguugggacuacaggcgcccaccaccaugcccaguuaauuuuuucuguguuuuuaguagagacaggguuucaccguguuagccaggauggucugaaucuccugaccuugugaucugcccaucuuggccucccaaagugcugggauuacaggcaugagccaccgcgcccggcaggucugcccacguuucucuguguagcuccacugggcuucuuucggcagcugugcaauggagucugugggugaucagaggagaauucauucaaccagccaccuagggguggacauuagguuguuucugcuuuccuuuuucagcugugcugcaguggacaucugugacaggugccauugggcuggggggucacguccccggggaugccgggccgggcauucuacauccucuucagcugcugucguuggggugcuuccagccagccuggucuucccuuccuguggcuuugggaggggaaaugagcaugggucaccugccugccacugucugccuccugccuccucugaggccucccuuuguccucagcccaggugaccuucagaaagacauuggagaaggaagcaaagggagaggagcccgacaucgcaguccccaaguucaaacagaggaagggggagucugacggggccuauauccaccgcaugcagcaagaggcccagcaugugcuguuccucagcaagaaccaggccauccggcagccagaggugcaggcagcucccaaggagaagucugagcagaaaaaagcaaaaaaagcgugaguggaggcgggagggggaggggucugcccugggagccggagggaagacauuggguucccaugacggcccucugcagguacccuguuucauagccauggggcagccuggauucagggagaccaagccagagcccugggaguuggcgagucggagcauccagcugggagccagugaggguguggccuccaggaggcugcggaaccugggaacucugcggagaccucgcuugguccuugcuuucacaggaaaagcaccagaaagcccuagcccugugggaaucagcccugagggggucggucugagggugacgugcccagggguucuguuuccauuagaacagaaugucucucguccaagagacuacaccuuccuaauucucuaaaagcuuuggccgaguacaguggcucacgccuguaaucccagcacuuugggaggcugaggcagguggaucacgaggucaggagaucgagaccauccuagccaacacggugaaaccuugucucuaauaaaauacaaaaaaaaaaauuagccgggcgugguggugcaugccuguaauuccagauacuugggagccugaggcaguggaaucgcuugaauccgggaggcagagguugcagugagcugagaucgugccgcugcacuccagccuggugacagagcgagacuccaucucaaaaaaaagaaaaaaaaaaaaaagcuuugaagguuugagagguugcuuucagcucuguagauucccuguuucuggauuguuguauuacuuauaguuaccuuagccagugaaaguucaucacagagaacguggcccagauacagccuggcgccacggugaucuccagagcugucgcugaaggugaagcuuccagauucacauugagggagacgugauauacaaugcuuguuaggcccuuuagacacagcagcaccggaugggcuggaugagucucuguuggguggucuuuggcagccuucccagccuucgugcacaaggugccaguagcccuugcccacgugucugcacacauugucagauguucccuggcagguagcuguccccagcugagaaccacugggggaccugugaggggccuguuggggucagagccuucuuuggugggcagcuguggguuuuggggugguaaggggagcggggacuuggaggcagccaccuguucuugggucccugcucugccacaggggaucccuuguggguggggcggccucugccuccucccuggguggaaagagaauuuaggaaucugagugacaugugcuuucuuccccagguuccagaagcggcgacuagauaaaguccgacggaaaaaggaggaaaaggcggcagacaggcuggagcaggaguugcuccgagguagcucuucccaaagcgauggugucagcagugguccggguggggccugggcgcaggccuucuguuccccaccagcccuggcugcacugggcaccugugguuuccccugggguccacagccauuagaccacuggaugaguugguguucugucccagcccuaugggagggaggugggcgggugguggcucugggugucaggggugcaguggcugugggcagcaguccucaguuguauucugcuccuccagacacggugaaguuuggugagguuguccugcagcccccagagcugacugccaggccccagaggagcguaagcaaggaccagguaaguggggcacggggacaacuugaguuugucccccagugcugccagggaacagaagccuuggacaggcuggacacggugggucacaccuguaaucccagcacauugggaggccaaggcaggcggauugcuugagcccaggaguugauaccagccuggacaacauagcgagauccugugucaagaaaaaaaaaaacccucagccaacgugugcgcugucugguguguggccugagagugcaguguucucgcuggcgggagagcuguugaagcugugaggcuuucuguugcauccccuccuuucccagccugugccucacccuccccucucucccucagccuggcaggagaucgcagaugcugcggaugcuucugagccccgguggugugucccagccucugaccgccucccuggcccgccagcggauuguggaggaggagagagagcgggccgugcaggccuacagagcguugaagcagcggcagcagcagcugcacggggagcgaccccaccucacuucccggaagaagccagagccgcagcugugauggagagacacccggggccuggccacgcucuggggcaacuggcaccaggagcugcuacaccuggguaggagagaggcaggccaugccagcaguguggggugaggccuccagcuacuuguucacacguugggcacuaguggguccacaucuugcagggggugagugcccgauggacuagggccaaggccugguugacagacggcccguggggcccggugucacucacagcuccaucucuuuguuuugaacguccauucugagucucagcccagguggaccuuaggaagggcuggaucccugucccugaacaccaaauaccgagacagcugaugaggcuggcucagugugugacggaggcccccgggagucagcagagccgagcguacagugcacaucaggcagagcaggccacgggcagggacgacgcaucgggacagggcucugcaggggaccgugacuacaggccagcugugagugguccccuacagaggcugcccacccaagguuugguuggggugaaacaugaugacaacacauacacuuaagaaggugggaaccgggggccgggcgcgguggcucacaccuguaaugccagcacuuugggcagcugaggcgaguggaucaccugaggucaggaguucgaaccagccuggccaacauggugaaacugcaucucuacuaaaaauacacgaagaaaaaaaaaacagugggaacagaguugucaccuaccuaacagggcucugagagagccgggaggcccaaaguggcuggaagaagguaaaggaaaaauccugucuugggcucaaggucacagaguggggcccagggggaguuccugcugagggcagggccuugccaggcuucagucuccagugccaaaggaggaaaugcccaggcugucagcauuuccagaugagagcagaagggagaagcuuaaacccaagucacacauccagcaauggaguccgacagcccagcaccaucugggaacugagaagcaccucugcccggcccccacaccguguggaaagugaggagcaccucugccuggccgccaccccgucuggcaagugaggagcgccucugcccggccgcugugcaaccuuccaagugugaagugacagccuugugugugauguuuucugccuuccccaaguuugcacuuucgacauuaaaguuuacuuuuuaguuaaaaguuuuaa

SEQ ID NO: 192329 - RNA, 7176 nt, Homo sapiens
uuaaaacuuuuaacuaaaaaguaaacuuuaaugucgaaagugcaaacuuggggaaggcagaaaacaucacacacaaggcugucacuucacacuuggaagguugcacagcggccgggcagaggcgcuccucacuugccagacgggguggcggccaggcagaggugcuccucacuuuccacacggugugggggccgggcagaggugcuucucaguucccagauggugcugggcugucggacuccauugcuggaugugugacuuggguuuaagcuucucccuucugcucucaucuggaaaugcugacagccugggcauuuccuccuuuggcacuggagacugaagccuggcaaggcccugcccucagcaggaacucccccugggccccacucugugaccuugagcccaagacaggauuuuuccuuuaccuucuuccagccacuuugggccucccggcucucucagagcccuguuagguaggugacaacucuguucccacuguuuuuuuuuucuucguguauuuuuaguagagaugcaguuucaccauguuggccaggcugguucgaacuccugaccucaggugauccacucgccucagcugcccaaagugcuggcauuacaggugugagccaccgcgcccggcccccgguucccaccuucuuaaguguauguguugucaucauguuucaccccaaccaaaccuugggugggcagccucuguaggggaccacucacagcuggccuguagucacgguccccugcagagcccugucccgaugcgucgucccugcccguggccugcucugccugaugugcacuguacgcucggcucugcugacucccgggggccuccgucacacacugagccagccucaucagcugucucgguauuugguguucagggacagggauccagcccuuccuaagguccaccugggcugagacucagaauggacguucaaaacaaagagauggagcugugagugacaccgggccccacgggccgucugucaaccaggccuuggcccuaguccaucgggcacucacccccugcaagauguggacccacuagugcccaacgugugaacaaguagcuggaggccucaccccacacugcuggcauggccugccucucuccuacccagguguagcagcuccuggugccaguugccccagagcguggccaggccccgggugucucuccaucacagcugcggcucuggcuucuuccgggaagugagguggggucgcuccccgugcagcugcugcugccgcugcuucaacgcucuguaggccugcacggcccgcucucucuccuccuccacaauccgcuggcgggccagggaggcggucagaggcugggacacaccaccggggcucagaagcauccgcagcaucugcgaucuccugccaggcugagggagagaggggagggugaggcacaggcugggaaaggaggggaugcaacagaaagccucacagcuucaacagcucucccgccagcgagaacacugcacucucaggccacacaccagacagcgcacacguuggcugaggguuuuuuuuuuucuugacacaggaucucgcuauguuguccaggcugguaucaacuccugggcucaagcaauccgccugccuuggccucccaaugugcugggauuacaggugugacccaccguguccagccuguccaaggcuucuguucccuggcagcacugggggacaaacucaaguuguccccgugccccacuuaccugguccuugcuuacgcuccucuggggccuggcagucagcucugggggcugcaggacaaccucaccaaacuucaccgugucuggaggagcagaauacaacugaggacugcugcccacagccacugcaccccugacacccagagccaccacccgcccaccucccucccauagggcugggacagaacaccaacucauccaguggucuaauggcuguggaccccaggggaaaccacaggugcccagugcagccagggcugguggggaacagaaggccugcgcccaggccccacccggaccacugcugacaccaucgcuuugggaagagcuaccucggagcaacuccugcuccagccugucugccgccuuuuccuccuuuuuccgucggacuuuaucuagucgccgcuucuggaaccuggggaagaaagcacaugucacucagauuccuaaauucucuuuccacccagggaggaggcagaggccgccccacccacaagggauccccuguggcagagcagggacccaagaacagguggcugccuccaaguccccgcuccccuuaccaccccaaaacccacagcugcccaccaaagaaggcucugaccccaacaggccccucacaggucccccagugguucucagcuggggacagcuaccugccagggaacaucugacaaugugugcagacacgugggcaagggcuacuggcaccuugugcacgaaggcugggaaggcugccaaagaccacccaacagagacucauccagcccauccggugcugcugugucuaaagggccuaacaagcauuguauaucacgucucccucaaugugaaucuggaagcuucaccuucagcgacagcucuggagaucaccguggcgccaggcuguaucugggccacguucucugugaugaacuuucacuggcuaagguaacuauaaguaauacaacaauccagaaacagggaaucuacagagcugaaagcaaccucucaaaccuucaaagcuuuuuuuuuuuuuucuuuuuuuugagauggagucucgcucugucaccaggcuggagugcagcggcacgaucucagcucacugcaaccucugccucccggauucaagcgauuccacugccucaggcucccaaguaucuggaauuacaggcaugcaccaccacgcccggcuaauuuuuuuuuuuguauuuuauuagagacaagguuucaccguguuggcuaggauggucucgaucuccugaccucgugauccaccugccucagccucccaaagugcugggauuacaggcgugagccacuguacucggccaaagcuuuuagagaauuaggaagguguagucucuuggacgagagacauucuguucuaauggaaacagaaccccugggcacgucacccucagaccgacccccucagggcugauucccacagggcuagggcuuucuggugcuuuuccugugaaagcaaggaccaagcgaggucuccgcagaguucccagguuccgcagccuccuggaggccacacccucacuggcucccagcuggaugcuccgacucgccaacucccagggcucuggcuuggucucccugaauccaggcugccccauggcuaugaaacaggguaccugcagagggccgucaugggaacccaaugucuucccuccggcucccagggcagaccccucccccucccgccuccacucacgcuuuuuuugcuuuuuucugcucagacuucuccuugggagcugccugcaccucuggcugccggauggccugguucuugcugaggaacagcacaugcugggccucuugcugcaugcgguggauauaggccccgucagacucccccuuccucuguuugaacuuggggacugcgaugucgggcuccucucccuuugcuuccuucuccaaugucuuucugaaggucaccugggcugaggacaaagggaggccucagaggaggcaggaggcagacaguggcaggcaggugacccaugcucauuuccccucccaaagccacaggaagggaagaccaggcuggcuggaagcaccccaacgacagcagcugaagaggauguagaaugcccggcccggcauccccggggacgugaccccccagcccaauggcaccugucacagauguccacugcagcacagcugaaaaaggaaagcagaaacaaccuaauguccaccccuagguggcugguugaaugaauucuccucugaucacccacagacuccauugcacagcugccgaaagaagcccaguggagcuacacagagaaacgugggcagaccugccgggcgcgguggcucaugccuguaaucccagcacuuugggaggccaagaugggcagaucacaaggucaggagauucagaccauccuggcuaacacggugaaacccugucucuacuaaaaacacagaaaaaauuaacugggcaugguggugggcgccuguagucccaacuacucgggaggcugaggcaggagaauggcgugaacccgggaggcggagcuugcagugagccgagauugcgccacugcacuccagccugggcgacugagcgagacuccaucucaaaaaagaaacgugggcagaccuaugacauccacugagaacgcaagcgcaggaccccgggcgaguguagaacacaggaggcggacagugccaggcaggugguuguguucauaaauaugugaagacaugcauauugccaggcauggugguucacaccuguaaucccagcacuuugggaggcugaggugggcggaucaccugaggccagaguucgaaaccagacuggccaacauggcaaaacccagccuuuacuaaaaauacaaaaacgagccgggcaugguggcacaggccuguaaucccagcuacugggggggcugaggcacaagacuugcuugaaccuggaagguggagguugcagugagccgauauucugucuccaaaaaaaaaaaggccaggcacaguggcucacaccuguaaucccagcacuuugggaggcugagguggggaaaucacuugaggucaggaguucaaaaccagccuggccaacauggugaaaccucgucucuacuaacaauacaaaaauuagcugggcuugguggcgugugccuguaaucucagcuacucgggaggcugaggcaggagaauugcuugcacuggaacugggacaggggaggcagagguagcagugagcugagauugugccacugcacucuagccugggcuagagggagacugucucaaaaaaaaaaaaaaaaaccacacacaaaaaauuagcuggguaugguggugcguuaccuguaaucccagcuacucaggcggcugaggcaggagaacugcuuaaacccaggagguggagguugcagugagcccagaucacgccacugcacuccagccugggcgaggaagcaagacuccaucucaauaaauaaauaaauaaacaaacaaacaaaggugccaauucaaugcagcacgguucagaacgugccaugugcuacccaggccagugcgccuccucccugcaccuuccucaccucuaucucacuaucccuuuggcagccauauaacccccaacaagaagccuacaguuuauacacaaauuauaaaacagcuuugcuguaaaaccagugccacguuugggaagagaaaugugucuauaagcaaaauauacacacaguggacuccguuucccaacaugcccagaguguuaccucuggguugcagcgguggacauguggacacccuacccagacuugggggaggaaggcaagacuucucagaggggccugauggaauuuccuccuucagcuccugacuccacccacuucucucuaccauugcuucagcacucuugucccaagaaucauggcuucucccuggcaguagccccgccaguugccagguccacucucccucacuccaucaucgcucggugacccuuuuuuugcuuagaguaaacaugaauuggccgugcccugcuaaaaacucugaugaaucuucgcuacuuuuggggagaaaaaaacgccgcuccuuagcauggauccugaggccccauaacggguccuccccgcccaccccacagccuccuuccaagccucgucuggaaccacagcgccaccagcugccagccacugcuuuagcuuuggccacgcucccccaccuucugagcaccgggucuuggcauauuuccucugccugaaacguucugaaguauuugggcgauugggcggguugagacacacaaagcuucacugccgcccaguaugggccugcacacaccugcuuucuuccucuucuuguuacugaucggguuuuucaucucuuggcggcuccucauaaucucccggagccggaaaggaaucuccuguucguccugguucuugggcuugcaguucacuuucuucuucucuuugcugggagaaagaacacgggggugagacccgucccaaguaaagcacaagcagaaucaguaagagaaacaauaguugggucuggcaauagaaucuacacgggcuggccgggcuugguggcucacgccuguaaucccugcacuuugggaggccgagaugggcggaucacgaggucaggagaucgagaccauccugacuaacacagugaaaccccgucucuacuaaaaauacaaaaaauuugccgggcgugguggcgggcgccuguagucccagcuacucgggaggcugaggcaggagaauggcgugaacccgggaggcggagcuugcagugagccgagaucgcgccacugcacuccacacuccagccugggcgacagagugagacuccgucucaaaaaaaaaaaaaaaaaaagaaucuaucuauacaggggccacaucuggcuucuguggugcgagccgguccagcaguccagggagcagggaucuuuccucucggucucacucaguggcugucccugaaccccuuccucacgggacgcgaggccgaaaggcacuccgaaagcccaggaggccuuuccgcccugaccucguccagaaccacaaagacgggacacugggacgcgggaaaggcaaaaccaaggacucgcucgcgccuccauucauucaaccgauccuggcggagcgugggccgcgggcacagacagaggagggcacugagcccgaccuggggaagggguccgagcgaacgcucccuagggggucccgggcggagccuucaaggcguccccuucucuggggaaguguggcggccucgcggggcagcgcagucaccugcgaagcccgggccacggggcugggcgcugcuuccccagcggcugcacuugcugccgcccccgcgcucgccggggacucccaggacccgccugcacccuggacaccgcugcuccgcgaccagcucccgccaucuccacgccgggaggcucccuagcgaagccacuucc

SEQ ID NO: 192330 - RNA, 17511 nt, Homo sapiens
gagccucgaaguccgccggccaaucgaaggcgggccccagcggcgcgugcgcgccgcggccagcgcgcgcgggcgggggggcaggcgcgccccggacccaggauuuauaaaggcgaggccgggaccggcgcgcgcucucgucgcccccgcugucccggcggcgccaaccgaagcgccccgccugauccguguccgacaugcugcgccgcgcucugcugugccuggccguggccgcccuggugcgcgccgacgcccccgaggaggaggaccacguccuggugcugcggaaaagcaacuucgcggaggcgcuggcggcccacaaguaccugcugguggaguucugugagcgccgggccuggcgggcgggcggggcucggggccgcugagccaggcucuugggacgcaggcacggcccggcagcccccggggucgggacccccggcgcgcccggaacugaagggcucccuugcugcccgccuugggggccaugucaggggcucccugggggugagagccgggcugggagccggggggccgucccgaugcccgcccugcgcacggcaggaucuuccuguuagugcgagaagaacaggaucgaccugugugagcaaacagagcaagccaguguccagccuugccgaguccuccccgggggccgacccggaaggcgccccgcuccugcccaccccaccuucagcuugccacagcaguccuuccgauggugucucagaggagaaucccaagccuuccucacguccauaaggauuugagcucugucccuggggugggaaccuugugccugacacagcugcuaacucuauugacagaucgucuuauucucacccuaagcaacucagggucugugugcacggaugugcaucucauacucacagcuagugcugguacaggccgccacggucacuucuucacuuuugucuguagucuuaaagggaaagucuaggggagauccuugccuuaguugccuguggggaauaagaagucagcaaccauugaaagguuugucuggcugugcugauggugacauagcagagugggggcugguguugguuggugguaguuugucguucacggccucuguccugauauugcccaagaacaccaggcuaucagcucagccuugugcguuaggagggguuaucuuggugaguagauaagguuuuuaugaagggaaaugccagaggaaaaagggaagcacugcugagggaucaaggcugcuuuagggaucaaggcugcuuucuagcaucucauuuccgcuuccagaugccccuugguguggccacugcaaggcucuggccccugaguaugccaaagccgcugggaagcugaaggcagaagguuccgagaucagguuggccaagguggacgccacggaggagucugaccuggcccagcaguacggcgugcgcggcuaucccaccaucaaguucuucaggaauggagacacggcuucccccaaggaauauacagguguggcuguggcacugcccuugaacugucuuuagagagggacuggccugccgacuuggaagggcaggggcagcugucugagcgguggggaggccggguuccagaggcuuggagggaucccguuccucaggccggguucucuguccacuugugcccugagggucuugugaggaguuuucauccuggaagaaccuucgaauggagaaccugucuugucuggugccauccugggggcggcuggcugaggucuguuuggagacugaccagcgaggagagggagacuggugccuuucuggccacaugggcuguuugugcugcccccuguuccuaggagcagcagcauggcuguagcucucggggugacaccugcuagcugucguguguagcgugccagcugccgcgucacgugcuugcgugauuucuccucgcauccucucugugaggcgggcuuuucccagacaaagggcugaggcuuagagcagcugaguaacagcaucgagccugucgguagcagaccucgaauccaagcccgcccugcuccgucuguagcacgggcccucagcugcucgucugccgccucugaagcugccguaguggaggccgagccccuguguagccagaucagugacgguggcaaaagaaaacucgucuauaaaaccgguucuguggcaugucagaugcucaugguggguagcccgaaagcagcucauuccaguguuagcaggguucuccccuuaagcaggugugcccuguccuguucuaguggcagcaacuccgugguugccucucacuuggcuguuuugauguuuccuuuuguccccuuaagcaggugugcccuguccuguucuaguggcagcagcucugugguugccucucacuuggcuguuuugauguuuccuuuuuuuuuuuuuuuuuuuuuuuuugagacagucucgcucugucgugcaguggugcgaucucugcucacugcaaccucugccucccggguacaagugauucuccugccucagccucuugaguagcuggggcuacaggugugcaccaccacgccuggcuaauuuuuguauuuuuaguagagacgggguuucaccauguuggccaggauggucucgaucgugaccucgugauccacccgucucggccuccuagagugcuaggauuacaggcgugauugauguucucauuuuuuacucauguucacuuuuggaacgggaagugcucuguccaaagucaccgugguucugucacuaacacucagguuugcagaugagaugagcacuccuaaauccacuugucacuggugaccgucuuguuagcacugguggaauccuucuacaucugaaugggguuuucccgauucggaccagggagucaaguucuaggagggaaaaaggagaggcaucauuccuuagccucagucucccaggaggaggaaguuucuuuccugucaguugaccgccuuugguggcauaaaagugugucaucuucuuccuggucugggaggcauggagggugggccauuggcgagaacucccgaaacgccugggauaaguuaggaggcgcgggagucaggugggcggggcgucagccuguucccagagguagaaaacuggcacugaguuuugaguuacuguccaccucucuaaaaugaggccugcugucagacuccugggugagaacauguguuugauggauguacaugucaaagaaaauuuagauaacgcagaggacaggcugggugcgguggcucaugccuguaaucccagcacuuugggaggcugagacggguggaucaccugaggucaggaguucgaggccagcauggccaauauggugaaacccccgucucuacuaaaaauacaaaaauuagccgggcgugguggugcacgucuguaaucccagcuacuugggaggcugacacaggagaaucccuugaaccugggagguaagguugcagugagcugagaucgugccaccgcacuccagccugggugacagagugagacuucguuucaaaaaauaaaauuuuuaaaaugcagagggccauccugggcaacauggugaaacccugucuacaaaaaauacaaaaauuagcuagggcugggcacagugguucaucccgguaaucccagcacuuuggaaggccgaggugggcggacugcuuaaucccaggaguuugagaccauccuaggcaacguggcaaaaccccaucucuacaaaaaauagaaaaauuggccgggcaugguggcucacgcauguaaucccagcacuuugggaggccgaggcgggcggaucacgaggucaggaguucaagaccagccuggccaacacagugaaaccccgucucuacuaaaaauacaaaaauuagcugggcaugguggcgggcgccuguaauaccagcuauuugggaggccgaggcaggagaaucacuugaaccugggagauggagguugcagugagccaggauggcgccacugcauucuccagccuggacgacagagguagauuccgucucaaaaaaaaaaaaaaaaaagaagaaacauugcugggcgcaguggcucaccucuguaauccuagcacuuugggagaccgcugaggcagguguaucaccugaggucaggagugagaccagccuggccaacauggggaacccugucucugcuaaacauacaaaaauuagccgggugugguggcgggcaccuauaauccuagcuacgcgggagggucaggcaggagaauugcuugaacccgggagguggagguugcagugagccgagaucacacuauugcacuccagccugagcaacaagagcaaaacuccgccucaaaaaaaaaaaaaaaaaaaaguuaguugggugugguggcacaugccuguggucccagcuacuugggagccugagguaggaggauugcuugagcccagaaguucgagguugcagugagccaugaucaugccacugcacucuaaccugggugacagagcaagacccugucuuccaagaaaaaaaaaagggcugggauugguggcucaugccuguaaucccagcacuuugggaagucguggugggcaaacugcuugagcacaggaguuaaagaccagccugggcaacguggcaaaaccccgucucuacaauaaauacaaaaaugagcugggugugguagcgugcaucuguaccccagauacucaggaggcugagguugggaagauugcuugagcccaguggguggaggcugcagugagccaagauucugccacuacccuccagcuggguaacagagugagccccugugucaaaagaaaaaagaaaaugcagagagaucagagaaaaaaaauggguuugugauccuguuauucagagacagaaucacccucuucccucuccacuccccauaaacacaaccacagucucacguacacugggguuuaggaggcgggcggacggcaccgggccucuuccauggugggagaacaucuuacuuagguugauucagguguccucagccuggcuggcagagagcagagacgggagcaggcgcggcagggcaggcggcacucccuguuugagaguagaaccuacauuuguuugggguuagcuggcagagaggcugaugacaucgugaacuggcugaagaagcgcacgggcccggcugccaccacccugccugacggcgcagcugcagaguccuugguggaguccagcgagguggcugucaucggcuucuucaagguagagaccagagcauuccagucuuccuuccuuccgucauccauugaggagggguccacagccugcagcuggcaguucugcacguguccccccuggccugggcucuacagggucugcccuacugcuuggugcugcgggaucaugacgaccucugcuucucccuccucauucaggacguggagucggacucugccaagcaguuuuugcaggcagcagaggccaucgaugacauaccauuugggaucacuuccaacagugacguguucuccaaauaccagcucgacaaagaugggguuguccucuuuaagaaggugaguggccccaggcagcucugcccagguuaguucugggguuggucugcagaggguggcguugcucuccuuaucguuaagggaaccuugcuccuggcaccuuuggcccaauagguauguucugcagcuuugccaaguugggguguugcgcugaugccuguggccuggucuucgcauucagcugugggcuuucuggccacucuccugccacagccgccucagaacugcuuuugacuguuagcuuuuuuuuuuuuuucaauuaugauaaaacauguaacaacauuugcccuuuuuuuuuuuuugggagagucuugcucugucacccaugcuggagugcaguugcgugaucucggcucacugcacccuccgccuccuggguucaagugauucuccugccucggccucccgaguagcugggacuacaggcaugcacuaccaugcccagcuaaucuuuguuuuaguagagaugagauuucaccauuuuggccaggaugguaucaaucucuugaccucgugauccacccaccucagccucccaaagugcugggauuacagaugugagccaccgcgccuggccccguuugccuuuuuuuuuuuugagauaggguuucucacucugccgcccaggcuggagugcgguggugcauucuuagcucacugcaacuucugcuucccaggcucaagugauccucuaaccucagccucccgagcagcuggaacuacaggcgcgugccaccacgcugggcugaguuuuuguauuuuuugguagacaugggguuuugcuguguuguccaggcuggucuugaacuccugagcuccgaguggucugccugccucagccucccaaaauggugggaucacaggcgugagccaccgcgcccggccacguuuuaacuauucuaaaguauuaacuacauucagagcguccugcagcaucccuauuuccagaacguuuuccuuacccagaggucuggaguauuggcgcucugggcguguucccacccagguggcacccacacuucguaugccccucagccccaagggcauuaugaccccuaaggauccacugugaaaacugccauccugaucccgcuguccuucuccuggggaagggcuccuggacaguguggccucuuagccgccucuccccguuaccaggacacagcaggguccuuguuugcacagugucaagauggggccuguggguuucuauugucucuuuucucggucaccaggcagguggggcuggggccgcacacuugugcucuagggacagcugaaccuggaugugggugaugguggguuugugccgcucagagccaggguaguguggauaggagagaaagucucgggagaggagggaccuggggagugaggggcaggagggcggccgggggcgaucggaccuucagcuccuguccugugucguuuccagaggggagaagaaccuuuuagacagcagcaucauaagccaaacggucagacgggcagccucugggauuggggcugagugguuuuggacacaaggaacccauucacuuucuuuuuuuuuuucuuuuucuuuuuuugagacagagucugucucugucgcccaggcuggagugcaguggcgcgaucucagcucacugcaagcuccgccucacggguucacgccauucuccugccucagccucccgaguagcugggacuacagggcacccgccaccacacccagcuaauuuuuuuguauuuuuaguagagacgggguuucaccguguuagccaggguggucucgaacuccugacuucaugauccgccugccuuggccucccaaagugcugggauuacaggugugagccaccgacccauucacuuucuguaguaagcacggagcauccagcacuccccgggaccagguaggagggaggguagagccagcuuccuggagcgcgguggugcgggugggucaggauggcuugcuuccauguucuuguucuugucauuuagcuguuuuugcagccacuuccucaagauaacucaagacaguagaugcucuuuaccaggagacauucucuugauguccccugaagggaagagaguugcuaaauuagucuauugccauugcaaggugcccaggaaauuaaaccucugacuagaaaaagccagugaaguguuggauaaaguugaaggaaccaaaggucuuuuuagagcuuuuauuaaagagaaaguuccaagucuuguccugaaacuuggguucuggggcagacuuucuccagagcccacgaaacucgcgaacccuguguugucacacagcccacagcuccuucagugcccuggaugucugcaguggccgcugugacucuauggacaguuuggugauauguguccgcgaaggcugggagggugguuucguugcucuugccugcaaaggcucacacguggccauccaugugggcuccccacagguuaacguucugucuccauucucuggaguccacuagagcugggcacagacaaacccacuuggguuugaugccaguugguggguggcgcuuuccugcccacugaagguggcucaggugucugugauggcgaacguggucguugcaggcagcuccgggcagaagcccggcccccuguccggugcacgugguaggggcugcccuggaagucagagcucaccccgcagcugagaggaugaguccaacuuguuccuuuuccaccaggcuguuaacccccaucccucaaagugagugaggccuuccugugugugcaguggccacagugggcagccuggcugagucgggugcucuuguguggcccgcucuugccugcucuucccuuccuucccuagcaggcacugcaacccaggaaaaccucugcgggggcugcuggucacuggcaccaugggugugagagcuucugauauuucacuuuuucuucucccccagcuggcagcacugggccuguuauuguuguuugagaaagggucucgcucuguuaccaggcuggagugcgguggcacaaucacacuucacugcagcuucgaccuccugggcucaagcaguccucccaccccagccugcugaguagcugggaccacaggugugcaccaccgcaccuggcuauuuuuuaauacuucuguggaaaugggguuucaccguguugcccaggcuggucucgaacuucugagcucaagcaauccuccugccucagccugccaaaacauugggguuacaggcgugagccauaccacccggccugcauugggcguuucuaugcuguuugucaccguggccuggcagggcuggccuccugcugcugugcccugcuaaguggaccaguuucccuuaccgcaguagaccgugauugagugugguguagcaucucugcugaaacgauggcagcccugggacagcugcggcagugucuccuccuggcuucuuggcaugagaugguguaggcggcgccugacacucuggagggagucagagacauuguucugcagggguggggggauuucguuugccugcaguugcggcccggcguuacuccugggcacagugcgagcccacccgugccacugggagcacggcugugaucagcagcucauguuccaaaggauucccuccaagggccuccugaacuuggcuuuucugccucuccuuacccgccuuugccccucuggggaagagguagcaggcuuagaagccucugccccucggguucgggcagggugguuggugcuugugcccugguuuaacaucagcuccuuggcagucaggccaggccaggguggcccaggcacagcgugcacaagagcagggaguggcaccuggucucuaaguuacucugcagacgcauacauggaaacggccaguaagaaaggaugcgugauuuauuuccccaagucucauuuaagaaguuugaggaggccgggugcaggggcucaugccuguaaucccagcacuuugggaggcugaggugggcgggucacgaggucaggagaucgagaccauccuggcuaacacggugaaaccccgucucuacuaaaaauacaaaaaauuagccgggcgugguggcgggcaccuguagucccagcuacucaggaggcugaggcaggagaauggcgugaacucaggaggcggagcuugcagugagccgagaagcaccacugcacuccagcguaggcgacagagcaagacucugucucaaaaaaaaaaaagguucaaggggaccaggcuugguggcucacaccugugaucccagcacuuagggaggccaggacaagaggauugcuugaggccaggagucugagaccagccugggcaacauaguaagacugucucuacaaaaaguaaaaauaaaauaaauuuuuuuggcuggacacgcuggcucacgccuguaaucucagcacuuugggaggccaaggcgggcagaucaccugaagucaggagcuugagaccagccugaccaacauggagaaaccccaucucuaauaaaaauacaaaauuugccaggcguguuggcacaugccuauaaucccagcuacuugcgaggcugaggcaggagaauuacuugaacccaagaggcggagauugcaaugaggcaagaucgagaucgugccauugcacucuagccagggaaacaagagcaaaacucagucucaaaauagauaaaauaaaauaaaauaaauuaaauaaauaaguauuuuaaaaaguaguucuguccaggugcaguggcucacaccuguaauuccagcacuuugggaggccgaagcaggccgaucaccugaggucgggaguucaagaccagccugaccaacauggagaaagaaacuccaucucuacuaaaaaaacaaaauuagccaggcgugguggcgcguaccuguaaucccagcuacuugggaggcagaggcaggagaauugcuuuaacccgggaggcagagguugcagugagccaagauccugccacugcacucuagccugggcaacaagagugaaacuccgucucaaaaaaaaaauaaaauaguuugggccgggcucaguggcucacacuuauaaucccagcacuuuaggaggccgaggcaaguggaucaccuggggucaggaguucaagaccagccuggccaacaugguaaaacccugucucuacuaaaaauacaaaaauuagccaggcgugguggcgggugccugugaucccagcuacucgggaggcugaggaaagagaauugcuggaacucgggagguggagguugcagugagccgagaucaugccauugcacuccagccugggugacaauagcaaaacuccgucucaaaaaauaaaaaaauaaauaaauuuuaaaaauaaauaaaaaaguaguucgggggaaugauggaaggcucacccaaaauucucacuugaagagccucagcacaggggcgccucucugagccugagccgaggccgcauccucagcugcaggcugaccccucgugguuggggcgccacagccucuccaucuuguggccuuaggacucccugaagcugccgugcauuauuagggguccccagggccuuacaggcacguggauugcgccuuucaggaucuguuguauuagaaacuagaacuaagaauguaaaaaaucguuuuuuucucucuauuuauuuuuauuuuuuauuuuuugagaugaagucuugcucuguugccaggcucgaaugcaguggcacgaucugggcucacugcaaccuccgccuccuggguucaagcgauucuccugccucagccucccaaguaguugggauuacaggcacccgccaccacgcccagcuaauuuuuguauuucuaguaaagacgacguuuuaccauguuggauuaggcugcucugaaacuccuggcuucaggugauccgcccgccucagccucccaaaguacuaggauuacaggcgugagccaccacgccuggccuguuucacucgucacccaggcuggagugcaguggugcgaucucacugcaaugucuaccucccagacucaagcaauccuccugccucagccucccaaguagcugggauuacaggcaggugccaccauacccaacugauuuuuguauuuuuguauuuuuuuuuuuuuuugagacagagucuugcucuguugcccaggcuggagugcaguggcacgaucuuggcucacugcaaccucugccucccggguucaaguguuucuucugccucagucucccgagcagcugggauuacaggugugcaccaccacacccagcuaaauuuuuguauuuuugguagagucgagguuucaccauguuggccaggcuggucccaaacucgugaacucaagugauccaccugccucagccucccaaacugcuaggauuacaggugugagccacugcaccuggccuuuuuuuuuuuuuuuuuuuuuuuuuugagacagaguuucgcucuugucgcccaggcuggagugcaguggugcgaucucggcucaccgcaaccuccgccucccggguccaagcgauucuccugccucagccucccaaguaccugggauuacaggugcccgccaccacgcccagcuuauuuuuguauuuuuaguagagaugggguuuuaccguguuggccaggcuggucucgaacuccuggucucaagcgauccacccaucuuggccucccaaagugcugggcuuacaggccugagccacuguagccaaauuuauuuuaaaagaauaauaaucccauuacauguuaucauaaaucacaucuuuacggaaacuaguuugucccagacaaaaacaauuuagugcugagugauguuuuagauuccuccagcaggauucuccucuccugcccuccugcucuugcgacaccaugcgcccagcagccucugugggucugugccgcagcacgugagagggagagugaaaaggcagaggccagagaagugugagugugaaaauagcuuugaccagccgggcgcgguggcucacgccuauaaucccagcacuuugggaggccgaggcgggcagaucacgagguaaggagauugagaccauccuggcuaacguggugaaacccaucucuacuaaaaauaccaaaaauuagccggugguggcgggcgccuauagucccagcuacuugggaggcugaggcaggagaauggcuugaauccgggaggcggagcuugcagugaguggagaucacgccacugcacuccagccugggagacacagcaagacuccaucacaaaaaaaaaaaaaaaaagaucaagaccuucguggccaacaugguaauaccccaucucgacuaaaaauacaaaaaaaaauuagccaggcaugguggcaggcgccuguaguccuagcuacucgggaggcuaaggcaggaaaaucacuugaaccugggaggcagagguugcagugagccaagaucaugccacugcacuccagccugggcaacagagcgagacugucucaaaaacaaauaaaaaagaaaauagcuuugaccacaugggugcccugaaaaggcuaggggcccuggggaugggccacacuucaagguugcuggaggaccacgugcgccaggcuugcauuguggaugugaagccagcuguugaauucacgggcagccauaaggccgugaccagagccagucuuacugucgaggaacagccauguccuguacccauugcuggaccuguggcucgaaaccccacgggagggcagggcugcuggcugcugugacuucccacguccagggagacccgggcccaggggcugugcucccagcagcaaugcucagucagggcccucuuucuguccacaguuugaugaaggccggaacaacuuugaaggggaggucaccaaggagaaccugcuggacuuuaucaaacacaaccagcugccccuugucaucgaguucaccgagcaggugcggcugcccugcagcccccaggcuggggauggggaggaguggguuggggguggcaugaggcucccggucaccacugcuguccagcgucugacauuggaggccauugggagaaucuucugcauuaauagugugugacucagacccaguaacuuaaguuuauaacacagacagccccgaagauuuuuggaggugaaaucaagacucacauccugcuguucuugcccaagagugugucugacuaugacggcaaacugagcaacuucaaaacagcagccgagagcuucaagggcaaggugagcugcucuucuggguggcucguggggcggugccagggagcaguacaacucuucccgaggugacaaguguggggccuuccugaggcugccugcuggacuggaucgggcaccugauucaggacagccuggauguaggcgaggggccagccaggccagaccucugcucccagucaccugcuggucugguugggcaaccccggaauccagguuggaggaaaaaggcaccggagcacggucugcuuccgagcaaagucagggcuggaggcagaggccagccgucucccgcaccugugcaaccuccuuuucucccccagauccuguucaucuucaucgacagcgaccacaccgacaaccagcgcauccucgaguucuuuggccugaagaaggaagagugcccggccgugcgccucaucacccuggaggaggagaugaccaaguacaagcccgaaucggaggagcugacggcagagaggaucacagaguucugccaccgcuuccuggagggcaaaaucaaggugcaggcgcguccccgggccagggcugccucccggguagagccgccaccuuggggucucugggcucucaguguccugggcuucguccucaaaguaagaucuucagaguaagaggacggagcccaagauggugugaagaccaccauucuugucacaccuuuggggaccuguaggagcccucuuguccacacggcuggcccagaugcuccucagggaaaccuccuggccggcgagggugcggccugcgugggcucauugggcccagcccacuggcccagccuucucuuucuggauucuuggcacuguuggugucugcggcugccacccuggugugcccagggcagccacgcaccucagucccgggcagggugaggguuggggagcucuguggucccccaggcaucgccgccccucaccgugcccugccugcccuccagccccaccugaugagccaggagcugccggaggacugggacaagcagccugucaaggugcuuguugggaagaacuuugaagacguggcuuuugaugagaaaaaaaacgucuuuguggaguucuguaaguguugcccuuucagcuccccagguccgugccaccagggcacgcgcaagguaggcagacuccuggggaagcgucugccaguggcuuuguguccaggacacacccuagaacugcuuucuuuucagaugccccaugguguggucacugcaaacaguuggcucccauuugggauaaacugggagagacguacaaggaccaugagaacaucgucaucgccaagauggacucgacugccaacgagguggaggccgucaaagugcacagcuuccccacacucaaguucuuuccugccagugccgacaggacggugcgccuucccuccagacggggcuggggcgggcucugggaagagcagugguccccacgccagccugggugccucucuggaaggagccuggggcuagucaggugggagaagagcugugggagcuccuucagaagcacccaccuuuguuuuucgagagagaugggaucucacuauauugccuaggcuguuuuugaacucccaaugugcuggauuccgggugugagccaccggaccgggccugcucugccuuucucuagggaggaggagccaaugccaggagauuggcucugggccgggaccagccccugcacucaucccugucuuccacaggucauugauuacaacggggaacgcacgcuggaugguuuuaagaaauuccuggagagcgguggccaggauggggcaggggaugaugacgugaguggggucacagcccugggcuggucucugggauucagccccuuggccccacgggacaugcccacuugggcucggcuugugaugggaauggugccauuggaggcacgucugugcguccagggcucuggggccccacaccuucgcccagcagggcaagggaugugcucccagugcucugcugaaacagcucucccuggccagcacuucuuuaggggacgacguugaaggcaucuuuaaaaaccagauuuugcuuagaaaaccuuuucagacacauggcaccgguuccucacaugcugcuaacuuggacucagagguccauccccagcccgcuggcggggcccgggcacaagggcgcagacaugggucugcccucgggaguuuaguccugcccgucagcgcguggccagcagcaguggugacucugccggggaagcaggaaggcugguguugggaggaugcggcaggggcggggugcuugaccauggugaaggagaugagggcauggucagcccaggcuggcagggccugcugggagugcuggugcacagugggaggugggaauacucugcccaggcuggggauggagggccggccccuggugcugccuguggccugucauuggccagagcccaaggguuggaaguagaauggucacaccccaguggugacugugccuggacuucaugcuggggcuguugucccugccgagauguggacccucuguagacuccauggugccaagcugggagacacacauacgccuuccaugcccaguggaaggguccaaggcugagcugggauucccaggguuccugacacagugggggcucugauucauccugcuauaggcagaaaucccccaggcgucacucuuccugggaagaccccuguguagcucguaaagaccaggguuggcugcuccaguggccgguggccauguccgccguggccggcuaguccccggugugagcaguguggggugcugggggccggcagccucagcuguugcagccaaccugcccgccccgccccuuuuccuguaucccaggaucucgaggaccuggaagaagcagaggagccagacauggaggaagacgaugaucagaaagcugugaaagaugaacuguaauacgcaaagccagacccgggcgcugccgagaccccucgggggcugcacacccagcagcagcgcacgccuccgaagccugcggccucgcuugaaggagggcgucgccggaaacccagggaaccucucugaagugacaccucaccccuacacaccguccguucacccccgucucuuccuucugcuuuucgguuuuuggaaagggauccaucuccaggcagcccacccugguggggcuuguuuccugaaaccaugauguacuuuuucauacaugagucuguccagagugcuugcuaccguguucggagucucgcugccucccucccgcgggagguuucuccucuuuuugaaaauuccgucugugggauuuuuagacauuuuucgacaucaggguauuuguuccaccuuggccaggccuccucggagaagcuugucccccgugugggagggacggagccggacuggacauggucacucaguaccgccugcagugucgccaugacugaucauggcucuugcauuuuuggguaaauggagacuuccggauccugucagggugucccccaugccuggaagaggagcugguggcugccagcccuggggcccggcacaggccugggccuuccccuucccucaagccagggcuccuccuccugucgugggcucauugugaccacuggccucucuacagcacggccuguggccuguucaaggcagaaccacgacccuugacucccggguggggagguggccaaggaugcuggagcugaaucagacgcugacaguucuucaggcauuucuauuucacaaucgaauugaacacauuggccaaauaaaguugaaauuuuaccaccugu

SEQ ID NO: 192331 - RNA, 9443 nt, Homo sapiens
ggcggcggcggaucccgagccugguccggcccggccuucccagugcgcucggcccggcccgcgcaggcggcgaguccuccgagccccgggcccggaccccucgcgccggucccugccccgcgcggccucggagcgcgcgcggccccgccccgccccggccucggcccgccgggcccgcaguguggugagugcggcugcggcggcgggcccgggcggugggggcggcgcggcgggggcggcgggggccgagggggcgcgcaggcagggcuccucccggagcuaggcgggcgguugggggcccggcggcgggggccgcugguuucgggucugccgcgcacccugcuggcggcccgugccucgauuuccccagcggucaggagccagcuccuccugccccuggcgcccggguacuggaggugggccgcgggcggcggcggacccgcggagccgggcgagugcggagcggacucggagacccgggcguccuggagggaggggcacuggacggcgggaggaaaggguggggucgagcgaggcgcccggggguccgcgccagggcccggcggcccggcccgcagcugcugauucauccgguggccgcgucagcucuccccggcgcggggguccgcggcgagcccgggaggaggggcggcgaugggggugcugcggggaagacccugccccuggcuggggcucggguuccgucagucgcgugccagagcccggagggagacuugcugagucaucagcgugaggucacucggugcucaagcugauaccggaggggauucgagcgaggggccucggggacuaaaaggccgccagcgggaggugggagggagccguggggaugugggagggggccaggcccggcgccuuggggugccuguuuaagugagcgccgagcgauccaguugaaggcaggggugcuugaagaggaaguggggguggcucgcugcagguguucucccggggucaaaggugaagccccgggcgguccaccccuucccaggcggcucuuuuccggcagcugguccuggucccaagucuggagcaguuuuccaaacugggaaauaguucccugagugagggaggggaggagcuucggugggccgagcuagccaaaggggaagucggcuuucccugggacuggccugguuggacagccccuggccagagaucgagguccugggagaaagagggguguguguaccaagcccugggugacagugggcugggcagggaggaagcaggggcagcucuaccaggaaacggcaaaggggaggaagcagcccagccucucuccccaguuggcccuggagucuggguugagacuguagguggugggagcuucagggugccuagccuuggggugcagcagaugggcugguguggauggcacaggguggcagaacgcagcacccagccacccuaaaguugucgcuaccugaaguggggucucagcguugugugaaguuagcaaagggaguggcccuguugggugucuggccuggcagcccaggacgcuuagaaaguggcagcuugggagugauguggccagagccaccuuuccuuggguauguggagauucacgaagguugacuuccuuugcccaggaguucauuucauggcuggguuaggcuacuuugugguuugcccucagggaugccccccgccccccgccacacacacacacacacacacacacacacacagguccauucucagugagcaccccccacacauacacacagaacacagguccacucucagugagccccggggcuuauagauuccagauguuucaauguuuuagcugaccguuggccuggaguuugaugcccugggaaaauuuugggguccuggagggacauuuauguacaucuuuuuuuuuuuuuuuuuuugagacggagucucacucuuuugcccaggcuggagugcaguggcgcgaucucagcucacugcaagcucugccucccagguucacgccguucuccugccucagccucccgaguagcugggacuacaggcgcccaccacgacgcccggcuauuuuuuuguauuuuuaguagagacgggguuucaccguguuagccaggauggucucgaucuccugaccucguaauccacccaccucggccucccaaaguguugggauuacaggugugagccaccgcgcggcccauuuauguacaucuucucagucacuuaugcaucaguggaaacuaaguuuuagguucuguucaaagagugacuuucaggagcugagagcuuauggagcagaggccaugacugccggggaguuucggccgcugggcuuugcagccagguggggcugucuguguucaggcacgggaguuucuacuuuagccaaaggagacggagcucccaaaucucccucccuuuccuggcucucagugugaauggguggccuagguacccucgcagguugcggagccgugaccaucugugccuccugcgugaggugggcuuauuagccucugggagcagagggugcaugacaggccccagcucugcccagccuugagggcuggaggagggcgggggcagcuucuccucaguccagcuccugggaucccugcauggucccucucagcccagguccagaggccaggccaggagccuggaacgcacuggcugugcucagggcugccccucccccaccccccggcgcaccuuugauaggaggcgauggcuugcacuugugcugaguucaggccuucugcggagggcaaaaucugucgaggaggcacuuuuccgugugaucucuucaggaagucaccacugucauugugcuuagcagcaggggugggggcgaugggggugggagaagcuggugccagggcagugucucugcacccugacuugcacucaaggcuggggggccccuccaugcuuggcugagggccugucuccuggggcaguguugugccggacguguaggaaagggcuccugugggccuucugaccuccagcucaggucuuccccauccuuuaucuggaagaauccaguggcuggagccucgggaccuugccucugagcuggcuuggcuguggggaggggucucuggccuccccucccugcucugugcuugcagccucaccuccuggucccaggcugggugagguggagucuugagccuggugaggaugugugcauccgccuggccacacuucagcuccccugaugagaguaagaagccccccagcccauaauuuccugaagugauccuagcuccucuggaggagucucccaucugucugcaucaaaccuggaaagugggggauggagcaugaggcggggguccaugcccaagggucuggugggagcugggcugagcugggaaucccagaaacauccuuagcaagaaagugagagcagagugcuggagggaccccgaguggggaagaguugguuguuaaguccggccaccccagcacuuuuguuuuugcucccuggcccugugggcacucacccggggcagggaccagagagcaggcugcagcucggaggggcugacuccgccagccuucacguugggcaggcccgggguggcucacugugggagcccuugugaaauacccuggaugggguggggcaggggcugcuuccugcaacccaaagccacaggaugguuacuccaucaguggaggaggccgacugggaggucuagaggggccucgggccaggcuccucccagcugauggccugccaccuggaaggugggggaacucccuggucaguccugccaacagaccagagcuagauggacggcccacccccagcuuuucaaaguuaggaggcugggagacucgggguucccuguagccuccucucuggccaggucccccguggggccccugugcacccagggagcagggggcuuuguccgaggccggcucaggggagguggcuguagaagguaggacccuggaagaugcacacacagggucacuggcuggcccucaccugcuauuggccaggcugggggcugcggcucucguggggcgcuguuggcuggcgggccagggagugcgggcgcggcggggaggcagaggcaaugugcugagucagcgugacucgccaggaacagccgcgcucugggcagugccgggguuauuuuuaaagcucccggcuuccuucuaggccugccucucccgcgucuuauuccuucuaaucucuccccugccccuugucuugcgccugccuuccuaacagccuucaguuccccuucucccgucagaccuuccugaccucccaccugguucucuaggggcaggguggacaggaagcagcucagcccagccugggagaggccaagggcugccuccuaucagguauugggggcugggcaccuggacagcaggcuggggcgggcugugcggcaagggcucuugugaacugggccgggggcgggggggggggggugcggcgaggguggucuccaggguacugaccugcuccgugucuugcagagagcgccugcucgcugugcccccggguuaugacgacccccaauaaaggaaacaaggccuugaaggugagugggcagggacaggagccugugggcuggggucggggggcacagugggcgugcccgcuuggccugugaccaccugcacugugccccaggugaagcgggagccgggugagaauggcaccagccugacggaugaggagcuggugaccaugucggugcgggagcugaaccagcaccugcggggccuguccaaggaggagaucguccagcugaagcagcgccggcgcacgcucaagaaccgcggcuacgcugccagcugccgcgugaagcgggugacgcagaaggaggagcuggagaagcagaaggcggagcugcagcaggagguggagaagcuggccucagagaacgccagcaugaagcuggagcucgacgcgcugcgcuccaaguacgaggcgcugcagaccuucgcccggacgguggcccgcagccccguggcgccagcccggggcccccuugccgccggccuggggccccucgucccaggcaagguggccgccaccagcgucaucacaauaguaaaguccaagacggaugcccgaucguagggacgcgcgucugcccaggcgggucuuugcggggccacuaggcacauggcgaauuuggcugcccugucccucuguuuccuucucuucucuuuccucccucucuuccccacccuucucucuucccugcaaagcacaaccuguaccccaggggcgccgggcugagccccuuugaucucgucauugucgucguguguuuuguauguugggauuggucaguucggcggugacguggggucgccccaaccccuuuuguaccagggccaugcaggcuuggaguccagaguuggugcugugggaacggacuagagagaguugcgggagagagaaggagcaggcacgcugggccucgcguguccccgagcagugagggucccaguguucccuccacucccgaguggccacaggcucgcgggcugggaaggauucacucucuuuagccccaggggagcagcucagcuuagcccagcaugaagagaugggcucugcucugagaguagggcgggcuugaaggcccugauggguggaccaccagccugggcgcaguggugcugggggcgugcagcugggcccaggggcugugcacucaggccugacccguugcacugaacaagaccaaaucucugguugugcgcuuaacgugaggguggguccagugugcccugcgaugggucccgugucacuguuuacaugaccuauuugugugguuauauagcccuuuauuuaaaagagagaaguuccuuuuacaaaguuauuaaauuaauuauauguuuaaaaguuaaagaaaaaagagcugcagaguauuuauaaaacugucuuuuagaaaaaaaacaagcaagaagaccauuugaccauaugaauggaaaagggaagaaaguauaauagaaacuuugcuaguuaaaaaaaaaagaaaaaaaaagaaaaaaaaucccuuucuuguaaacuuacggacaccucuuuguggcuguuggaguuuaguuuuuauauacacagaguuaucagacauuauuuauaaaacuuaguuuaaaaaaaagacaaaaaaaaaaaagccaagccgugagccgaccagaaggccguccucuuugauaucuuuugcaauuguaccgaaagugacuuacuccucugcccuuccugcuuccgucucuugccggugccguggugucguccgugccuggugagguuuugugcagcgguaaagugcuggugcuucuggugaccuuugaccugugggugucacuucuugugucuguuuucccguguucguuuuuuggguuuaguugugcuuuugcuucugcuggcuugcuggaccugggcuggggugccaaguggcgccugcugcgucagagcucaaggaaucugugcccaccaccagcuccugguccguaggaggugagacaugggguucugucaugccccccuccacugagccuuggcuacaucugugucuagggcuugggcugaucuaguggcgggguaggugaaacuggggucccuuggggcgccccacgcugcuuccacacccaccaccucuggccuugggugguggcauuacagggaugagggagucacuguggguggccacagggcuauggccaagcguucccuggccgucuuccucuggccucagcuuuguuccuauaggcugcccgcgccgugggcugcaggucucgccgcccgcuugaucccugagguguuuccaugcugcggguggugcuuccaggcagagugggugggggcccaccgggcaccgcccuuucuuccuugucccugccucacucugagagccuugggggucuccaccagugcagacaagggcuacagucuccagggccgggucuugucccucuucuccgcugguccacgcuggcagcucuuggcuucgggccugccuucugccucccuuugggaucugugucuuccagggaucagcugcuuggcuucugcuggaggugccucccugugggggcgcagccugccuccugcucucaguuccucgccagaggcugcugcccuuccuggcugggcucaggaggcuccuuguaggcauaugauggggagggggugccccuacccaccuccaagaggcuacagcccugugucuggccaugugagcccuggccuuucaccggguugcugguuucuuuucuguggggcccagacuucuguaaagcacacagauguggguaagaugaaaaacuguggcccaacagggcuuaacccuauggauggugggauuuuuauccaauaguuuggccuggugugcccacaggaugggaacagggaggcaccaucaacacuugucauguuaaugagcuuuucuuugcucgagguguucagagacaaguccugugucuaccugcgucagccugaaaauggaaauauuggcuguugacucuugucauuuagugacuucaucccccuccccucagucugaucuugucuaaguagaauccaggcguuaguuggaaucauaucauaaguauccaugaagaaaacgucaugaucugccucggaguggggagaaacaggcccuccuuguccuugugcagcccccacuuuuguccuggcuguggguggccauccauuuugagcaccucugccaggcugcagaccuggaggcgaagggaguguggaagaggaggguguaagggucgacgcgugcugaaugggaggugcagguccucggugcguuggcagaagaggcuucuggaguuucgaggccauaccuccuuucaagagcuuuggauuuggggcgacuucccugggucuaggggaguguuccuguccccugucaggucagcccugcggagccacuccaccccucuuccccuuccccuggauuuccugacauagaugguguguucaugugcaggugugagugugcuguccuucugaucucuguugaucccgcuuuccuacugagagggugguggagagggugguggucucuucucaccucaguuuuucugacacagcgaaucgagggcuuuggccaaggccaggucucucaaacuuguccgccaaguaaaccaugauauaugucuucccuuccaccuuaacuuugccccaacuccucuuuuauccuaacauggacgcucagauuucagaggaauacccagcagggacaggucagcucucaccaggagagugaggccccuggcugcugcucgggguggcacugguguugcuggcucagcucuuggugcauguuucagauauguguguacacuucugacuggugaucagggcccggcccacggcccugagcggcugcagccugcuuugggacgauggucaggucccauguugucccugcugccucccucuggaguggccacuuggccaaagcgcccauccacaucuggaaagucggagccgcagccugcugcaccguuuccgcucugggaucuugugaguuacuuuuuuaggcugugguuuggugaaaggaaccaacacauuaacgauuuuucccccagaagccacugaauaauucuuuuugguguauuuuugccuuccuguuggcugucuggccuuggagcaggucgggagaguagaguacauaaucagugccacacagaggcagggcgugucugagagacuaaugccuguccugccucuggccuguguccuggguguguaccauaccugcugggccagucccacacauuuccacccugccccuggagcagcagcuuugauaccaugggugucccuugagucugagcuagaguguguccccgauaaacugugagaccucccuguucuuggugaccccaguugggcuuuggccccuccagcaaccuugugucccagcccugcccuucuucccacccccucaaucugcuagucccugaagccuuuaaccaaacgggagugggcacagaaagccuucuccuggcaacaggacaagggcugcccgcguguccagcccuguugcucuccuggcgcugagagguggguccaagcagaguugaucagucccugccugcccugccuaggucuagccaggggagguugugugugugggagaagaccccgggaucugcuggggugggauggagguuauuaaagaucuaagugaggaggggcugggguuuggaugcggggugaggcccgagcgcucacacuucguguagggcgggcaggggccugaccucuugcagggcaguggccuuggugcccuaccccugcccugcgcaguauuuauugcuaaauuauuguccaggaggggcagcacugggccuggccccccggguauuuauugcuguacauaguguauguuugugauauauaagguuuucuuuauuuuguauaugaucaauaaaccuuuuaaagagac

SEQ ID NO: 192332 - RNA, 39857 nt, Homo sapiens
uugagggaugcacaagucuuuauuccugcuggcagaggaggugguccuguggcuggcggagugggcaccucaggcuggcagcucucaccucuugcuggcuguagugcagacacaucagggugaccacacaccccgggcucucaccacccggccacccgcccaccagcccggcugaagcacucggcccugccggccacagcaccuagccccccagcccacugacccugccacagcacccggacccccgcccuccacccggccacagcaccccaccuuccacccagccgcaguacccggcagcuucagccacuugggcaccuugcccaggcuccucuucacgggcugggccgucccugggaugggcucaggggggaccagcgcccccuccucagcagcuggcucagacuuaggugcagggucaggggcuggcaauggggaaggggacccggcggcccuggacauguaccuguggggaggcgaagacacagaguggugagugccgccacgggaggugcccccagacccaccggcacuuaccuggccaccagcacaucggccgcagauggggagauggcaugcuccagcaggccaggcuccagguagacaccugcagggaggcccaagcucacccugagccucugaggagggguccacucaccauccacccagcaucugcccaccagcacucagcucugggagggggguggccagcagguggcugucccaguccucucucggggaggugguuacugggggccgcagaucucccucucagacccaaaggaggccccagaccgaacgcccucccgggcagcuggcucugagguccagggacaggcuggcuggacuccgacacuggccccaaccacugacacucaccugccggcuccucggcucccaagugcaccagagcggccgggaagagguucgccugcagggagggcggggggcucaggggccgggugugggcagagcaccccccugcugugaaggcagcuacacccccagggccaggccccagcuccacccucagacaggcucugccugcccggcccccaugagcccaucgcccagcuuccugucugacaccagcccuaccccuguaagcaaggccagggcguccugggaccagcgcccuccaugggaccaccccaagccccaagccagcugaaggcuggggccucgaggguccucaagccaugcagcaucaccguccucccuccucuggccucugcacccgaggaagguggggccaggcguggcggguccuggcggaugcgccgggaccaccguggaggggugcagcugccaggcugggguaucccccucccagcuccagauucccccucccggcuccaggcugcucagggccacaggcugggggugggaguggggcugggggauguuaaaagauuaauaagaggaagcuucaaaggccaggcccaggaacgccgaaaccucagccuccagccgggggcccagggacacaaacaagggccgugaaugcuuugaaaacccaauugugccgccugggaucaaagccuugugagcagagaagggccuguggggugggcaggggcugcccgaguggcccuggagaggcgccggaagcuggggagccaggaagggggcacggggaggacagcgccaggagcugccauggucucagccucucccagauggagagcaugcuccgccaccaccgggccuccaagauucacacccaggcugcggcugcucacagaagcccaggguacacugcccagaggcugcugugggcacaggagcccuggccagccccaucugcaucccaccugcugccgggcgagagggcucccucagaggccaccgaugcagagaggcaccugguucucaucauagcccccacaggccaggacccccaaccagcacugccccacgggacgcacagaaaggggcgggcaggacucgggaacaccaggagagggaaguaggcuuggcagccaggccuggggcaccugggcucccugucugcgccucugugcagggagcacugagccaggcagccuacccggccuguccccacgugcuugugcccagccuugacucgggagggaucgccacugcucggacgaggggaugguggagaggagggucggcagacuggguggcauggaggcugaccagugcuuggagaggcucggccucuggauggaccccaaaaaagaagccucccagaguccacgucgccuccaucuccuaccacuggcaagcguguucucugcucuggucccaggcaccguuucagcgagggacccagggugaauggagccacccggucaccaagcuggggcuggaaagggaaagugggucacaccguccccccagccagagcagggcccgggaagggccuuugagggaggcacaggcugaggggccucuccccaccagcacugucccaggaugucucaggcugccccugccuggcucccucggcugacagggagaagugggggugcccgcccugcccugacacagccugagggccuggagccggccccucccuagcugccgcccaggacacuggggccccaaauccagccgccucucugcugccaaccccuugccccacucaguguugccaggaagagcuuccgaaaggaggcccacgucaacccccacggggcagcaacucuguaggggcugcaugcacacguggcccagcgccuggccgcccccuccaacgagaacagcaccacccuccggggaacgaagccaagagaggagcccuugcagcucaagacgcccgggagggaggcggcaccacagcgccugggagggaggcggcaccaccgugcccgggaggaaggcggcaccacagugccucggcagggagauggcaccacagagcccgggagggaggcagcaucauggugucugggagggagguggcaccacggugcccgggagagagaaggcaccacggugccugggcagggagagacggggcauccacccacagagcgggagugggggcugcaggagccauccugccuucugcaagaccauuugucaacgaggaacauuucagaggguccaggugggguagggccugguggguggaaggaagggggccuguuggucccagagaggccccggcagugggcgacacggcagugcaggacggggcuguccuggguggaaaggaaggacgacagaacuggcuaggggcgggcgcccagcaggcacucaggccagaagugccagucacgcccugccaggugaguggcuuggggaguggggaaccaggcagcaaggguggccuguguccuggcagacgguccccagaggcagccugagagcuccaacaaacggaggguguuaggagccaggcuugcccugccaaagccaauggaaggaagcccaaacagcagagccuuugaagagauaagugaggugaccgugacaucaaaggugggccuagcccagggugaccuuccucaugaccugaggacgcggaccgcacacagaagugacugugugaggacaccagggcagggccagcccugaugcccagggccaggacgcagguuucaggcaggggcggggggcuuuguuccccacaguggugcccccacacugcucacaauucccuguccucacuccuggccgccuccucccagcccucccagaaaaccugcacucuccugggccagggccacagagggcugccgggcuaccggagcccccacacccacgcacgcugucccucucggaagccgggggccggccccuggacaucccccaggcagcaggcagccggaguggggcucugccagagacgugaaagcuggugcuuccgcgcccgccgccugcuugccugccagggaggcaggcuuccuucccucagccccgccagcucucugacggcaggcaggcaggcaggcacgucaccggggacaccaccccgagaggccccgaggcuagagccgagcugauggagggcaggagacgguggcugguagggaagccaagcguccccagaaacagggcagcagcaccccagugcucucaggggccucccagcgggagggugggcugcaggccugggcacugguccuccuccaucccaaggcaucuuccaaauucaauguuuaucaacuggcuggccagcaagggaggggauggagacggaggaaggaggcccggaguccgcccggcagcucgggggcugagaggggacugucucaccccuccccugccuccgcugcagggaaucccgcucaguccugcuccugaucaccccuggcagcugccagccuucuugccccagcucaguaagcggcugcagccccaggcagugagcaagcuucucaccuccaacccaggccucuguagaggccuguggccacuuaaaaaaaaacccgccucuguggcuaauuaaaauaucugaagaggcuuugaagaggaaaccauuaggccagagggcuucggaaggccccaggcagcucucccacaggccaaggacaggacauucauugcuucuggcucuggagggcggcccagcagggcugggaacccggcacccucacccuggccccacccucaggagcccucagggagguggcagggacccacagaagcagcggacagcuaugggcaccagggcguuccuagcagggaccggggggccagcgggagaggccgggcagggggaaggggcagcugaagcccaaggcggccgccuccagcugagggccuggucccucuggggcucccugagcccugcuccgaggccugccgggcccuuccucacccagaccccugggcagggacugcugccgccuuggccccagcacagcagcccaggggggccgagaccuccaagcggccucaguucaggcaggccgccuagcagguccuuucccacccggggccaggcaggaagcagaggaggccggaaagccgugucagaagcaacuucagaggcgcacggcccccucggaacccaccggcucucaaaggcuuuauuauccugccccagcgccugccaggccccuccuuccugcccgaggccucacgcucucguccugcccucccuggagggccccgccccgcagcaccccagggaggcccucagguaccugaaagagggucugcguguggucguccaggacuguuuuuggaggggugaugacugaggagagaaggcaccuacguguuaggaagcaccguggaccucgcccauccaugcgcccgaaggaagacaggccugcagaugggggugacgccucaaguggggcagaagagccccucacgagcacgcccugugcccacacuccugcugcagaaacuccagcugagggcucggaagggccgguggggggcaggcccaccugcaggggacaccacccgugcagcccggcuccccuugcagugggcagccuaacccuuugccaccuagacacccuccaagggaggccagccacucccuguccacccacccuucccacagcccucgggcaggaguggccugagccccagggguggggaccaggcuggggugcagcagggcuccagaggggagcagggcgcugagagagaaggcaggaagccuggcucccaccgccuggcucggggagaagggcccuccuaggucuccacacagacaccaugggcugcaggaggcaccugggcgggaggccacagaugcugcuccuguggagaagcugccacgagccccagcugggacgggcggugugcccacagcaccaaggccccgagcacuggaggcaggagugggcucaggagaaaaaacguacacagguaaaaugacagcucgggguuccccagguggcuccucacgaagucucgcaagucccccacugcagaggagaaaaagaacauacagacagcucuuccaccacgccagccccgggcugccccagcaccugggccacugcucccacccuccugggccuuuccccgaggggugggaauucagcccuguuccucccacagcacuccaggugcucggcguggcugggccaccgugcgggccacacuugggacccccgcccugcuggagagcacucccacugccacccgcugccccccagccccacccccgccccagccuaagcgcuucccuuucccugggggaggccccugugaccuugggcugcugccgcccggccgucuggguacaggucacaagccccugaaugucacagcaccacugcccuccucccgggguagggugccuuccucugggugccccucugccccacccaugcccaguaggugggcgacgugagcacucaggaccacgggcucccugagcuggggccgggcaccuggagcaagcgcccagccugccugacacucugcgaacugggaugccucugcacccccaaggggacaucagcacccgcacccacccagugcccuggagcccgcaggccagguggcugcaguccuguggccuggaaggaaggagccgggagaggccccaugggccccugccccccauccccggacaccccacagcgcugcccaccugucucgcuggggcggaagaagcccuguaggacguagcggucggggaacaggacccucagagccaccuaggccagacaaguggaaggguuggagggacggccggagcugcaccagggaccagggcguggccuccccacucggcccaugcugggccauggacaccagggcugaggcaggcagaagcagccacccccaaucagggccugggcuuugacucccccguggcaggcugggcauggagacagccaagugccgugugugugcacagcggccugcguucuaaaaccacacugaccuggguucaaaugugcugguuuuuuuuuuuuuuuuuuuuuuuugagauggagucucacucugucgcccaggcuggagugcaguggcaugaucucggcucacuguaagcuccaccucccggguucacgccuuucuccugccucagccucccgagcagcugggacuacaggcgugcgccaccucuccugacuaauuuuuuguauuuuuaguagagaugggguuucaccgugucagccaggauggucucgaucuccugaccucaugauccgcccaccuuggccucccaaagugcugggauuacaggcgugagccaccacgcccggcucaaaugugcuguuuaaaguuucauucagccaggugugguggcucaagccuguaaucccagaacuuugggaggccgaggcgggcagaucaccugaggucaggaguucgagaccagccgggccaacaugguaaaacuccaucucuaguaaaaaaaaaaaaaacaacaaaaauuagccgagcuagugguagcggguaccugaaaucccagcuacuugggaggcugaggcaggagaaccacuugaacccgggaggcggagcuugcagugagcugagauggcaccacugacuccagccugggcgacagagagagacuccgucucaaaaaaaaaaaaagguuucauucuaaaucaugagcaggggaggaucaacuggccacuaagggcaugcgcgccaccacgggggggcccugcucagagcugugccucagucgcccccacgucccauccacagaccucacagggggcccccucagagcuguaccucagucgcccccacgucccauccacagaccucacagggggcccgcucagagcugugccucagucgccaccacguccuguccacagaccucacagggggcccgcucagagcugugccucagucgccccaucccguccacagaccucacggggggcccccucagagcugugccucagucgcccccacauccugucugcagaccuuuggguagcgcuccagcuucuccuuuaucugcgccucccugaaggccuuggucaccaagggggcuucuuccaggcgcuuccuguggugaggaggggaaggaacagggcuucuggucagaaugggggcccuggcaacaggccccgggcuccucaccugcacccuccagggugggagugggcugcucuccccacacaaggcaggaaggucuggacgccccucccugggccccaacccucugagguccuguuaagggcagccugucagggaccugggccgggagccagugcuggcacuggggacagcgggcagcacaagcacccgauggggcaaacccuggcgcgaagaugccgggaggcacugagggggcacccaccgcucacucuugagcugggccaagcgucuucucacgucguccaccgucagcucaaagaacucaucaggcagcuccgcuggccaggccugcagccgcuccuccaggucgggguggcacaccaccggcucccgguccacgggcucccgguccacgggcuggaggcagagggcgcggcugacggcgggugucacgggcugggcccuccgcaccccgggcugucagugccccagccgagguggucacacagacuugggagcugggcccacucccucccuggccccggccagcgcagggccaaggccagguccugggggcagggcugggcacagcagcugggggaccccaccccacucagagccuguccagggcuggagaccccccucucccagucagugcaccagaccugaugcugagccccugcuccccagcagggcacauggccccuggagucuggcucaggccacgucagggucuccaugggggggagggguggcgacagccgccaaauuagagcgucggcaaaaaccccaguccagcugcccccgcugcccucuuggccacagcuccauggccaggcugaauccaugcacgccugcccccagggaacaagccggccccucccucugcccacccugggaugcgggagggacagcgucaccccuaauuggcaucaacagcaaugaaauugacaaagccgggccgugcagcucgcggagcccugggcagugauuucaaugcauucagcacagugcugggguacgugggacaccucagcacugcgccgacccacacucggccccguccccccucacacagaacagccgagagcugucgggaguugggguggccuggagccggcucugggcucccacuccuaccucacacucucgacaccuggggauggcuuggcagucccugcgaacaacccuccuggucccgucccgucuacccugcagucucccacccagccacgggcugcugccuccugcccuacacagcauuccagcacccccaccaugcccacacugggugacagccagggugcgccugccagagguacgccugucccaggugucuccagggcugcccuccggacacaccugagaccucgacugcugugggcgacagggcccugcagccacccagcauguggcucuguuaugacuugucacgggagucuggcgggagcugcacugaccucagcagcgucauggcagggcagccagugagggcugaccacggcucggcaguggggcccacagguggcugaccaaggccccugggggcugcccuuccaaagccacaaccauccugcagccacugagagcagccugcgccagagcuuuuuauaacaagaugccaggcgccaggcggccccccacagccccagcgccugcauuccagagggccgcgagcacgccuggguucccgggggagagacccugggccaggagccgccauguccaugagcggccaggccagccuguggcagguuggcauccucugcagccugguccagagccucccuggaggagcccccagaagccacacugucuucccaggcgggcagaguaccccugaugggcucguacugagccugaccaccagacggggccccaggacaugccgugcucaggcggccacguccagggcacagccugguggucacugggggaaaugugggcugcugccacguccgcauacuggacagugccaaggacccccaggcccacagcccacaccagggugccuccaggaugggggccauaggggacaggaccaucagcaucacgcugcuagggggcuguugacuucauuuggaaaacaaaacugaaaaaaucucuaauuccuguggauccacccuagauuccuacccgucaucccaagggccuggcucaggaagccucugucugucagacagacccagggucccacacggggccgugguagcaggggagagcggccucuacggaaaccucccacacccgcccuucaccugggcagagcagccccgauccggagcagccucgcuggagccuggggucaggcuggauaagcggcuaccagaagggcccaggccaccugagucaccccgagaacauauggcgucugcaguagggcugcugggaaaugucacuuggccaccaaaugacagagggagaugccaggggacccuguguguggagaaacuucaaacacccaucagcucagcuccgagccuuccccaggagagacuuucugucccacagagaagaggggccaggaagggggagccacagcggcagggccuggggucucagggcugccccagccacacccagcccuguugacuggugagcucugcccagcagucuggcccgcauuuguggcaucagcgccgcucccgcgccagguggauucacagagaugccuuuggauggaaaacagagguugagggaugagacacugugagggaaaaaagcgacagcgagggcccugcagggcagucaaggccuggccccugggggaauucccguccccccuccccagccuccucgccggugccaggagaaaagaaacgggcugccugugcaggccaaaaaugacgucaaccgggggugaggcguccuggagccuccaacacagggaggaggagcaggaggcaaggagagagacaagcacccuccuuucucuuuccccucaauuucuuauuuugaaauauuucagcccacagaaagaugggcagacacaacagugaacaccccucaugcagaugugaucauucggcugcauucacuuuccuuccgcucuggggcaaacaugcaugcacauaugugcacacacagacaugcauauacacacacaccugcaugcacccaagcacacgugcacccgcaaggacacacacacacccccaaacacgcacgugcacccgcaaggacacgcacacgccccccaagcaugcacaugcacccgcaaggacacacacacacacacacaccugugcacaugcaaggacgcacacacacacacccgugcacacacgugcacccacaaggacaugcacacacaccccaagcacgcauguguacccgcaaggacacacacacgcccccaagcacacacgugcacacgcaaggacacgcacacgcaaggacaugcacacaacacccaagcauggacaugcacacaaaagaaaaccacagacugugccccaggagcacagcagcaucugcugagagaaggacucuugucccagcugccagcaucacaccagggcccaccgcaugggggagguggcucucacacacccacacuggaaaugucccugcuguccccaaguacccggacgguuuucccacacacacggucacgcuggggcuggagcugugccuccgccccuucccacaucccgacaggggcugugucagcaggacgccuccguccgccguggucuggcccccaauucucugugcugagugagguucggguugaagguuucagggaggaggcaacuggaugccauaccacugucccuacaaacauccccaccuggaaagcucccaagcagacggagggccagcggggaaugaggcccaaaccucagcagugcagggggccccaaccugggucucagccuugguggggucccccagguguguggccgccaggugucccugggggccuugccacgccucaggaagcugcuggggucagucucacucagccaacgggguggcugagagccaggaggagccuuccagaagccugcguggggcuuccugucucagaugaggccucucacgagaccugccgacccacggggcacacaggcgcugcagcaggaggaacugaaccgcagggcagcaagagccgggggaccacugccccgcaggccuccgagaccaaaccccagggcccaacugaugcccacuucacgcggccucauguuuccgccaccccggcgccccacccugccacugagcagaggccguguucugcucugcccagcgggccaggacugccccagaagaaccagcaauauuuccggaacacucggcacccccaggccucccgcugcuccccaaagcccuugccaccucggaagcugccugcucuggcagaggcgagagccccacggcugccggggcauccaaauggcagcugacccucgcccagccacggauggccuccccugagccgaugcaaagaggcccagacccccggccccgggcagcaggucgcagguccaugggagcagcugggcucuuccagacagguucaggagauggagcccagaaccuucucugugccgcugaugcccccggacaccagugccuucaccaggaggagcucgccaugcugagcccagccugguuuccgccucacugccugggcccggcuuccaaaggccccacacucccuucuucccgacccugccccucuugcugggcagagucagaggucucagaggacaggggugaugccgggggcacagcaggguccagcagccggcacugcacuuucacaggggcugugugugcugagcuccccagaagcucaaaaugcgccacagggugggggugccuguggcugccacaugacacacaaggaggcaaggagcguggaggguccagcuggcaccaugagggaaaggugugauggccucucaggcuccgaggguggccgggcagcugugaaagacccgacuccuccugcaggugaagccccugcaugcuucugccccuuuagccccuuccugucuccugcaaacccaggcccccgguggacccccaggucccggccuccaggagggccgccaaggaccggaccacaaugaugcuaaccauuuauccagaugccccgaaacuggaagggggccggagaaaggccagaaaggacgggcaggacuaaggacagggacgcuguccgggaugccgggggcagcccugcgggcgcgcggccucacagcagacagugcuggggcaucccugggccgcugagcugggaaaccgaggggagggaggcugggggcugcagggugagggcgccaggggcaugcacacaggccgggacacugcccagaggucuccuuuucuugacaguaauuuuccaggaugugaugacacacagaggaaaaaugugaacccauucggagguggccccaaccucagaguuuccagcgucucugaggguuuguguuuuucccucccggccucccucccucccaccgucucggcccggccugccccgccagggcuccggugagagggaguguggaguuuccccuggaggcucugagcuucaaugaaucacuacgccagacacgggccaaaccucccgaguuacucagcgccccggccacccucggaggcaggcggcggagcacguggacgccaucaaaggccugggacgugcacagcaggagaggcugugccagggcgugggcgcgggcucuguggggagaccgcugcgaccggcguggacaggcaugcacaaaggacgcaggcgggacugccucugaagacaccacaaacuccaugcccaaauuuuacauccaaagcacggggaacacccucagcacaacaucccuccugcaccaggcagaggcaucaggccucgaaucccacccagaggagacggcgccgcccccaggcugagcacagcauccgcaccgaugcucauggcccgggccugccagcgaguggccacauggcuggggagaggccaacaaggaaggcccaaagcagagauguuucuguuuugagacagcgucucgcucuguugcccaggcuggagugcagcagugcaaucucagcucacugcagucuugaucucucaggcucaggcaauccucccgucucagccucccaaguagcuggggcuacaggcacacaccaucacgcccuacuaauuuuuaaauuuccuuuguagagauggggucucguuauguugcccaggcuggucuaaaaccccuaggcucaagagauccucccagcucggucucccgaagugcugugauuauaggugcgagccacuguacccagccaagaaaaguuauuuuaggcugggcacgguggcucacgccuguaaugccagcucuuucggaggccaaggccggcagaccaccuaaggucaggaguucaagagcagccugucaacaugaugaaaacuccaucucuacuaaacgggcaccuguaaucccagcuauucaggaggcugagacacgaaaaucgcuugaacccaggagguggagguugcagugagcagagaucgcaccaccacacuccaggcuaggcaacauagacagacccugucucgaaaaaaaaaaaguuauuuuaaaaagaugaaaacaggccgggcgcgguggcucacgccuguaauccuaacaauuugggaggccaaagcaggcagaucaccugaggucaggaauuugagaucagccugacaaacaugguaaaaccccaucucuacuaaaaauacaaaaauuagccgggcaugguggcaggcgccucuuagcuacucaggaggcugaggcagcagaaucacuugaacccgggagguggagguugcagugagcugagaucaugccaccgcacuccagccugggcaacagagugagacucugucucaaaaaauaaaaauaaaaauaaaaauaggcugggcacagaggcucacaccuguaaucccagcacuuugggaggccgaugcaaguggaucaccugaggucaggagugcgagaccagccugaccaacauggcaaaaccccuucucuacaaagaacacagaaauuacagguggcagacaccuguaaucaaucccagcuacucgggaggcugaggcagaaaaauuacuugaacugggaggggaagguugcagugagccgagaucgugccauuguacuccagccugggugacagcgcgagacugucucaaaaaaauaaauaaaauaaaauaaaaugaaaaugaaaagaugaaaauauaaagcaugagguacucauaagaaaaaaaaaucacuuuuuaauuuuaaaaagaaaaauacuuuagaagaugaaaagaggccaggugcaguggcucacaccugcagucccagcuacucgggaggcugagauggaaggucaugacugcugugagccguaauugugccccugcacuccugccugggcaagagagcgagacugugucucaaaaaaaaaaaaaaaaaaaaaaggaaaaagaaaaaaaaaagaaaagaaaaauaagaacaggauucaggacugcugcagccugggcugaccaugagcccgucuggagcugggcacguuacgguguggcaggcgugugucacuguggauaaagcgcaccaacacccccggacaggcaggaaaagcaguuuggugaggggggucauccgcagggcagagucuggaggcugcuccugggggagcccgggaagggcugacggggccccugaccugaguuccuggaacaaucccaaccaggggaucuugggcccaacggggaggagaguccaggccagaaggggccaguggggucugcgcccugcagcagccgacucgcccaguacggagccccacacucccaguucuccccacagccccaguggcgagcauccacccccuaccccccgggguuccucaccaaaacacaagcgccugucagucaccaggcuucuaaacagccgggacucagccagccaccugcaaagucgcugagccaucugccagccacgcuugguggccauuccaaucaaggccacaggcugugccccuagggacagccucagagcccaggguuguccucagacacccaugaggcauagcagggaccugggccacccuggccacugacugugcuggccgcagggaugggagucugcaccgcgucggaugugggggcuccugucuagcccggcgucaggguccaggggcaggagccccuggcccaauaccuacugcccagggucaacagcaccugcccugccaggcacacgggggucccaggcaggguguauucaccacgcccagugcaugacccgcuccaggcccagccuccuccccgcugguuuacccccaaaacccugggacaggcuccuccccgccccacgagucccacaccggcugucagccacagagggccgggugugagcaggggugcugaggaaaccccaggccccggcuccaggagcaagguucacccccgaggcgggaggggcaggcagggcagcagccgccagcccgugcgggcagacccagccuuugaucaggagcggcccucgugccagcugccgggaggccgaguuguggggggcgucugcugggacuggcgucccagcccagcacagggcugcagggcagccucccagccaguggaggcacuucaaagacagggccagggggcgccgggcagccccagccucucccagcgcccgguucugaucgccaguaaaacuaccuucuaauaauuaaugccugacaucaaaggcaggaaccgcccgggucugugaaccaccccgggucucggccgaggaccugccuguauuuuauccugucucuuccuucugacucuuuauuuaaguccaaaaaccacacacaggcaaaacauuaaugggaaacuuggaaacucuuuuugcuuacuaaaguguaccuuugaaguuccccaaaaaaguucuguuuuguucccuucuccccuccccccaucacugaaagggacccagcagcggcauguggccccgggcccucugcgugugcggcuggcggcgaugggaggcgcggggcaggcaggacgcccuccaucaaucagcugcccaagucccagaucaaaggcccucagcacgccaugcaggccaggcacacgcucccuccccuggaccccuccugccagccaagaccccaccccaacagcgccucccgacgggcgagcacgggcgggcacuacucugggcugcgagccccaugcuccacgccccacgcucugcagacaagacccgcccuggucacggagggaaggggcugaggcccacgccucuagaaugggggaacaugacagccacugugucucucacacugagggguccccacaagagcaggccuagagggggucagccccugcucacccggagcacacgggucgaggggcacgagcgcuucauggggacucaggugucacagugcagaguuuggcagaguucccagagggaggauggggugccaacaccaucauaguccuagaauggacccaacacccucacuccccacucccuuguccacucaacaggaacagucccaggacagccagggggacagaaaacagaggggcuggacccugacgccgggcuagaugggagcccccacauccaacacggugcagacgcccggccucugcccucccagguguguggccgggaggcaagagggaggcaugagguugcuucacucagaaguggccagaggaggaggaagcaaacuccugaccucaccugaguuccgggacacguagcacgagugcccaggggacagccgaggccggggccaugugcacagagcccuccuggccacuucuuguuuucuuuuuuuuuuuuuuuuuugagauggaguuucacucugucacccgggcuggagugcaguggcacgaucucggcucacugcaaccuccgccucccggguucaagagauucuccugccucagucucccgaguagcugggauuacaggcaccugccaccacacccagcuaauuuuuguauuuuugguagagacaggguuuugccauguuguccaggcuggucucaaacuccugaccucaggugaucugcccaccucggucucccaaacugcugggauuacaggugugagccaccaugccacaggcccagacacaaauauuuuaaauguccacaggagauggaggcaugggggccuuccaggcccacuacgucagcaggagcucaagaagcucugaccuggccccugggcuguggcuggcagcuggcagccuggcccucaggggacacaggggcugggaaacagccuccucccaucccugucaccgaaagccgcaugacagucccccagucugccucuuuuggcacaaaacccauaaaugccacgaacaccuuaguucugcaggugaggaagcugaggaagucagguuucagcagcccaggugcagggcucugaugcggggucaggacagggacaaaggaaaagucagccacagggccagggaccccacagacacgagguccccacgguuggggggaggcgugagggagagggucaggccacagccacacacaggcaugcucggaggucagcaccuggccgccugccugcaugcacuccccgccaagggcccagugccccagugguggguguagucugcagugagcaguggccauaaccuucggagaacuuccagaacccagaaaagaggggccacugcccagcucccuugugagccaggugaaauucgauucccaaacuggaugaagacagagcaaggaaaaaaagucugucucacuuaugaacacacaugcacaagccaauaaaauaaagcauacggucaucuccauugaugcugaaaacacugaaacgguucaacacccacuuaagauuuuuuuaaaugucagaaaguuaggaauaguaacuuucucugcuugauaaaggcuuuuuauagcacacaucauccuuggcagagaaaugacuaguaauuccuguuacgaucaagacaaggaaggaugucuacuaagaucgccacgauccaaaagcaccagaggcccauucgcugcaacacaggaagaaaaacgaugagaggacaaagggaaaggucugcagaggccccgacagaaaccaagacgccacuagaacuagcaaggagucagccagucaaagauguaacaggaagcaugauacuauccacaauauuauaaaaaguaacuuucaggccuggugagguggcucacaauuguaaucccagcauuuuggguggcugagauaagaagaucgcuugagcccaggaauucgagaccagccugggcaacagagagagaccucgucuuuaugaaaaauaaaaauaaaaauaaauuaggcugggcgcgguggcucaagccuguaaucccagcacuuugggaggcugaggcgggcggaucaccugaggucaggaguucgagaccagccuggccaacauggugaaaccccgucucuacuaaaaauacaaaaauuagcugggcgugguggcacacgccuguagucccagcuacuugggaggcugaggcaggagaaucgcuugaacccgggagguggagguuacagugagccgaaagugcgccaccacacuccagccugggcgacagaagcaaaacuccaucucaaaaaaaaaaaaaaagugggugccucaguaaaggugguuuaaaaccagaaaaaagagcugggcgcgguggcucacgccuguaaucccagcacuuugggaggccgagguggguggaucacaaggucaagagauugagaccauccuggacaacaugguaaaacccugucucuacuaaaaauacaaaaaaauuagcugggcuugguggugcgcgcuuguagucccagcuacucgggaggcugaggcaggaguaaucacuugaacuuggguggcagaggcugcagugagccgagaucgcgccacuguacgcccaccuagggacacagugagacucugucucaaaaaaaaaaaaaaaaaaacccagaaaaaaaaaaaucauuugccugagaagcuaagaacaagcccagugacccugcucagguaggagguggggcuugauuccagaccagauugaagacuggcugaugcguucaccagcucccccuucccuggccauaacccggaaguuaccaccccuuuucuagagauuucugaaugccccaccccuuaacgugcauguaguugaguggauguaaaugugaccacggccaugcccugagcugcugcccuccaugcaccaccccagggcggcccugcucugugccacacaucacggagccaacacggagcugacacaguugccgccuugucauggagccaacacggccucaucccggagcccacacggccucaucccggagcggacacggccucaucccggagcagacacagccaccgucucaguaaagcuacuuucucuaccaccugcuuaccccuaaauuccuuccugggcgaagucagaaggcuccuguccagagccccgcguuuggguuccucugcgcguuuggguuccucugcccgcaucacggccacgccaccaggcugaccagcuaaagccacgcagggcuacacaucaggagaaaggacacccccaagucccaaggccuagagccccuuuuacccgcucccgcuccugcuccugcuggggaucccgcucccgcuccugcuccugcuccugcuggggauccuggcccgacuuggacuucuuuggcuuggaggggccuccagggcuggagagggacuucggcaacuuagcugaagaugaugucagaggccucgugggcccaggagggccccccagucucugucccccacccgagaaaggaacaaagggggcagcugcgggugcccuugugcucugcuucuccugagugugcucgcagcagggcccugagguguccgcguccuccggacggcucaagucgccgcggcugagcuccccagauuccaagggaaguggagcgcuggcggcugccuggccagccgacgcugacgagcccaggcuuccuggggucuugcccacggggucguagcacuucaugacaaaccugaguggggccagaggacaagggaagcaccuuguggugccuacccccggcucacccucucccggcccaggcucacccucucccgcccccggcucacccucucccgcccccgguucacccucuccugccccaugcgcccucccaagauccaccgccccucugggggacacagagaugaggucggggcagcccagcccccacgcccacaggcaggcagaggccaccaggcgcucuccaugaugagggccuggguacaccuacuccccacuugccacguguccuuucuccuuuccuuugagaccacuuuuuuuuuuagcuaaauagacuccucggccccagcagcacugcccuuaccugaugguggcgcugcccccggucaggcccagcgacugcagcgucgugccccgcagggcagcuucacccgucaccugcaggaggagcagccaggacaggugcgccuugcaccgggaccccagagcccagggaagcccuccgggcaccggcaccaccaggaccacaggccacgugcccucucuggccuccauccuacccaccccccacaucuggccccugccgguccacacccuccacaaggcccagcuugagucuggucugcagccggggcaggaccugcugcccaugccugaccgugucucccccagccuggucuccgcagcugggacccaagcucacugaggccugggcuggcagagcugggcugcaaggaggaagcccuggugccaggacccacugcccggagcgagagaggcaggaacgugcugucacccacggggguggccauuccuggugcucagcucggggugggcagggaucgggccuggcuggccacgucccauacgcuaacucugaccugugaggaagggguggagaagcugccucuagcgagggcacagucaauggcccagcacaaaagccaaaggguguaagggucccugagggccacagccucaggacagugcugggccuggguccugagccccguggcucauccccucaagggaggacguagaccugaaccuccccgucacagccccagccagggagcuuccaaauggggauaaaugcggggaauguccuggccccccagggccccuccgggccagugcccccccaccccagcaaagggcacucagccagcguggaaacaaaaggccccugugaggccagggacgagcgcuaggagggucccgccacggcgggcuuugcuugcgccacgccacacucgguuuugaaaaugaucaaaacaccgagcaaagcaaauauuuauuaaaugaaaccacuuuugugacucuugggcuuugagagaagcugaaaaaacaaacagggcgccgagggagguuucggggcagcccgggcuccgagggccggccacucccucuuuuuccaugaaacacgucgugcuuucaagagcccgagucucccgccacugcccuggagacggcugcgggacagcagauuuuccaguuggaaagugggcugaaagugagcggggacugggugagcaagagcaggccgccuaccucaucccucguguacacgcagacugggguggccccgccggggugcugcaggcacucccugggaggagaggaaagaaaccaucagguaccccagggcagcucaaccagugccacggaggcccuggggcaggagacucggaaagcaaagguguggggcccucacccagcacccacccaggacagcgucccaggcccaggcccaggccacagaccucagccccacugcgccccacaaccaccaaaaggaggcaccugacagccgggggcgcucccaaggacccuggccuguggugcguggccugggggcuccccccgagaccuccagucucggggccgcuggcaggacguggagcugccggcagggcccagggaccgcacaggaggggcgagcagcacuggcuccggaaugcggcucacggacaccuguacucaggagccugagagucaggguaccgacgucugggcuuucaucuuaagccgcccacuaagaggaggugccccugucuccaccgccugauguccuccuucaaagccgacgccugaugucaccgaagcauggagggaggggcgcugcacuccgcucacgcccgcuugccuguggccggggaggccgugcuuauaaguccaugucggacucugccaccagugucuuucugagccucgccccgcaggaggcacagcuggacccgugcaugggugggcagguauaugcagcacgccucccacacaugccugaugugcauggcagcccgggagacgggcacaugccgucacauccagccccagagcaugugaacugcugguggcaccugcugcaugaggcgggcuugccucugcguuuccaacuccccaccgugaaauccuccccacugagaaaaacaaaagcccuucucaggccuuccuugcagaugccccucaucagucccucuccagggaggggaauccgagaggagggggcagauggccagagccuaggcaaaggggaggccagggccggccucaggucaugcaggugcccugccaggcccuauggccagugugccuugcaagggcucaggugggacaggaagacacaggcugagcuggugaccagaacacaggggauaaagauuagguaacagcugggcuggaaacugcuugcagcaacccuccgggaugggggguacugggagggucagagggcagggugcugcaguguccaggucgagacauacgugcacauccaugcacagagcgggaugcugggacaggaacucucggccuccgccugaacccaccugugugcuuacagggccgcagggguccacugugcacucaccgugccccgacccugggaucugcugaccuacuugaaagagcaggacucagccgggcgcgguggcucacgccuguaaucccagcacuuugggaggccgagaugggcggaucacgaggucaggagaucgagaccauccuggcuaacacaaugaaaccccgucucuacuaaaaauacaaaaaauuagccaggcgugguggcgggcgccuguggucccagcuacucgggaggcugaggcaggagaauggcgugaacccaggagguggagcuugcagugagccgagaucgcgccacugcacuccagccugggcgacagagcgagacuccgucucaaacacaaacaaaacaaaacaaaacaaaaaaaagggcaggacuugccucccugaaaugagaacagaccaagcagaaaagcccaaggugccacacccaggacaggcccagccccgacaccuggggacucggccacguguguggguuugacguguuuucuuuuguuucguggccuuuauuuuucacguccucaauccugggggaggggcaucccuuucccacccaggccccgacucugacagccuggucuggcugcagaggccccacagggucguggacuuagccccauggucucccuggguccacugccuacaggggagccccuuccccaagggccucuagccuguggagcacgugcgcaccacacacacggcggguguccucugcgcacaggcugggacacacucccuaagcucccgucccacagagcagccaacaaagggccuuggauuugccuucccuccaaauggcuggagacucggcccagaggccccgagacgcagggcucaggaaaacacaaggccucaaaaugcgccggagcagaacccggacagaggcagagagaggccucaaggaagcacagcccccagggccaggaagggggacagggagggcccaggguccccgcuccccagcaugacacagauggccagggguccggagauggucaugaggccacuucucuacggcuggggaggccugggcugagggguggccagagucccaacucacaguccuuccccggcacugaccgccagcuuggggaccucaaaucacaaacagggacagagcacagcagcgugacaucaaacgccagcccggcuuugaugugcggcuccuccagagggaucagauucccucccucaugcgggaucucagggagggguggugggcaaucgguuccagaccuucuacgccggcccagugugcaggacgccagggcccgggggaaauuccagcgcccgaggagacacagccccuacucccccucccccacgcagaccucugcaagucccaauguccgcaggggcaagacccagggccucccggggaccccaggccaggccaagccaccagacaccaugcuccgaagccagaaaugcaagaagugcuuuggggcgcuuccgcgggugccugcucgcagcaggguacuggcacacucucacacacucuccagccagcagagcuccccacccggccagggccagaagccagcgggacggccaggagggcagacacgccucugcugcuggcuucgagggcauauucuuuaugcaccacaaaccccgccccgcuggggccccgcuccggcaaggcgcggcugugugcuggggacaaggcagugagucuagagcucucuguguucauguccugucuggguaugacaaagccgggcgcaaacacaggugcugacgagagcccaggcagcagcaugcgcccugccgggaacagaagcuguggcugcaggccaggagccacugggcucagggaggcccgcagagggcaucacccaccacaugacagcccagccgccaagcggcuagacagagccugggagagccuggggcaggcuccggccuucucaacccagccagguccagacagggauggacaaggauggacagggauggacaggaauggacaaggacggacagggaugaacagggacgggcagggauggacagggacgggccgcagagcucugagcuggcccagcagcaugcacagacccacccugaguguggccacaggccagugcuccaccuggcagagcccuguccucaccagcagcccaucccuacaccccagcacacccagagggcugcagaaaucacccagcuuucccggagccacggcuuuaccuacagaaggaggaacaggcugagaugcacucagccagcccccaagcacugagucaaggcugggagcagagggcugggggccugggaagagauccagccaggggccgggcacacugggggccacucccaccuggggugcccacgccagcacagcccgggggcaccucugagagaggacaaauccccuccauggcugagcucaugaaucugauuuacagaaagcccacccugcucccucacggucuucagauggaaagcggcucagcugcugugugaguucccacggcucacccuuggcaucguuccacggcaggucucggucacccacaacaguccccgguucucuuccugcucccagcagcucagcaugguccauccacaccccugccuuucaccacuuggcaacuagguccuuacgggacgugggauucaaacuacgggacucgcccgccugcccucguggacugcccagacgugcuacaguaucccccgagucacaguaugaccuccuggggcuagugccugcuggcucuaaacccauggagagaaacuccucauaggaaacccguuagcauaacaaucuguaccccagcaaagaugcuggucagaaagguacucccuuuccuccuccgggugccuccaggagggccguguacccccagggcccguaggccaugaaauccucauuuccaucucaugcgucuccuaucacggaaggcacacuccccguaauaaagaucucaaacuagacacaggcccaccaggcaggcagagagcagugucccccagagcucggcguggaagaucccaaacucagacacaggcccaccaggcaggcagagagcagugucccccagagcucggcguggaagaucccaaacucagacacaggcccaccaggcaggcggagagcagugucccccagagcucggcguggcuguucacaccccucugugcugggcagaaccuucagacuauagggaaaaugggaaagcucgaagccagcagugugcagccucugucuccugacgcccucccugcagcagagccugagaagcagaguggagagcgcccaguccacgaggacccggcccagaccgagaugcuccaagugcaccauacaugcaggucucaaggacucugcacaacaagagcaugagacggcucacuuuucuacugacuacguguccaggaagucguauuuuggguauacugaguuaacuacacguauuacuaaaauuaaugacaccuguuuuuauuucuucuuuaaugcgguuacaagaaaaagugagugauuggccaggugugguggcucacgccuguaaucucagcacuuugggaggccgaggcgggcugaucaccugaccagccuggccaacauggugaaacccugucucuacuaaaaaaaauacaaaaauuagccaggcgugauggcgugcgccaguaaucccagcuacucagguggcugaggcaggagaauugcuugaacccgggaggcggagguugcagugagccaagaucgcaccacugcacuccagccugggugaaagaaaagaaaaugugagucaccuccauggccgacguguggcucgcugguaucccugaggccccugcugcuugagacgcuggucgggccagggcugcgugcuacagugacacccucgcaguggagcugcaacguuucaaacacguggcaguguccauccaaggaaaucacccagggguccccaaauacacaaagcaggcucugucccagggcaacuccugggcacgcuacaggccugcagcccccagccucagaacgccccuucgaagcacagcgccuacacugucccuggacucagaccuccuccgaaacacaugaaagaagaaacaucagcuucccgcccgucccacucugcggacaccuggacuucccaaggccuccccaagccuccugggccagugcagggacacuaggcacgagagccucccucccucaugcagaccugcuggggaccagcucccagcagagagcccaccaggcacuccacccucaccguggggcuggcaacgccacccacuaugaaaccucguccauauccugcuccaugguuagcaaacuccagcuucugggacaaagcuugggucugagcuuuuagaaauuuauuuaauauuuauuucugagacagagucuugcucugucgcccaggcuggaaugcaguggugugaugucggcucacugcaaccuccaccuccugaguucaagugauucuccugccucagccucccaaguagcugggauuacaggcccucaccaccacacccagcugcuuuuuguauuuuuaguagagacgggguuucaccauguuggccaggcuggucucaaacuccugaccucaggugauccaucugccucagccucccaaagugcugggauuacaggugagagccgccaugcccggccuggaaaugaaaugugaagaagcccuaucuuaaauuccaccucuggaauuuagcccacaggagaagcuggggugggugaccaggugcaaaggccuccagcugcacacucugcugcaacccugcccgggaugcccugagacacagccagaugccccgcaacacccacaugacacccacacgacggaagagcauggcugugaggagugacaggugcgggacccuucaggaagauguccacagcauauucaccagcaacaacagucagccacaaaucacucuccaccacaggugugaguguucaucaaaugagguguacgugcagacacacccgcagacagacccacacugccacacagaccagggccgcaggcugggggcuccgggcuuuaccaccaacggccccaccaccuccugcugucccuggugucucgaaagagcugccccacuugcucuuguuuuuuuuuuuuuuuuugagacggaguccugcuuugucacccaggcuggagugcaguggcgcaaucucagcucacuacaaccuccgccucccggguucaagugauucuccugccuccugaguagcugggacuacaagcaugagccauugcgcccagcuaauuuuuguauuuuuaguagagauggguuuucaccauguuggccaggcuggucucgaacuccugaccucaggugauccacccaccucggccucccaaaggguuggaauuacaggcgugagccaucacgcccagccacuucuguuguuucuuuuuuuuuuuuuuuugagacagagucucgcucuguugcccaggcugagugcaaucuuggcucacugcaaccuccaccuccuggguucaagcaauucuucugccucagccuccugaguagcugggacuacaggaacccaccaccacgcccggcuaauuuuuguauuuuuaguagagauggaguuucaccauauuggccaggcuggucucgaacuccugaccucgugauccacccgccucagccucccaaagugcugcgauuacaggugugagccaccgugcccagccuuguuguuucuuuuguuuuuuuguuuuuuugagauggaguuuugcucuugucacccaggcuagagugcaauggugcgaucucggcucacugcaaccuccuccaaagcgcccaaacccacccccacagccaccaccaaagccagcuccaaagccacuuccagaaccaccacgccuggccaagccuguuguuucuuaaacuaaguuucacacgagguuuacaaagucuguugaagaggcuuaugcuaccacaaugccggccccaccucuccagacacccucggccccuccccaguggcagccccaggccacucugggccauuuccuuaccuccauccccaucugaggacugacagcacagccagggaggacggcccucaccaagcaccugugccugugggagcacuggauucuguucacgcccgggggcaccgcccggcccaggggcauuuccuuccagacguucaucuuuccugacuucuguuccccgcgcuguuugguuuucuucuugcccucugccacucucgucucaggaagcagcacagagccagggcgccgggaucccugcuucucacccagugcccacacagcgccuggggcugccugccucccugcccggcgccacuccuggcucgggucccgcucaccccugcccguggcuucgcuuugcucucaggcuccgucaucuccugccucgggucccgcucaccccugcccguggcuucgcuuugcucuuaggcucugucaccuccugccucgggucccgcucaccccugcccguggcuucgcuuugcucuuaggcuccgucaucuccugccucgggucccgcucaccccugcccguggcuuuggcuuugcucuuaggcuccgucacuguugucugaguuccguuuugggagggagaauuccgugcucgugcuuaacccgcugccaucuccaggggccuccauucaccccgacagccacugggguggcuuccauccccaugaccacugagacccgacgugcagaccucagcgcucucacccacgaacgcaacacccgugccaugcagcgcggcacuacugucagacgggagcaggcccagcccuggggccaccaagcgcgcccaacgcacagucaccuucccagcgcccgacgcgcggucaccuucccacaggcccuaugcucgguccucaagacaugaacucaccccauccacacaccagccggggcacaggugaggaaacugaggcccggggagggcgagaacccccuggcucacagcaaaccccagccccaagucccuuccauucugcugagccuuuuacuguggacagagacuuccagccaacgaugaaaagacccaaauugacaaagcaccaauuuuuacacauucaggaacaacguuuaaaccauuaaccgacagaaacugauacacaucaauuacuuauuuuuauuuauuuauuuuuuugagacagagucucguucuguugcccaggcuggagugcagcagugcgaucucggcucacugcaacugccuccacggcucaagugauccucccaccucagccucuggcauagcugggaccacaggcacgcaccaccaugcacuaugccuggccuaacauuucuauuuuuuguagagaagggguuucacuauguugccgaggcuagucuugaacucaugagcucaagcgauucgccagccucggccuuccaaagugcaagccacuuugcccagccacugugcccagccacugugcccagccauccaauuacuauuaggaagauuuucugguggggcacaggagcucacaccuguaaucucaacgcuuugggaggcugagaugggagaauuucuugagcccauggguucaagagcagccuaggugaccaacauagugagacccugccucuuaaaaaaaagagaccuuaugaucccauccaggggaaucaagcauggggagcccugcccccagcaccgaacgucuccccuuagugcucaccaggcccccacaaggacagaagcacauuccugcucuucuaggugggcaaggcugggccgcugggcccaggaaacucagaacgaugagcugugaccagccauccccgaggcugcugcucaugaaccggcagcccacacaccccuccucuacaaaggacugcaaagugccaagaggcaccacaggccagcacagagcuuggguguccagcucugaaccagacccaguaaccacagcagcuuccccagcaaacaggguagggaagagcccccagcccacugaugcucaccugaucuguggaaaauggcugagaagcucccagagggucuggccugaacagaaagaguccugcaaccucgagccaucguccagcugcaaagcgaugcgaaccuggaggguauaagacaugagaaacuuccuuaggaagaaaagcaacuauuccuucuaaaucccagacugauucuccagacacagagagggugacugccccgcccuggccuccagggagaggcugacccccacggagaaggcuacccuccuauucacucuggagugagggccuuggaggcuccccggcagggcugcaccagcaugcgugugugcaugugagugugcagguaugugcaggugugcgugcgugugugcauaugugugugugggugugugcgggggugugcaguugugugcagguauguguguggaugugugcauguuggugugugggugugugcaggugugcgcaugugcgugcagaugugcgugugugugcauguuuacaugcaggugugugcggguaugugcgcagauguguagguguguguguacaggugugugcgugggugugugugggggggaggugugugcauguuggugugggcggugugugcaggugugugggggggugugcacgcaggugugugggugugugcagguguguggggugugugcgggugugugcgggugugggggugugugcacguugcuguagggguguguguggguguguguggggggugugugugcgggggugugcagguguguguggggugugugcagggguguguggggguguguacgggugugcggguauguggguguguggggguguguguggguguguguggguacaugcaggcgccacaggagugaacuguguuggagacaguccucgugucccagugggggcuucaaaagauugcagcuccaccgaaccugacugcagccucaggacagacacugagcuaagcugcucccagauuccugacccucagaagccacaugagaugguaaauguuugcugcucuuuuuuuuuuuuuugagacaaagucucacucugucgcccaggcuggagugcaguggcagcacaaucucggcucacugcaagcuccgccucccggguucacgccauucuccugccucagccugcugaguagcugggacuacaggcauccgccaccacccacggcuaauuuuuguauuuuuaguagagacgggguuucauuauguuggccggcuggucccaaacuccugaccucaggugaucugcccgccucggccuccuaaagugcugggauuacaggcugcccuugcggcauccaugcagcgcuuucggcucuaacauucugggcaauucuaugagcagguggucaggcuggugggugaaugcugcugacacccugagccagggaaggcacaacugaccccagaaagaaagaaaaacuuccacaugaagaaugacgugggcggggcgcagaggcucacgccugcaauccuuugggaggacuuugggaggccgaggcggguagaucaugaggucagcaguuccagaccagcaggccaacauggugaaacccugccucuacuaaaauacaaaaauuagccgggugugguggcgggcaccuguaguccuagcuacucgggaggcugaggcagaauggugugaacccgggaggcggagcuugaagugagccgagacugcgccacugagcuccagccugggcgacagagcgagacuccagcucaaaaaaaaaaaaacaugagaugcucauuuucaguugccaguuaucaaaaaacaggaagcuguuugggcccaacccagggaaggcagaacuggugcuaagacucaugucccuccuuccccagcaccccccacugucccgucccccgucccuggccagcugaacgauccugugccccacacagucagccucccccagagcacgacccaccauguucucaggccccucacggcuccgggaagcgggcaccaucuccagcuuggcauuguugggcagguuggcaaaucuccacuggagagaaaggucgagcacgcuccucugaaaccugcaagacagaccagagcacacuugcugcccugcagagccugacacgcccugccauccacgccccgccauccccgucccaccauccacgccccgccauccacgccccgccauccacguccuguggcagcuccccaacagcgggacgucaugaccugcagaggcacaaggcggguccccgaucauauggggccuccugcaagcagaagggagcaggaaaaagggagaugugggccucggugcacgccgagggggcugcuccuucagagucuggggugcugacagccccagugcagacgcucggaaaacacagagagaacgacuggggcgugaacacugcugcacucgcggaagcuggagugucacagaccccggccgucacggcuggagccaccacagaaaaccugacugcccgggcgcaguggcucacgccuguaaucccagcacuuucggaggccgaggcaggcggaucaccugagguucaggaguuugagacaagccugaccaacauggugaaaccccgucucuacugaaaauacaaaaauaucccaucucuacuaaaaauacaaaaaaauaagcugggcaugguggcucaggccuguagucccagcuacucgggaggcugaggcaggagaaucgcuugaacccgggaggcagaggcugcagugaggcaagaucaugccacugcacuccugccugggcaacaagagcaaaacucugugaaagaaaaaaggaaaggaaaggaaagaaaagaaaagaaaagagaaaggaagaaaaagaaaaagagaagaagaaagaaagaaagaaagagaaaacaagaaagaaaaagaaagaaaagaaaagaaaaaucugaauauacucaaagugguuggccucacuuuggaaaugcaagcugcugucggagacaacuagugaagagaguucagacagcccaggggcaucuggaagaauuaagagagaacaaacuuugcuauaucaacacuggccagaaaagugagucuggaaauugccacaugaaaugucuacgucaagacaggauagcagaucgggggaucccgagggcaggcaggcugggaaccuuggagcggagggcacuguucacgccuggggcugcauuccucugcaccggcugcacuuuguaagcaagugguaccauuagcagaggaaaagggcaccugaaaacauggcuaugguauugcaggaccugccucaaaaucgcacucacugguucccaccagacaccaccacacagaccacgggcaggugaacacugagaaguaacaaugcgcugggcgcgguggcucaugccuguaaucccagcaauuugggaggcccagacgggcagaucacuugaggucaggaguuugagagcagucuggccaauguggugaaacuccgucucuacuaaaaauacaaaaauuagccaggcaugguggcacaggccuguagucccagcuacucgggaggcugaagugggaggagugcuucaacccgggaggcggagguugcagugugccaagaucgcgccauugcacuccagccugggcgacagagcgagacuccgucucaaaaaaaagaaagaaaaaugaggccaggugcaguggcucacgccuaucaucccagcacuuugggaggccaagacgggcggaucacuugaggucaggaguuugagaccagccugguccacauggugaaaccccgucacuacuaaaaauacaaaaauuagccaggcguggcacgugccuguaauuccagcuacucaagacgcugaggcacaauaaucgcuugaacccgggaggcagagguugcggugagcugagaucaugccacugcccuccagccuaggugacagagcaagacucuguuucagaaaaauggccaggcacagugacucaugccuguaaucccaacacuuuggaagaccaaggcgggcagaucaccugaggucaggacuugaagaccagcaugaccaacauggugaaaccccgucccuacuaaaaauacaaaaauuagcugggcaugauggcgcacgccuguaaucccagcuacucgggaggcugaggcagaagaaucacuugaaccugggagacagagguugcagugagccgagauagcgccacuguacuacagccugugugacagagcgagacuccaccucaaaaaauaauaaaauaaaaaagaaauaaaaaugaaacccuaagccccccccaaccaacugaaccagccuccucuuggcccaggggaccccagaaaccuugaaagcugaguuccuggccauggcugggugggagaucagacacaucugcaggcucucuucccuaagggauaaacagaaagcagcccuuuccaaagaccccugggcugguaucugacaucagccaaccucccgccaggcccuucucucuugcgguuucuucaaaacaacccacagguauuuccugauaagaaaccaccaaccauggagugguucuggcacagucaggguuuucguggcacagucuucauguccucugauuugccauuuauuuauuuauuuacuuauuuacuuuuuuuguagagacagggucucacuauguuccccaggcugaucucgaauuccugggcucaggcaauccuccgccucgggcacccaaagugcuaggauuacaggcaugagccacuucacccagccugcuucaccucugacuucagaggccaaaaauuccacccucaggucaugcuggcacugccauuuuuugcacauaggacccgugaagaggcaggaagcucaacugugugcacaguucuccuuucaugaauacucaugauccuccuacagcguauuaaguacgucuguaucagccaccccauucgguguaaaucccugucuuauucuucccucucuugaagugucuguuuccagcuucuggcuggaggcuacacuucccagccuguuagaauggccacccugcaagcugcaaccgguuaugagaaauaaagcccuccuuuccaaacauaugaaccgcauucuucaguugacaagagagacuggagaaggauggugugaaggucuggggcagaaagcccaagaccaccuggcauucagagcacagguccugggauucucacgugguccagacacaagguagaagacuggaaugacuuggcagguaucaccccuaagaaacuccucccaggagagccucguaaggcagggugggcaaugccaggagggcaagcuccugcccucugcccccaguguuaggacaacaguacuguaaaaacaggucuucaagggcaggcauggugacucaucucuguaaucccaguacuuugggaggccaaggcaggcggaucacaaggucaggaguucuagaccguccuggccaauguggugaaaccccaucucuacuaaaaauauaaaaauuagcuggguguguuggugagcaccucuaaucucagcuacucgggaggcugaggcaggagaaucacuugaaccuaggagguggagguugcagugagccaagaccgugccacugcacuccagccugggcgacaagagugaaacccugucucaaaaacaaaacaaaacaaaaaaaacaccagaaaacaggacuuuaaagugaaaagcuucgcgugugggauagacacgcacauccuauccauaugagggcucugacccuucugcugucucagacuccuugagagucuggcagaagcccucucuugggaacaauauccccacacagaagcguacguguaauuccaggggcugugagacugcagggauccaccugcaguuuucaaggcauccuauuucuccacggccagcucuuuccccucagagccccacugggaacuuaugcaacucaaugcaauaaaaccuacaggggguugaaugguggcccccccaaaaaagaugggucaauguccucacccccaggaccucugaacaucuuacuagggauccuggucuuugaagauguaaugauaaaucguucuagauuauccaaguggacccuaaauccaaugacaagggucuuccugagacacagagaaaacaggaaaaggccacaagaaaucggaggcagagagcaaugcggccacaagccacagaacgcuuggagccaugagaagcuggaagaggcaggagggauucucccuuagggcauuuggagagaguguggcccugccaaggccuugggucuccagaguugggagggaauauaugacuguuuaaaaccaccugggggcuuuuccaagugagagccaguauguucagggggcaggggcacagauauacucagacccugcugcugagcuggagcaaacucacuucagaucauauucacagggguugaaguccugccgccggcacguguccuccagaaccugggggugagaugaaaggauggugaacugcugagugugcagggcuggcgggcgcagugggccaggucagccaagggcauucagcuuccuggugagccagguggcucugcccaggcaaagccaagcacaagaccacacuauggacgguccccgcaacaaaugcaggcucucaccugcaaauccuguccacucucccucccuucuucaccauccccucaguuuuguaggaaagcuccacucagaguuccccugcaguacagcaacacgggcaucuuccuggcacacacccugggcucuccuucaaacccuguaguucugcaaccugccuuaaacuugccuagcacaagcuacccccuggcucuggcacgguucugugcaccugcugccacugccugcaccgccuccgccccucuucuccauaaaaagccaaagccguggccuugcaccaaggggucccgcgcagccucugcgggagcgccccacuuccgcacucugcacgccuggcaccaacagccuccuggcugcgcccuccaccugcccaggccuggggaccccacgccgugggcugcucccgcaaacuccgagucgugugcaccuucggauccucacggucccccacgcagcagaggcucaauaaauacuuuuuuuuuuuuuuuuugauauggagucucgcucugucucccaggcuggagugcaguagcgcgaucucggcucacugcaagcucugccucccagguucacgccauucuccugccucagccucccgaguagcugggacuacaggcgcccgccaccacgcccggcuaaauuuuuuuguauuuuuuuaguacagacgggguuucaccguuuuagccaggauggucuugaucucuugaccucgugauccacccgccucggcaucccacagugcugggauuuacaggcgugagccaccgcgcccagccaauacuuuuacauuuaauugauucgcggucacaaggugcccaaguaaaagugcagugagugacucggcaaaaaucgcuuccaggccccacggccgggacaucugccaccgcgcaacccgggcucccgcuccgggggacgccccggaaugggaacgcgggucuagggcuccacuccucccucuucccggcgcccucgcgagcugggcucggccgggcgccgaguacucgaugcgggugacacgcggcgccguucuaccucaccccugggaaggcucgccaccgccccgcccccacucgggacccccgggacccccgggaccccagcggaagcgcaggugacggcgagcagggggcggggccgccgcucaggaggccgcucauuggccgccgaggccccgcccccgaacaccgggacgccgaccgcaaugggcggggccucggcgcagcgccccccgcccgccuacccguccgccccgggcgggcggccgcaccugaagcagcacggugcucggcgucaccuucaccguguggcgccggccguucggggccagcaccgacaccgcggagccuccgccgccugccggggccgccauuuuccgcucacgugacccgccgccgggccggcgucaaacaacuuuaucggcaacagccaggacgcgcagccacgcggccagggggcggggccgcagc

SEQ ID NO: 192333 - RNA, 1170 nt, Homo sapiens
ucacgccggggcccugggacccucgggcgcaggucgggccggggccgcuggggccagcacgaggcugucagugggcugugggcugcaggaagacagggagcggcccgaacagcgcuggaagcgggcgcggggcugcagggagggaacgggcccccggccucccccgcugcccgggccccgcacgcggccgcgcagguggucgcgguaguuccuggugagcagcguguagaggaagggguuggcgcagcuguugccguaggugaggcagguggucagguaguugacgaugcgcgccguccgcggcgccagcggggccuggugguacugggcgagcagcugccacagccagaagggcaggaagcaggcccagaagagcagcacgaugcccagcaccaggcgcagcgcgcgcgcccccggccgccgggcccgcuugaaggaggcgcgcugcgagcggcgguaggcgcgggccaggcgcgcguagagcagcccgaugagcagcccgggccccgcgaugcugguggcgaagagcagcgucagguaggcgcggugggcgcgcgggccccaggcgggcaggcacaggcucuugggaccccggcgcaccagccgcauggccagcaucacgggcagcgucagcagcagcgccagcagccaggugcccagcgccagcagcuugcgguagcccuuggggcgcugcacgguguccagcggccgcagcaccgcagcguagcgcucgcugcucaugacggucagcgugaagaugcuggcgugcauggucaggaaguccaggccgaagagcacgcggcagcccacguccccgaagugccacuccuuggugacguagguggccacgaugaaggggaugcugagcagguacagcaggucggccagcgccagguugaccacguagacguacauggaggccaccgcacgcagggagcggcaggugaccaccagcguguaggcguugcccaccacgcccaccacgcccauggccgacagcagagucccaauggugcccguggccaccagguccuccagggagcugggcucggucgggcuggcccaggagcuguugaggguugcguuggggccgccaggcggcuccggcacagagcugccaguggcggccagcccagggaagcugcucggggacucgggggucagcgccau

SEQ ID NO: 192334 - RNA, 24265 nt, Homo sapiens
ugcagcuuccacucuuuauuuccaaagaaucagugucacacaugcagaucacaaagcgggucucccugugcugcuuccuucuguguuuucuagucucucccccaggggcugcccagggcccucaggaacugagugugggcaagacacugcugggccagagggcacgacgcccacgugggcccguauugcccaggccauuuggcagugcagagcccccccagccuccagcaggagcccccuggcaugagcucuccccucagggguccugagcaacgucccugccagggcugguggguggcagcgggggggcagacaccucgcugagguccugcagcagagcuugcagccgcugcaggcuggggugcacguuuuccuccagccacuccuccacggcauccggguagaaagccagcugcagggcagccuccagcuccugcacgagggugcuccacugugccaggaggcugcaggugagggcgccaugaacgcacagucugcacacuugggacuugcccucagccccauggucaguacugcccugugccucaguucaccugugaaauggggcuacugacccuaccucaucggcaugucgggaggaacaagucggugacagcugcacaucugagaccagagggccuuuuacaacuaggggcucacccucugcucucuaguugagggacaugucagcaacagcagcaguucucagggaacccauggcugcacggccuauaagagcccagggccucaccugagcgcugcgggcuggaugugcugaaccaugaccggguggaugagcuuccgcuggcggugguaggggcugaaccagccagugacauaccuggggcaaauccacauaggggugugccgcgggcuaccaaggcagccguggggcggcuuugcaguaauacagaaaauguuuaagaaugggguugacauuucuaagucuuaugucccccagaaagucuuugugaaggaugaggcugccuccuccugugccugggaguggggggacuugugaaccugccccucaccagcaccugucccuaccccccucacccacaccugccucccacccacaccugccccaugccuucccgcuuacccacaccugccccucagccgcaccugccccaugccugccugcucaccugcaccugccccucacccacaccugcacgcucacaccugccuguucaccugcaccugccucccacccacaccugccccucacccgcaccugccccaugccugcccgcucaccugcaccugccccucacccgcaccugccucccacccacaccugcccccucaccugcacccgccccaugccugccccccucacccacaccugccccuaacccacacgcucaccuguugcccuccagcagcgcauccacagagcugcgcagauggaggcugacuugugugacaagggcaaggauguugcugccagggaaggagccggcccccucccugcggagagcccugcugagaacagcugucuccacgggcgggggaaggggaggggaagaaggggacagggagggcugcagggugcuugccuaacaggguccguuuuuuccaggcuggaaaucccgagaagguucuccacuuucgcuuuaacaucuucaucaaauccuccugaaaucacaaaugagcggggcgguuggaggggccucuggaggaggggagggggcuacauugggaccugcaggccuagguacuggggcagugggcgggcggcaauggagagccacuggccaggcccagccccgcgugugccggccccaaggggaccugggggcaaaugggccugcugcuucucuuuaaacacgugaaauacguuccuuauuuuaaaaaucagaaaacagaaguaagacuguguugccagcagcaacacccggacagcaaguggcucuuccugcugggcgcagcccgacccacacagguguccagggcucacgcagaguuugccacuguguuuuacacaaucgauggaauauucuagagcacccgaaacaaacccaugaggccugcaggcaccagcguggacgaaucuccgacuugguguucauggaaaugcuugcugcaagaggcugacggccagagggcaggagggaagugccccagucacggguggcggauggggccgugggcaagggacacugcaaauaccgucaauauuaacacagcucuuuagugugggguacaggggugucuguuuuuaucguuucugccccuuucuaagcaguugagagucagcaacugagaagucaaucugaucucauucugcguccucucaccggccgcguccccgucccugggccgccgcgccugcgggucccgcucuccgcgcgucucggccauuuuucuuucugcaucagcaccacgcagucgcuaauuucccguguggccugcgaguuuccacacacacagcuccucuggccaagcccccugccgaccccaagggguuccccggugccugccccugcccaugggucccgcugcucccucaggagaccuggaagugugagugcuggguccagggugcggggccuuccagggccgggcgccugagccccacaccugcucggccaggugggcaggacgugugugcagcaaagguggagccguuccccaccuccgaccugcgugcauuucugcggauucacugugucugaggggugccucccgcgucacucuccagccugcuuugggcuuaggccuggagacccagacacaggcccagccuggguggacuucagggcagguggguggcugagcuggggcggugagaccauccuccgacugugaggaccaccacaguccagcagggugguuggagcacugggugcuuggccuccugcccuccgggucuuucggggaggggccgguggggcuugggguggccagaccagacauaccgcguagaagcaacugcaggcaggcggccagggacgggacuccugcgggcagcagcucgcacagcacagaguaguggucguaccuggguccaugagaggggcgcuuagcuccgcagcccgcccccagcagccugacgcaggcgcccugacuucggacgucccugcuguuguuccagggccuuaggcuacaucagcgcugggggcagcccgacccccucaacccauggggcccaggguuuccaagacagguucugugcggcagggcucucaugucaacuccguucuagaaaccggacaagugaagagcguggggauuccuugcugcaaugcucuccggagccaugggaauucuggguggaccuuggguggguggccggucguugucccuccccccagcaccucuggccucugagaaaagggcuccugcuucugggggcugcccuugacgccccccuccuagggccuccgggccccuccugccccacccucucccucggcugccuccugucuggcugguggggguggcagcuuuuccccaaggccccaugaggagggcgagagaucaggcguggcaggcagcaggucaggggcagcaucugucccaagcgagggcuggggggccuuggccuggccugggcuucccacugcuggguagggugccuccaccugcccgugccucaguuucuucagcugugaggugggugacagacgcugccccaggugugagcacaggcgaaggcugggcaaugccugacgccacagccccaggcucgccugaaggaugcgccgcugcucugggggaggaggagccucgccccgcucuauggacgauccugguuuaugcagacagagcuguaucccaacaggacagugggaacuaucuagaagcuucugcagagccgcugccagcuccggacaugcaugguggcugugagcugccccucuagcaggcuggcccaccaggcucugcgguccccaccaugaaauucuugacuccaucucaaucugagcuuugugggugagggcacggggccccuggugggucuggccuccagccguucgccuagcccacaucaccugcgccaccugccccccaacccucuaacuugagacgagacccaaggucaggacuuggccggcgaccagggguuuaucuuagcucugcuuuucacacagugucgucaggggagcaggggccugggagcgccagggugaugccacggaggcccagcuccuucaugggacuaacaaggcccauucuugccaggcaggacccacagucacaggauuuuuacagcugaggaagugcuuagauaccugcaggggccacuccuacaacagccgacaguccuggcauccccacacccacgacagcaugugccuucuaggucaccagaguuaggcuuccauaggcuacacacugaaauguccaggacaguuuucuuuaaaucauagaguaauacauuuuuuuuuuuugagacagaguuuugcucugucgcccaggcuggagugcagcggugugaucuuggcucacugcaaccuccgccuccuggguucaagugauucuccuugccucagccucccgaguagcuaggaucauaggcgcgugccaccacgccaggcuaauuuuugugucuuuaguagagaugggguuucaccacguuggccaggcuggucacgaacucuggaccucaggugauccacccgucucagccucccagagugcugggauaacaggcaugagccaccgcacucagccccuagaguaauaaauucugucacacuauuggcccacccacagguagcacagcuuaguguuuacguagacaagacccugauaugagaaaaacggaaaacagagcugggcacgccuaugcuggccuuccgagggcuccaccucugucacugggcaccuuucagugacccucccucaccacacuuggccuugaauucuuuccugugugagacccaagaaccuucucgugggguccgaauugagacggcauuucuagcaacagagugaaauccugaaagaaccgaaaccccuccucgugccacaagcaagacacacacacacacacacacacagccucaggugcggcgcacacggguagcaugggggcugggggccacguguucgugacccugaacacgggagcagcgucccucagcggccgcucuggcgugcagggcccaaccccacguggcuguuucugcagcuccucuuggaggcccgggcugcuuccccuuugaccaaccugggaaggcccuuggcggacgcugcacaggccgacgugguggccaccagagcugcccuggacccucugaggacagacuggccaggacuuaccucugccagccggucaggaugaugcccugcagugaguccgugggcccgcugcccgccaccugcagccacugcacgugguuccugagguggugcucaacagggggcacggccuggcugggccccguggcacccuugaaggcacuggcugcccacagcugcggaaagccgcaccgccgguacuucugcaugaggaggacugggugagaaagcaaacaggugaguggcuccaggggaggcggccaacacggcccuggacacgccucccggggcuguacccagagccaacaugggagccgccugagacagccaggcccgggucucaguguaggagacuccagaguguaugcggccggcccgggucccagucggggagacuccagaguguacguggccccugguucaccugcucacuaggaaaacacugguggaacagggagggaggugaggcaccggugcacgguggccgucccgaggcaccaugggcuggggucugcuggggcugugcccuggccucuacccgugcaggcuccaggcugggcaguuccggcugcagggucacagggccagggauggccuucccaggcacauggccaggacaacacaccccccacaacuuggcacugacccuugccgugcacauccaggucggccguguagucccagagcaccggcuccaccagcugcggcaccccggacgcugcagacagagcggacgugagguuggugagacaccuggaccacacucucagccccucggacccaccuguucucguuuugcuugaaagugugagcacagauaccuuuuuaagacagacuuggcaccgugcuggguuuugacaaugaaugccacaaccacacacagugccuuuccaagccagcgcccgcuggagcgaccaugcucccacugcugcucuaccaggccaugagccacaggcacagcuggagcacgcggcugaauggaggucacucuaagucaucuauguggccaugcauggguggaagcugccaggccggcacggcccuaggacacccuggcucccagcucugcuauggagcucacugagccucggggcucuguguggaaccaggccaggugucugaguaccaccucuuggcccagaaaggcgcucagcagcucgucccaaagccucaggcagagcgagcagggcccaggggcuggaggagcagccagcgggaaccucggcccccagucccagcagggauggccuuggaggaggcugcugcgagugcuggacacucccaagcccucugggccaccaggcaggccugugcucuccugcccaaaccuccacagcuucuagggaaacgacucaggccuggcgucaaggggaugcaggaggugguuguggcgggucugugcggggcuggggcucacccuggggcccacuuccuacagcaccuucuuucuuugaagccgcaggucuugggcaguucaguggcccacccccucccccagcccuguuggccgaccugcgagcugguccucaggcaggucucggagcaugucgucccacaccaggggugucacgcuggggcgccgggccuucacgccgcuggccaccgcccgcaugugugacaggcacaacuuccccgugcuguucugcucuugcuguagccaccggcgcgaggccucccccucuccgagguaauagaccugcaaggaaggagcaggacgggguugccuuggcagccgugcacaccggugggaggguccgggguucacgccgugcccugacggagaggggccgcugccuguggggaggaggccagggaggggcucggagccuuugcuuaccacccccagcgugucccugucuuccucacugagcccugaacuucuacucaagguuuccugugaauguucacagcagcucuucucacagccaacaaagcagagaccacagggguccaucccccaugauggaccagcauagggcagcaucccccaccaugaacacggcucggcuucagcagacagccaagcucuggcagcugacagcccggaggagcacaggucauacacugugugacucgguacccguggaaugcccagacgggcaaauccaccgagauaggaagcagaccguggucgccggggccugggggcaggugcggggcuugcccuggggugauugcccacaccaugaaugucuggaagaggugcugacguuuauacuuauuuauuuauuuuggagacagggucuugcucuguugcccaggcuggagugcaguggcacaaucucaaucucggcucacugcaaccuccaccuccuggguucaagugauucuccugccucagucuccugaguagcugggauuacaggcgcccaccaccacaccuggcuaauuuuguauuuuuaguagagacgggguuucaccauguuggccaggcugaucuugaacuccugaucucaggugguccaccugccucagccucccaaagugcugggaucacaagugugagccaccgugccuggccuauuuauuuauuuacuuauuuauuuagagccggagucucacucuguugcccaggcugguaugcaguggcgugaucucagcucacugcaaccuucaccuccuggguucaagcgauucucgugccucagccuccugaguagcugggauuacaggcgcccgccaucacgcccggcugauuuuuguauauuuaguagagacgggguuucaccacauuggccaaacuggucucaaacaccugaccucaggugauccacccacuuuggucucccaaagugcugggauuacaggcgugagccaccacacccagccuauauuuuaaaaugguuagaaugguaaagcuuaaguguauuuuacauacucagguuuccuucaaaaaaaggaaacuucuggggcuaaaauguucagcucggguucccugugagccacagcccugcagaaccucccagccccgugggcaccaaccccgccccuuucaguuccacauccugcccaggcccugacugaguuggaguccagugaguggcaggaggggcaagggugggggcucacuggguuggagggggcacaucucuggcacccccuggggaccaccuuuuccauugggugcuucaggguccaaaugcagaacuuccucucagcaacaaaagggugucccucgaguuacacccugacuuaugcucacugcugguccuggggcgugaaccugcccaucacccacaggcuuccgccagcccagccgcccgggguggucucgucugacacgagggugccucccucgggcucugcaggcugucccgugccaggccgcccauccacccggagaagauguuggacgcgucugacacgagggugccucccucgggcuccgcaggcugucccgugccaggccgcccauccacucggagaagauguuggauggggugcccugaggggaacaacaagccugucucuaggccucagugccuggaagauuuuccuauuuaaaaggacaagccaugauaggggagaguguccugcacagagcuggggugacaguacccaccucaucacacccgaugugcagccgcugggcgccuggguguagcuccaggaccuggucaaucauggcgcccaccagcgccagggacucugccucguggggguucagggugcaggggaaggagcccaccucccgcaggugggcgaaggccgugugcuucagcacaaacugcggagagacagagaaguucgcguugggggcggaggagcuggacugaucuccuucugcccaccuggggcuucuguuucaaaucuacagauaauacaaaaaaauuaggccaggcagagagucucaguccuguaaucccagcaccuugugggggcugagguggguagaauguuugaacucaggaauuugagaccagccuggacaacuggugaaaccccauggaaucucgcuuuguugcccaggcuggagugcaguggcacagucucggcucacugcaaccucugccucccagguucaagugauccucccgccucagccuucccaguagcuggggauuacaggcaugugccaccacgccuggcuaauuuuuguauuuuuaguagagauggcguuucacuauguuggccaggcuggucuugaacuccugaccacaagugauucgccuuccuuggccucccaaagugcugggauuacaggcgugaaccaccacgcccagacuaaaaauauauauauaaaaaaaaaaaaaaaauauauauauauauauauauauauauauauauauauauuuuuuuuuuuuuuucuuuuuuuuuuugagauggagucuugcucugccgcccagucuggagugcaguggcaugaucucggcucacuacaagcucugccucccagguucacaccauucuccugccucagccucccgaguagcugggacuacaggcgcccgccaccacgcccggcuaauuuuuguauuuuguuuuaguagagacgggguuucaccguguuagccaggauggucucgaucuccugaccuugugaucugcccgccuuggccucccaaagugcugggauuacaggcgugagccacugcacccagccauaaauuuuuuaaaaaccaaaucgguuuaagaaaaaaaaguggccaggugugguggcaccugccugugguccagcuacuugggaggcugaagcgggaagaucacuggagccuaggaaguugaggcuguagugagccaugaucacaccacugcacuccagccugggcgacagagugagacccugucucugaaaagaaaaaaacagaaaaauguuuaucuaugaaagaccacucuaacuuugccuaagaacagagacucuguggccucggccuagggcuacucacugcccccuucccccucacuguggaaaccacagcuuugcugccaaaggggcagacuuaacuugaggcuggguuaaaaacccaccccuugugggggcgcugucaguagaagcagcaacuggagaagaggcccugucuuccgcuugccagagggugcagucccugcuggggagagccaagacuggcugcagauuuaaugggugacccuggaaacagaaagccagauggugcugcacacucuccucaggccuggcugacgggggccacacacacgugcagggaccugugagggccaggugggaacugcgcgaaccuagggaugcaccccccaccgcccacacacagccccguggcaaggggaggaggucugugggcucaaggugugggagcacaaccucugcccaaacccuuggcugaccaccaacuaugaagacagagggaugacccuaggaagccaggcuaaaauguaaaaauaagaaccaaaaaaucucagcacagacaucagugagugcacacagccaggggcagguccugcagguuaaaugcaggccauuugcuagaaaacaacaaaaagaccaccaccagccacuggggaaaagaguaaacauucagcuuugcuauaauguauuaacugaaauguucaguucucaaccaaaaauuuugagaugugcaaaugaacuggaaaguaggauccaguucacagacucugacucucagggcccacaugcagaauuuaucaaauauuucaagaaaacuacuaugaauauauuguaagaaugaaaggaggccgggcaugguggcucaugccuguagucccagcacuuugggaggccgaagcgggcagaucacuucaggucaggaguucgacgagaucaguuuggccaacauggcaaaaccccgucucuacuaagaagacaaaaauuagcugggugugguggcgggcgcuguaaucccagcuacucgggaggcugaagcuacuuggaauguggaguuuguagugagcugagaucacgccgcugcacuccagccugggugacagagugaaacucugucucaaaaaaaaaaaaaaaauuagcacuuagggaggcagaggcgggaagaucaccugagcccagaaguuugagaccagcccagcaacauagugagaccccacucuucacaaaaaggaaaaugaacaaaaaaaauuaacucaaaauggggccaggugcaauggcucaugccuauaaucccagcgcuccgagaggcugaggugggagaacuguuugaggccagggguucgagaccagucugggcaacauagugggaccugguaucugcaaauaauaaaaaaaacuggccggguaugguggcacgcaccuguggucccugcuacucaggaggcugaggugcuugagcccagaagcuugagcccagaagcucagggcugcagugagcugugauuguaccacgcgcuccagccugggugacagagugagucugugacucaagacaaauaacuuggauguucaaggguucuggagaaagaauaaaaauaccaaacuaaaaauggaucauagaucuaaaugaaaaaugcacagaaguuaaacuuuagaagaaaauacaagaaaaaucuuugugaucuggugaucacaaagaguuuuuagaaaugacaccagaagcauguagcucuacacugggggagaauaccugcaaauuacauaccaucagaggacuugcaucuagaacauauaaagaacuuuaaaaacucaaguugaaaaaaaaaaugggcaaaacaccugagcaguuauuucuaguauaccaagaggguauacugggcugggcaccguggcucacgccuguaaucccaguacuuugagaggccgacgcaggcggaucgccugaggccaggaguuugagacuagcuuggccaacaucuugaaaccucaucucuaauaaaaagauaaaaaguuagccgggcauggugggguacaccuguaaucucaggugcucaggaggcugaggcaggagaaucacuugaacucggaagcagagguuguagugagccaagacugcaccacuacacuccagccugggaaacagagugagacccugucucaaaaacaaacacacaaaaaggguauacuaauaguaaauguacacauggagggucuuccucaguaagaaaccaacccuucgacacgcugauuuuggaugucuggucuccagggcugagagaacauuucuguugucuuaagccaccugguuuguggcgaucacuucugcccugacagcaguguccuuugaggagauggcgagugugaguggucagggcugugcugugacuugcugugguggggagaggggcacggaggggcagaguggccccgggagacccauuaggaaaguuucauggugaguccauagugguuuagacagggguggugccugcaugacagaggaagaggaggaggagcagcagcaggaccaacaugggucagggcguggcgggugguggugcugacuguggcuggucugcuucugguuugcacaccagaggcuggaggagggcccucaauggaagcgaccagcaggcagcuggggaugagggucuguaacccaggaggucuggaguugcugaggugcagacagaagaggaagaggaagacgaagaggaggacaaagagaaagcaggagcagaaauggcaccaucuagagagagagugggagguggggacagggaccgagaggagcccuggggaccgccagcuacagagagacaaaugcaaauggauaucgaggaggugcagucagaggcagagggaagccagaaaguguggggcucaggagagcggcuggggaugccagaagcuaccgaggggcccagcaggaaaggacuaaaaccgucccuggacuuagugaccuggaggacccuggcggccuuggcagagacauucuguggauacguggcaggaggcuaagagcgcaggccgggucccagagcagaguacgauggagagaaucaacuagaaaggcuggaggaccgagcugugggaaggaacuccgguggcacgcccagaacaccgacauguguaagugaaaacaaccuucuuacccgcgguguguggaaauagaagccagaaugguguaucuguuagagaaauaaauggaaccuaagagccauuaaaucgguguggugguuaaugccgcaucacuuccuguuugaugcagacaggaaaaagaauauguguauauauauauuuuuugagacggagucuugcucugucacccaggcuggagugcaguggugcgaucuuggcucauggcaaccucugccuccugcguucaagugauucuccugccccagccucccgagcagcugggacuacaggugcccgccaccaugccuggcuaauuuuuguauuuuuaguagagacgggguuucgccauguuggucaggcuggucucgaacuccugaccucaggugauccaccagccucggccucccaaagugcugggauuacuacuggugugagccaccgcaccuggccugaaaagcaccuuuucuuucccuaauacuguguuuuaccucacauaauaauauucugaugaauacaagugaaaaaggaaacugccuccaggaccccuuuucuggcucuuuccuuccauuccucaggcagacaggcagccccaaccugcagcucuggccgagucaggcagggacuuccuagaccaaaggccuuuccauguugugcugagcugcgcugccugcaccccaaccaugggcccgcugcacccaccccugggcacaagccuggcccagccugcagccccuggaccccacaccuggcaccagguaacuuccauuucugccacucaccuccauguguccaaaugucugcaccaagggaaucaccuccagcucauugaguccagccagaugcaagaucucuuugauuucagaggggcuggagagacaaaauucauagagagagggucaugugagcagcacgugacuuccacacccacccccccagcccuuccucaucaggcccuggggggcucuccgggaaacaguaaggcccuaaacuccacaaagcuugacagguauccugauuucuggaaagguaccugcuccaaaauuugggaagaugauguucuagcacguccucaaguaaugguucgcuuuucaacccacgacaagagaaugaagucaucacauuuuacaagaaacuacucaaggccaggcacaguggcucacgccuguaaucucagcacuuugggaguccaaggccagcagaccacuugaggucaggaguucgagaccagccuggccaacaugaugaaaccccguaucuacuaaaaauacaaaaauuagccaggccuggugguauguaccuguaaucccagcuacucgggaggcugaggcaggagaaucacuugaacccgggaggcagaguucgcggugagccaagaucgcaccacugcacuccagccugggagacagaacaagacucugucucaaaaaaaaauaaaaaugcuacagaaggugccacacuccauccagagccgggucagcagcugcccgagggcagguccaccacaggguccucaaccugaaacaauccuggggcgcccguccucugcagaagggccacauccugggaagggcugacugccccgggucgaccucuucguuuuucacaagcuuuacaugagcugucauuuaugaauuuaucuaaaaaaaagcuauuucuaguuuuuguauguguuugaaccaucuuaggcuaauccguucuauagauuuaugaguuacauaaagucuuuaaacauuccuguuucaagcuucgaaggaacccugguacuuuacuuuuucacaucaaaagacaaaaugucuucacuguaggaagaaaacuagaagaguaugaagaaaaugcaaaccccugaucaugucaucgcacuugaucaucucaucgcaccugaucaucucaucgcaccugauuaucucauugcaggccaacacccuggcucaccguucaucacuucuggucuaaccacaugugggcugcauggggugcaggcauuuuggaguuuugacacauggaaccgaaguccuuccagaacagaugucauauuauguucaucagcagguaguuuuccucuuucucauucucaucaacacagucuuuacaauuuuucauuuauuuuauuuauuauuauuuugagacagagucuugcucugucacccaggcuggagugcaguggcgcgaucucggcucacugcaacuucugccuccugaguucaugcaauucuccuuccucagccuccugaguagcugggauuacaggugcgcaccaccacacccagcuaauuuuuuuuuuuuuuuuuugagacggagucuagcucugucgcccaggcuggagcgcaguggcgcaaucucagcucacugcaagcucugccuccuggguucccgccauucuccugccucagccucccgaguagcugggacuacaggcgcccaccacuaugccuggcuaauuuuuuauauuuuuaguagagacgggguuucaccuguguuagccaggauggucucgaucuccugaucuugugauccgccugccucggccucccaaagugcugggauuacaggcguuaagccaccgcgccuggccacgcccagcuaauuuuuguauuuuuuuugguagagacaggauuuugccauguuggucaggcuggucucaaacuccugacuucaugauccgccugccucagccucccaaagugcugggauuacaggcgugagccacagcgcccagcccaagucuuauaauuuuuaaaaaaggcuuaccaguuugguagccaggaugguguugcauuauugauuuaguuucuuugauuugaguacuaugaggguuuaacauuuucuuucuuucuuuccuuuucuuuugagacaggcucuggcucuguugcccagguuggagugcaguggcgccaucucagcucacugcagccucuggguccuggguguuaauccaaacugcaccauuuuguaagcccccugcuguuuuccagacccagguugaagugaaacauuccacgggguuugggcugugaggaacauccugcccaacauccugaccacacggcccaggaacaucccgaccacccgaccacacggcccaggaacaucccgaacauaccuugcugggcaaaggcccagcugaaggaacauccugaucauauucugcugggaacaaggacccaacugccucaucaugggaacaucucucaacaucuucccaggcagaagcccuacugcccaaaccccucccguccaggccuguaaguaccccagccuguaagcggcggugggcucuggcauuaagcugguccccccucuguagguuucugcacuauaccucuguugcuguagagacgcccucucucucucugucuuucuuuaacccucgccuucccuuuaaaaaaaccuaacaccaggcucaagccauccuccuaucucagccuccugaguagcuuggacuacagccccaugccacuauccauggcuauuuuuugcauuuuauguagagaugggguuucaccauguugcccaggcuggucucgaacuccugagcucaagugauccacccaccucggccucccaaagugcugggauuauaggcgugagccacugcacccggccuaauuuuuguauuucacauagagaugggguuuuaccauguuacccaggcuggucucaaacuccugagcuccagugaucugcccaccuuggccucccaaauugcugggauuacaggcgugagccacugcuccuggccuucacauuuucuuauaugcuuauuggccuuuuuuguuucuuccuuugggauuggccaguuaauguccauugugcauuuaucuuuggggccguuauugauuuucacagagaccugugauuuuagcauuaagcaggggccucccaucuccaccacaccugauuuuauugauuuugauucucuccccuuuaauucuucucuucucuaacucaaggcucaacuguggccugaagagcagccccucccugcgcggaggccuccuccagcauccuccagccuucucuagcucagccuucuacagccuccuccagccuucuccagccuccucugaccuucccuggccuccuccagccuucucuagcccagccuucucuggccuucucuaaccuuaucuagccuucucuaaccucuagcccagccuucuccagccuucuccagccuucucuagccuccuccggccuucucuagcccagccuccuccagccuccuccagccuucuccggccuccuccagccuccuccagccuucucuagccuccuccagccuucuccagccuucucuggccuccuccagccuccuccggccuucucuagcccagccuccuccagccuucuccagccuucuccagccuucucuggccuccuccagccuccuccagccuucucuagccuccuccagccuucuccggccuucucuagcccagccuucucuggccuucucuaaccuucuguaguccagccuucuccagccuucuccagccuucucuagccuucuccagcuuucucuagccuucucuagcccagccuucucuggccuuccuucucuggccuucucuaaccuucucuaaccuucucuaaccuucuguaguccagccuucucccaucaacagaagaaacgccugcaggacagagacaggaacugcagcucuucccuguagggggcgcugcugaugcuuacuuucccuuuaaauguuucaaaauucucuccagugaauguuugaaaugaaacuuuguuuucauacaauuaaagagaugaauuuaaaaagacaaaaaaggaauguacccaccacuguucaguuccugacugugccacccgcaccuccagguugcugcuccuccugcccugcggaacccccccuuccccgcuuucacgccgcgccccuguaccugccacgggcaguguuaccuguaggcguacuuggcccucagcagccucagagggcccucguagggaaacaugucuucauacucaaugaggaggccguuugcaccuagcgcacggaacagaggaaaaaucugggggguaaacagggagggguuaggaagaaguggcugcuggagcacgauguggcaaguccacagcagggagacgccuucccuuucagccuguggagacugugggaguugcuacuucuauuucuccugggaaccuuaaauccggaauguguacuuuacguuaugccaaaugaaacuccccguuccagugacuauuuugcacagaaggggagauaugcuaugaaacagggcugcuacucaacgcgcugguggcucagcuugggagggacggguccggccagcagggagccaccaagaagcagcucuucaugcacggcggcccagcaaggcagccaggcugaggggcaccagcaaggcaugggggacagggcagccaggcugaaggagaauggcaaggcaugggggacggggcaggaggagccggggcagggggagcagggcucugaaggguuggggucagcaccugggggaggugagagaggggugcagaacucauucguuccuggucuguacucauggggucccuucccccuuauucuccuccccacuuccuugucuuucucucuuuuuuuuuuuuuuuugagauggagucucgcucucucgcccaggcuggaguggaguggcgugaucuuggcucguugcaaccucugccucccggguucaagcgauucuccugccccagccucccgaguagcugggauuacaggcgcccgccccgaugcccagcuaauuuuuguauuuuuaguagagacgggguuucaccauguuggccaggcuggucucgaacuccugaccucagguaaucugccccucggccuuccaaaaugcugggauuacaggugugagccacugugcccggccucucucuuuuuuuuaacagauggggucucacucuguugcccaggcuggagcgugcuggcaugaucauggcucgcugcagcacccaacuccugggcucaagugauccuccagccucagccuuccaaggagcugggacuacaggcacaugcuaggccuccuggaugacacacaugcaggagaacuaaggagccccagcugacaguugggaugaacugccggacauggaaggccacgcggaccaucagagguuucuagauguuacggggcugugaccaccugagggcaccucggucagaaaagcagaaucacgcagccaacccacagaaacacaaggggugaugaauggggaccucaaguuuggggagaucugucacgcagcaacagaugauggaaacagggacuccagcuguguguaaguuggaucuucuuugccuauauucaauugucagaacgccuuuccuuucuuuuuuuuuuugagauggaguuuugcucuugucccccaggauggagugcaguggcacgaucucagcucaccacaaccuccgccucccggguucaagcaauucuccugccucagucucccgaguagcugagauuacaggcaccugacaccacgccuggcuaauuuuuguauuuuuaauagagacaggguuucaccauguuggucaggcuggucucgaacuccugaccucaggugauccacccuccucagccucccaaagugcugggauuauaggcaugagccaccgcgccuggcccaagucaaaaugccucuucaucagcuguauguaaguucagucuucuuugccauauucaauuugucagaacgccuuuucaucucuguuugcuuuuuucuuuucugucaucuguuuccaaauacugcacuuuccauggugucuacucacuuguacacuucuuauaguuuagucuucauuaaaaacauuguuuuuuccuuauaauucauuucugagcuccacaggcaauuuuuuacaaccuccuuuugucugauuaccacauuucugggcuuuuuuuuuuuuagacugagucuugcucuaucgcccaggcuggagugcaguggcacgaucuuggcucacugcaaccuccaccacccagguucaggugauucucaugccucagccucccaaguaggugggauuacaguugugagccgcugagccuggccugggcuuuucuauuucugauuuaugcuguucuuucacagcuuccgucaucuucugaguaucuuuuaucuuguuaugaaauauuauggaacaguguuuccugcugggugggccugugugucuggagcaccuucacugcugcaaugcuauucagaucaucuucuuuuuucuuuuuuuuuuuuuuugagacagagucucacucuugucacccaggcuggagcgcaguggcacaaucucggcuuacugcaaccuccaccucccagguucaagugauucuccugccucagccucucgaguagcaggauuacaggcgccgccaccacacggggcuaauuuuugguauuuuuaguagagacacuguguuggccaggauggucuucaucuccugaccuugugauccaccuuccucggccucccaaagugcugggauuacaggcgugagccaccgugccuggccuucuuuuuucuuaccuaucuuuguaugauguuaaacaacacucuuuuuugcuucuuuuuuucuuuuuuugagauggugucuugcucugucaccuuggcuggagugcaguggcgcaaucuuggcucacugcaaccucugccuccugaguucaagcaauucuccugcuucagacucccaaguagcugggacuacaggcaugugucaccaugccuugcuaauuuuuguauucuuaguagagacgggguuucuccauguugcccaggcuggucacaagcuccugaccucaggugaucuguccgucuuggccucccaaagugccuggauuacagacgugagccaccauggccagccuguugcucauuuuuaagaacaggcucuuguguuugcaauggugacaggccagccucaaggcccccuccucuacugcugccacgcgguauuagaaacugcaggcucuguguagcugcuucugcaguguuuuuugaccuccaccucuucuggacgccuuuccccaggaccuuucccuucgcuguuccugcccaguucaauguggaugcuuucccuguuuuguccuuaguggggggcgcuguuccucuggaaggaaguuuuguuacguauuucugagaguuuugcagccuugggccuccccugcacccuccuggauguuucauuacguauuucugacagccuugcagccucggccuccccugcacccuccuuuaagucucuuugcacucaaucucagacgggagccauuaaaacucugccccacuucucgcuaugggagaccuuuacuuacuuuugaggcuauuuucuggguccucuggucauagcacuguuggaguuucccucuuuccucuguuaccuccugcuuggccacuaaccccauacagguguuauucugucugugguuuggucccacccacuuguaguuugggauccauggggacacccugauaccuaauuuuguugaagagugucuuaguuuucuagggcugcuguaauaaaugaccauaaacuggguggcuuggccgggugcgguggcucacaccuguaauccuagcacuuugggaggcugaggcggguggaucacgaggucagcaguucaagaccagccuggccaauguggugaaaccccgucucuacuaaaaauacaaaaauuagccaggcaugguggcaggcaccuguaaucccagcuacuccagaggcugaggcaggagaauugcuugaacccgggagguggagguugcaguaagccgagacugcgccauuguacuccagccuggaugacagagcgagacuccgucucaaaaaacaaacaaacaacugggcggcuugacacaacagaaauuuauucucucacaguucuggaggcccuaaguccaaaauccaggugucagcagacccagcucucccugaaggcugaagaggaggacccuuccuugcuucucucuagcuucuggugaucgucagcuguccucggcauccugggguucguggcacgucaugaccaucuuggcugcuggcaccgcggggcauccuccugggucuucacacugccuucccuccgugugucucaggcucuaaauuucccucuccucauaaggaugccaaucacuggauuaggguucaccauauucuaguacaacuucaucuuauuuugauuacaucugcaaagauccuauuuccaaauaaggucucauucacaggucccagggguuaagacuugaacauaucuuuuuggaaagauacacuucaacccaaaagaaagaagcugugaguuucuuuuguucucugucuuuuuuuuuuuucccuuuugucauccugguuguucuguuuuugugagaggcuauggaggaaauucaaaaucaaugcugcugccaccaucuugcuccaccgagaaccuugugguuguguucuagguacccguuuccacagaacacugcucaaaacuuuaaagaaugaagccaaggcaaaaaguaaugcucuagagguaaaagggaguccuuaccucugagagguacgagaccuuugguggagcuccuuuaaggucuaaaugaacuaaucucaucugaaauggaguggaaccugacauuucaauauuuccugugaacuccuauggcgaagucuccuuggggacuucuuccuaguggagaaaaucaagaguuaucaacaggggcagaagcuucucccuuugccuuucuccuuauacuuucaguuucaguucugauacuggccaguuuugauagauuaacuuggaggaaacucauuuugcuaacaugaaaaugaacuggaagucuaccuccauguuaagauauagagaccucugcuaugugugauuuguugcuaaaacaaaacagcacuaguuuguuuauaagaugguuaugaucuauaauaacacaaauaacugccaaacaaccuuguuuuaaagaccuuguuaaacuagauguacuaugcuagugaaaacagucgggcagaagccucuaaacauuuucuuaucaggccgcacaauaugaugcuucuguaggaaauuuauccaaauuuuagguaauauuaaaacuaauuuguauuucuagagcucagaucagcuugauuauaaagaggaagaaacugcaaaacugacuccagguuggagaaaacugucuaggauuuaagguaagcugauaauuuugaaaaagcccccaagugcaucagagcugaccguaguauuauacugaauaaaggcggcauccaagggauaacgaagcagcuggggaaggguaaaauuuauguauuuuuuauuuauuuuuccuaucuacuaugaaagcacaaaggauugggugagaaaaggaaaggaaagcuuugcaugugagacagacucaguucaguaauccagccccugguuccgugcagggguucggaggcugcugacccuaagggcucuguaacacagcacuuucaguuuguacauacgaccaguuacacacaauuuacacccacaggcucugugcgagccucucucagcagccccgcaucgccgcugcgggacagccacgcugggaggcgucgcucgggagcccggccgucccucuucagguacuggcgcgggggaaacgcuuccagccaggagccgcccggccuagcgcgcagagccagagccgcacccgcaccucaccugcgccgccgcggucccgcgagguccgggggcgcagccaggcccggccgccccgcccucgcggccgccgccuccgcucugagccccgccccgcucggccgccgauugcucgggccuggccgccagcccaggggccgauggccgagcgcgucgcacucgcgucccugcgccgugccugccucgcgcucccuguuacggcguucguccccgggccuggcgcccgcguccggcccggcuccgcggcggccugguccgauggcuccucagcggagggccgcaaccaaggcgcccgagggcaacggagcggccgagcgccggaaccggagcagguagcggugaggaggggaagggcgcgcgcugcggcg

SEQ ID NO: 192335 - RNA, 33974 nt, Homo sapiens
guggggcgcgggcgcgcgcacggacguccagcacgcacgcacgcacguccagcacacacgcacauccagcacgcacgcacguacguccggcacuuccggccgcggcggccucagcgccggcccgaagggaccaggccgccguccccagcgagaggcaugcagcgcugaggagcggcgacccagcacggcggcgccaugaaccuccugccguguaacccucacggcaacgggcugcucuacgccggcuucaaccaggaccacggugaggaggcgcggcccugucgccuugcccggccgggccuucccgcagcccgggguccccggcucucaggccucuccugggcgccccuuuccggccaggccuuccacccgggaccccggccccgcccgagcuccccuccgaagcccccggccccggcccucgccgcugcucccagcccgagccgggguccggaccaggcccgaaccggcucccaccuuccuggccuuucgcgcucccccaccccccggguugugaccgcucccagccggccgucccgggccgaggucgaggucggugggagacggcacagaaccccagccuccugcgcggacgccccuccccgcgcgccacgcccacucggguucccuggcucccugcgggcuccacgguuaucgggauuuuccccacagcgugauugacgcccugcccagaaccccguuuugcccccuguuccuuucagggucuuuaguagguagcccguggcugagcugacuucgcuuggguuuacuggagccgcggagccggcgucuccgacgccucugguggcgaguggcgcggguggggugcaggucucaccuuucccgucgguuuccaucggaaaaugucacucuccccacccccacuccccgggauuuuucuucguguuugguggagucaaaggacuuaagggaggccuuugagggaaaucuuacuucuuuucccaugucggaauccagguguaagcacuggaugauuuaaagcgcccagggaaggugaccuccuuccccgcaggugcuucggagcugcgggggaugcggccggggcggcgcggucggauucccgcgggaggcgggcgggaccuggauucggaugguugccuccucaccucccauuugaagggcgcgcuucccaaagguccugauggggaggaaaaggaauguccguuauuccgagacaggcuucugcgaggcuuuacauguuggcuuuggaaguuuuguuuuugaagagaauccaggcaggugcuguaugaucccguauaugugaagacaauuuuauuuauuuauuuauuucauuuugagacggagucucauucugucgcccagccuggugcgaucucgacucacugcaaccuccuccucccggguucacgccauucuccugccucaggcuccugaguagcugggauuacaggcgccugccuccacgcccggcuacuuuuuguauuuuuaguagagacgggguuucaccauguuggccaggcuggucucaaucugaccucaggugauccacccgccucggccucccaaagugcugggauuacaggcgugagccacugcgcccggccggauuacacauauuugaaagaacucccucucagugauuuugaugccugaugcccugggaccagucaggcuuccugggcgcugccagcuuccccaggguugugugcugggguuucuccggaagaaaguuuugcugagaugguaagggagaugccuagccuucucagagggugguuuccaaccaucugguguuuguaaugccuucuuuuuagugaagugugcuauaccuguagaaggguggauauaucauaaguguucaggugaugaauuuuccaaacuacacaccugucacuaacaauuaagaaauugaauauaccuggccacgcuugauuccaauaaaugcucccuaccugacuugugacaucauagauuaguuuugccuacuucuguacuuuauuuuuguacuuauuuuuguuucuagcuguuuuuuuguuuuggguuuuuuuuuuuuuuuuuuuuuuuugagacggaguuuucgcucuuguugcccaggcuggagugcaauggcgcguucuaggcucacugcaaacuccgccucucagguucaagcaauucuccugucucagccucccgaguagcugagauuacaggcaugcaccaccaugccuggcuaauuuuguauuuuuaguagagacuggguuucuccguguugagucuggucuugaacuccugaccucaggugauccgcccaccucggccucucaaagugcugggguuacaggcgugagccacggcgccaggcuguuucuagguuucuuacucaacaucauguuugugauuuuuuuuuuccguauuguugaguauaguuguagaucuuuuuuuuuuucuuuuuccgagacggaucuugcucuugcccaggcuggagugcuguggcgugaucucagcucacugcaaccucugccuccuggguucaagcgauucuccugccucaggcucccgaguaguugggauuacaggugcccgccaccgcucccggcuaauuuuuguauuuugaauagagaugggguuucaccguguuagccaggauggucuugaucuccugacccugugauccacccaccucggcugcccaaaaugcugggauuacaggugugagccaccgugcccggccagaucauucuugauguacaauguucuuuugugcagacauacaacaauucauauauccagucuaccaugguugggcauuuggguacguuccaguuuuuggcuaccauaagcauaauaugaguaauaagaguaaugauuaaucuagaagaugucucucagugaccauauguucacauuuccacaggcauguacuucuauauaccuaggaguagaauugagaguauaguagauaguacaaauaguuuuccaaagugguuguaccacuuugcccucaacuagcaggucuaagaguucccauggcucuacacccagcucacauuugauguuuucucuuauuuuuggucauuuugguggcuguguacaucucucuguuguuuauuugcauuuuccugauuuuguguuucuugaccacuuggauauccucuugugacaugucuaagucuuuugcccauuuuucuauugaggauuuugccuuuuucuuguggauuucuaggaggugguuuggguauuucuauuuuuauuuuuuauuuuuguuuuuuuuuuugagacggagucuugcuguguugcccagguuggagugcaguggcgugaucugagcucgcugcaaccucccccuccuggguucaagugauucuccugucucagccuccugaguagcugggauuacaggcgcucaccaccacgacuggcuaauuuuuugguauuucuaguagagacgggguuucaucguguuggucaggcuggucucgaacuccugaucucaggugauccaccugccuuggccucccaaagugcugggauuacaggcacaugccaccaugccuggcuaauuuuuguauuuuuaguggaggguagguuucaccauguuggccaggguggucucgaacuccugaccucaggugauccgcccaccucggucucccaaagugcugggauugcaggcgugagcugcugcguccggccucaaaugggaguuuuagaggccuuuguguugggcuuucacaccacuugugcagucauuggaaagauccagacuuugcaacauuucaugugaaaaauaauugagggguuuguuuuuuucucuuuccagccacagcuucauagagccaacaguuggacauggcauuuaaggagauggauguagucccugggucacacacgagcauuaacacacgaucaucuacgcacuuaagugcuuuauucaguuucuaacagugcuguuuauuuggaccauuaacagccugcugugugacuuggaggcagugaccaggaugagugaccuggguaacucauugagacucugacaggauuuuaaggaguuaggaugauuuauaggugggagcaaagucacgggagaccacccuguaaaugggaaagagcauccuuuccucaccuucccgguuccuggagucuaggacuaccucuugucuccccagcacccugcccuucccuucaccugguguccacagugggcgggauugccugcuugguggcuuuccucuagaaguguccuucacguuugucacugaucguccuccaagccugggccauggggaugccacagaaggccccugcaguggggaaguugugugaacaacuccaagacuccuuugcuaaaggacaaacaaaaugcccugcauggaugugcuugucacuuaguaacauuuguacaaggacaggaguugugacuuagcaccuaucgugucugugugguuugagcaucugcaagaguucucaguaguugucauuucuccagaccucuuucuuuuaaccacuccaggccuggggauuaaugucucuuuuacacuucugcuuuaggaugcuuugcgugugggauggaaaauggauuccgagucuauaacacugauccacuaaaagaaaaagagaaacaagguaagaauuaacgggacauuuucugguuucuccccuuuccaacccucggagucuuaaauuuaaccuugcagguggagcagggaagggauggcuguuuucgagaaguaaauaggguucauggccccucauaaacuuggagggagcuguccucuuucuuucguugagcuucuacaggugcugagggauacagguguugagcagguuuguucacuggccugauuucucuagugaauuaucgaucagcaugaacuucuugugccuuuuccugucacaucagggauuuuuggcagcagaaaccucuuuucaaguaaagucuuaccuguaacccugggauguagaacaguaaguggugcuuuaugucugggaguuuauuuuguaagucagggugcauuuccucagccugcauccaugcuguguacguuugaguccugguucugcccuuuaccagguugcugugcgaccuugggcaaauuucucagccucuuugggccucuauuuuuuuuuuuuccuucuuccgagacgggaucuugcucugucgcccaggcuggagugcaauggcaugaccucggcucauugcaaccuccgccucccggguucaagcgguucuccugccucggccucccgaguagcugggauuacaggcacccaccaccacaaccggcuaauuuuuguauuuuuaguagagacgggguuucaccauuuuggccaggcuggucucuaacuccugaccucaugauccaugcaccucggccucucaaagugcugggauuacagacgugagccaccguccccggccaccucacuuucuuuguacgugaaauaagguugauaacaaugccugccucagaguuauuguaaaaaugagucagggugcguaagacacgcagauuaaugccugcgcgcacauuaggugcuguggaguguaugaugccacauacacuguaugaugggauuuaugcagauaaauguaugaugggauaaugaugggauuuaugcagauaaguaguugcaaaacauuuuaaaacagcuugacuugcaaaucucaggauacuuuuuacugaauugacccagaagcuuacaggagaguuguagacguugguguccaaguugaaucauuagcagcugugugggaaaaaccccccagccauguuuucucuccacucuuaacagcacgacaguugucagcacagaagacuucugugacugaauguggggaauuucuccccacacaccaagcaguggacaccagcuggguguccuuucaguucugacgccaucuaccuagagauagagucagaucccacagguugagggcucaguccccaagacugccccaguccccaccaugcaugagucugggccuccuaaacuucagacugacuggcuucaaguugggguucccacagcccccuccuuggauucaauuaaugugcuggagcggcucccagaacuuggggaagcacauuuaccaguuuauuauaaagcagcggucugcagccuuuucggcaccggggacugguuucauggaagacaguuuuuuucauagggggaugguuucgggaugaaacuguucccacucagaucaucaggcauuagagucucaggaggagcgugcagccuccaucccucgcgugugccguucacagugggguucaugcuucugugagaaucguaugcugccgcugaucugucggggcagagcuugguggggaugcuuguucgccugcugcuugcguccugcugugcagccugguuccuaacaggccacggaccaguacugccccgggguugcagacccauuguaaaggauaauugccaagaauacagaugagggcaagcacggaacaagguguggggggacaggcuauggaguuuccaagcccucccucggcugccacccuccagaaccuuccauguguucagcugaccucuuggauuuuuauguuuuuuauuuuuuuacuucaaaauucauuuuucuuugauuuuuuuuuucucuuuuuucccacauguguuacagaaaauaccucuuggagauauauacauaucuaucucugacguugucucgcucuguugcccaggcuggagugcaguggugugaucucggcucacugcaagcuccgccucccggguucaggccuuucuccugccucagccucccgaguagcugggauugcaggcaccugccaccacgccuggcuaauuuuuuuuguauguuugguagagacgguguuucacuguguuagccaggauggucuugaucuccugaccucgugauccgcccaccuuguccucccaaagugcugggauuacaggcaugagccaccgcaccccggccaccucuuggauuuuuaaggaagcuucauaguaucugcauugcuucuccuagugugcagggugggagcuucucuauggagguucuucagacccacaaucagguggagaagauuugaguucugccuuagcaggugaaagggcaggagagagauucugguuccugagggccuaacacacccaauauuauaacaaaagauuguaacaaggucugggaguuaugagccaggaaccgugggugaaaaccuguaugugucucucucauaacaccacaacagcauauuaacaacugcuuccuaauuaaugaaguguuuacaguaaauucaacauuucuuauaaaaaugaguuugacggcccgcacgguggcucacgccuguaaucccagcacuuugggaggcugaggcgagcagauugccugagcucaggaguucgagaccagccugggcaacacggugaaaccccaucucuacuacaaauacaaaaaguuagccaggcgugguggcgcauaccuguaauucaaauuacuggggagguugaggcacgagaaucacuuaaacccgggaggccgagguugcagugagccgagauugcgccacugcacuccauccugggcgacagagcaagacuccgucucaaaaaaaaaaaaaacccagacaagaaacaucuaaaacuucuaaauuccagaaaaguauaccauugucaugguuuagcucaucacacacauauacccggucuugugcgucugccagcucggcugugucuggggcaggcugucccugagcuuagcaugcagugaguucucacaugugcauguguggugugcucccguuuccagcuuaugugaguagauaggcccuaaugugaaauggauacaguagggccacacugucuuuuugauggcacauuuaaacaguuuggcucugcacuuacagacucaucugcugcucugcgucuggcagcuuacaguuuaacaaugaagagcaggccaggccucuaaucccagcacuuugggaggccaaggugggcagaucacgaggucaggagaucgaaaccauccuggccggcacagugaaaccccaucucuacuaaaaauacaaaaauuagcuggaccugguggugcgugccuuuaaucccagcuacucgggaggcugaggcaggagaauugcuugaaccagggagucggagguugcagugagccgagaucucgccacugcacugcagccugauggcagagugagacucugucuuaaaaaaaaaaaaaaaagaaaaaaaucccagugaagagcagcaccagacuugcccuuguuccuuuuuaauuguagcaguuugcuuuccugagugguggggaaggaagccugcaugacaguguguccuggaucugggcuuguggcaugguucucuccagggugacugugcauugaguaaggagacugugggcucugagcaggcugcuguuuccagauacgccuucugccacuuggcaggaacgggaagcugguaguucagggaagccuucuuggggaucccugcuccuucagucuuggggggcaguguuguccaacccugcuccccgacauagguccugcauccauuguacacccagguuuguucuuuccacacacacagcccagccacccucccgacccacacacagcccagcagcccaccugacccgacacacacacagcccagcagcccaccugacccgacacacacacaacccagcagcccucccgacccacacacagcucggcagcccaccugacccgacacacagcccggcagcccucccgaccugacacacacacagcccagcagcccucccgaccccacacacacacagcccagcagcccgccccaccuacacacagcccagcagccuaccugaccugacacacagccuggcagcccucucgaccugacacagcccagcagcccgccagacccgacacacacacagcccggcagccucagcacaucuagcuucacaacagguccugcaggcuucgugcugugugcucacccagcgugccaggugaaggugcuagagaaaugggaggccugcaauguguagguagcaggugguuccugcggguggggaggacacagaggugguggguagcuuugggaaggagguggaaaggggaaguuugguaaccuggugguagaagguuaaauugguagagccuuguggaguaauuuggcaagcuguguucauuauagauguacuguuuggugccuguauaccaauauuacuugcaacgcuguuuccaagaguggaaaauuggagaacccgaaugacuuucaugaaaggggugauuacugugguuguggcacauccucaaaauggugcuucaugcgguaagaaugccgagaccaaucugaauccucauuuggagagauggccauggcauuguuaaaggaaaaagaaaguagagaauagcauagaugguguuauaggaacaaaauaucuaugcacaaaguuuagaacauacguggccaggcagaguggcucaugccuguaaucccagcacuuuaggaggccgaggcagguggaucacgaggucaggagaucgagaccauccuggccaacauggugaaaccccaucucuacuaaaaauaaaaaaauuagccgggcaugguggugggugccuguagucccagcuacuuggaaggcugaggcaggagaaucacuugaacccaggaggcggagguuacagugagccgagaucgugccacugcacuccagccuggugacagagcgagacucugucucaaaaaaaguacauaaaugauguuguuucacaguguuuucuacuuuaugcuuuucuguguuguuuuauagaaaugaugcauaauuuuuauaaugggaaauaagguuuucuuuaaaaauaaaacuccacagaaauaggaacgagaaacagggacugcacgacaugacagaggcaaaaauaaaaagguuauuagccucaagugcuagaaugguugauuuucacucauuuguauaaagugauucauuuuucaagcaucucuuaguggaauagaaguuaugccaguauucagacauccccuuuccccauuuucuuuuauuaguuucuuguguuuugcagcaggcucuguugggagagucugggccugucaagaugugguguaauuauauauuuugguuuucacccuggccgguaacucccacagaccugguuagucuuuuuguuacaauauuggcccucaggggaggccucugaccuucuccuaccccccuuucacccuaacguguccugucuccccaccaccaccccaccuuccuuccuuucuuuucuuuuuucuuucuuucuuuccuccuccccccuccccuccccuccccuccccuccccuccccuccccuccucuccccuccccucccuuucccuccccucccuuucccucgccuccccucuucuuugacagaaucucucccaggcuggagugcaguggcuccaucuuggcucacugcaaccuccaccucauggguucaagcgauucucgugccucagccuuccaaguagcugggauuacaggcacaugccaccacaccuggcuacguuuuuuuguuuguuuuguauuuuuaguagagaugggguuucaccacguugaccaggcuggucucgaacucuugacuucaaguuauuugucugccucggccucccagagugcugggauuacaggcauuaaccaccacacccccacccuuucuaauugugggucucaggacccuccccagagaaggccguacccucugccccugggaaaggaaugcugauaucaugaagcuuccauaaaaucccaaggagacgggguucagagagcuucacggaagcuuuguguccuuccccuaauaccuugcccuaugcaucucuucaucuguauccuuuguaauauucuuuguuauaaacugguaaacauaaggaaguguuucccugaguucggugagccgugccagcaaauugaacccaaagaaggggucacgggaaccccaacuugaagcuggucagucagaaguuuugaagguucuaacuugugacugguguguggugcagucggucuuggggacugagccuucaaccugugggaucuaauacucucuccagguagauggugucagaacugaguuagaggaagaccagcugggguuugcugugcgguuucugcuuuagucacagaagucuucuguguuggugauugugugagaauagagaccaugauuagaggagaggguuuuucucuguaccacaaggacugggguguaccucaaguuuuccucagcugauguuuaguaggagccuguuuuguguccuacgcaaccuauugcugcaauuuuaguugcuguuacagacaaguccgaccgccagggacccuuagagauguagacgcugacauccugggcaggcuugggcauuucuucuuuuuguggguauaaaauguuccaggaauaaauaaaugcucagugcugugaaguaaaaccagcacucaggcaaaaguuuaauucucucaguaaggcaauuuacuucugcagaagggugccccuugcaucagucaagauggcaagagcacagagaacaaaggagaccggggguuuuuauccugaacgcagucccuaucucugugucacuccccuaugggcuggggucggacugcacaaucugagcugacccaauaggcuacuuguacauauuuuucuaaauauagaaggggagggggaugugagguacagagguggagcgugugagacgugcaguuucaggggaacaauguguacagguaaccaagggaacaggugugaguuauugauuagaguugacgggaagcggguaggcuguuuacaguaacuaggggcaaggaagaacaagaaagucgaguucgagaacaaaggauaaggaaguuaacaggcuaaauaaacccuuugaagagaaacucagaaagauuuauuguaucuuacauuuuucuguaacaacgaauauccuuuguaauauuucaguaccagcccuugggaucuggaacauagaaagcucugaauguaacccuggucuuucuguggggagacccuuucccccucuucagcugcaggaggugggggucagguauuaugggagaaucucuuuggcgggguuuagaaguccucucuaauuccugaaguuuggcucuuaccuuugauuacuucucauuccaggaaaggccuuaacucuccuucucugccucuucacuugauucugaaaaaucuguuuuucuuuuuuuucuuuccauuuuuaaaacccagagaccgcauagcuaacugugccugugacugacuguguuugucuucuuuuuuuuuuuuuuuuuuugagacggagucuugcucugucacccaggcuggagugcaguggcgugaucucggcucacugcaaccuccaccugccggguucaagugauucuccugccucagccucccgaguagcugggacuacacagcuggcugauuuuuguauuuuuauuuuuuauuuauguauuuauuugagagacgaaguuucacucuuguugcccaggcuagagugcagugacgcgaucucggcucaccgcacccucugccucccggguucaagugauucuccugccccaacuucucgaguagcugggauuauaggcaugcgccaccacaccuggcaaguuuuguauuuuuaguagagacggggguuuuccauguuggucgcgcuggucuugaacucccgaccugagggauccaccugccucggccuggccucccagagugcugagauuauaggugucagccccugcacccagccaacauuucuuuacuuaaccauuagcuagaaucacaucuugcuaagggaaugacuuguugcuuuuagaacuugaaaagacggcugcgcacaguggcuaaugccuguaaucccagcacuuugggaggccgagguggguggaucuccugaggucaggaguucgagaccagccuggccaacauggugaaacgccgucucuacuaaaaauacaaaaauuagcugggugugaugggcgccuguaaucccagcuacuugggaggcugaggcaggagaaucacuugaacccaggagguggagguugcagugagccaagaucgcaccacugcacuccauccugggcgacaagagcaaaacuccaucucaaaaaaaaaaaaaaaaccugaaaagacuuaugauauaaucaagcauuaauaacuuuauuaauaagccuaagaucauguaguuuauaaaagggcuaaacauugucucucgguuaaauaguguuugaagaguacauuagugaccuugacauaauucucaggucacucagauguguuucuaaaacuuacugaaccuacauugaggaaauaguuacacuucugacaccuggggcaaagaaggucuucaguggcagcauuuuuuaaaaaaaaaauuaugguaaaaaauuauguaaaauaaaauuuaccaucuuaaccauuuuuaagcgcauagaucaguaauguugaauauauucacauuguuguuaaacggaccucuagaauuucaucuugggaagccaaagucuacauccaucaauucugccuccccugucuccuaguaaccaccgugcuacuuuucugucuccaugaacuugacugcuguagggacuucccgugaaugccaucauauaugccuggcuuauuucacuuaguguaguguucucuagguugaucucuguugcagccugggucagaacuucaggccggguaccgcagcucaccccuguaaucccaguguuuucagagucugaggcaggaggauugcuugaggccaggaguuugagaccagucugggcaacauagugagaccuuaucuugacaaaaucauaaaugagaaauauuguuucuguuuaaggcugaauaauaaaucacugcacguauggagcacgugcuguuuguucauuucuccaucuguggacacucggguccuucugcaucuuugcuauugugaaugaugcugcuacaagcgugggugugcggguaucucuuccagacccugccuugaguucuuuugcuuguaugacuagaagugggauugcuggaucauaugguaacuuuguuuuuuucuuuuuuuuugagacagagucucgcccugucgcccaggcuggauggagugcacuggcgagaucucggcucacugcagccuccgccucccggguucaagcaguucuccugccucagccucccgaguagcugggauuacagaugugcacugccgcuccuggcuaauuuuuguauuuuuaguagagacaggguuucaccauguuggccaggauggucuugaucgcccgaccucaugauucgccugccucggccucccaagguguuggguuuauggguaugagccacugcaucuggucauuugguaacuuuuugauuuauaaaaaucagccuuuuuuuuuuuuuuuuuuuuuuuugagauggagucucacugugucacccaggcuggcgugcagugucacaaucucggcucacugcaacguccgcuucccggguucaagcgauucuccugccucagccucccaaguagcugggauuacaggcaccugccaccacgccuggcuaauuuuuuugaauuuuuaguagagacgagguuucaccauguuggccaagcugguuucaaacuccugaccucaagugauccaccugccuugccucccgaagugcugagauaacaggcaugagccaccacgccuggccuuuuuauuauuuuuuaauugagggagcgucucacuguguugcccaggcugaucuuaaacuccuggccucaagucaucauccugccuuggccucccagggugcugggauuauaggugugagugagcugcugugcccagccucuuuuuaauuuuuugaggaccuguccuacuuuuuuccagagcagcugcaucagacagugcaugagaguucccauagcuucauaucuuggccaguacuuguuauuuccuggguuaaaaaacaauauuagccauccucugcagugagcccuguucucaucacugcacuugccugagcaacacugucucaaaaaaagaaaaaaaauuagucaucuucauggguaugagguggugggaucucauugugguuugguuuugaugucucugaugccuaaugaaguugagcaucuuucuuuguacuuguuggccauuuguaaauuaucuuugaagaaacacuacucaaauccuuugccaauuuuaaaaucagauuauuaauuuuuuuauuguugaguuguaaaaguccuucauauauucuggauauuacgcacuguaucagaugugugguuuguaaauaugcucugccguuccauagguuguguuuucauucuguugauuguguccuuuggugcacaaaaguuugaugucccaaaagcacauugcccgugcugguuuuuuuuuuuuuuuuuuugagauggagucucccuccuucgcccaggcuggagugcaguggugcaauccuugcucacugcaaccucugccucccgggcucaagcgauucuccugccacagacuccuauauagcugggauuacaggcgccugccaccacagccagcuaauuuuuguauuuuuaguagagacggaguuucacuauguuggccaggucgaacuccugaccucaaguaauccaccugccucagccucccaaagugcugagauuacaggcgugagccacugcggccggcgaauuuuuuaauuuuuauuuuugguagagaagggauuuccuuauguugcccaggauggccuugaacucuugggcucaagcaguccucccaccucugccugccaaagugcugggauuacagaugugagccacugugcccggcugccuugaauuuuaaauaucucgaagaucgagcugaggaacuuuugagucauuucgugcagcugugacuggagagauagagcucauggucauugcagacacagaaguggguggguggaugguccuccugaguuacgugaaccaugcagaacgugggaguuucucaucagugugccccuguugcuccccucagagagcauuggucauccuuuugucauggaagaccucugaaaauuuguggacauuuuccucuuacguaauucaugaacaguugggagcauuucagacuucgguggcucacacuuacaaucccagcauuuugggaggcugagauggcaggauuguuugagaccaggaguucacgaccagccugggcaauacaguaugaccucgccucuacaaaaacuuuucugaaaaaauuaaccaggcgcggugaugugugccuguagucccagcuacucgggaggcugaagcaggaggaguccuugagcccgggaguuugaggcuguagugagcugugaucacuucacugcacucaagccugagcaacacagcaagacccuguuucuuaaaaaaaaaggaaaugauaaaagucacucagcuuuugcauuaaaguuuugugggguuuuuuugguuuguuuuuauuuuuguuuuuauuuauuuaucuugagauagagucucgcucugucaccaggcuggagugcaguggugugaucucggcucacugcagccucagccuccgggguucaagugauucuccugccucagcuccugaguggcugggacuacaggugccugccaccacgccggcuaauuuuuguauuuguaguaaagacagcguuucaccauguuggcccagauggucucagucucuugaccucaucaucugcccgccucagccucccaagcauuaaagcuuuuaguaugcugucuuggaguugacagguuuugccaccucuugaaaugugaauucaaguauuucauacauuuugcugaguuagcuuccuaggguguugugugcucagccuuuaugaaacagugaacaugaugacaguaaacugagagaauuuggaaaccuagcacucacuauuuuuuuagccagucaccuuucucauuucugacgauaguuagauauaaauugcugauuaaaaaugaguccuguaggccgggcacaguggcucaugucuguagucccagcauuuugggaggccgaggcagacugaucgccugaguucaggaguuugagaucagccuggccagcauagugaaaccccaucucuacuaaaaauacaaaaauuagcugggcaugguggcacaugcuuguaaucccaacuaccuggggaggcugaggcaggagaguggcuugaacccaggagguggagguugcaguaagccgagaucgcgcgacugcacucuagccugggugacagagcaagacuccuucucaaaaaaaaaaaaaaaaaaaaaaaaugaguccuguauucccagcuacuugggaagcugaggcaggaggaucaugugagcccaggaguucaaggcugcagugagcugugauuguaccugugaauagcuacugcauuccagccugggcaacacagugagaucuugucucuuacaaaaaauagaaaauugcugcguuaccugucuugacuuucucuuuucuuuuuuauuguaaaauauacauauuaacuuguaacauuggucuuuuuaaaacuaucauuucagaauuucuagaaggaggaguuggccauguugaaauguuauuucgcugcaacuauuuagcuuuaguuggugguggaaaaaagccgaaauacccucccaacaaagguacuguaauuguguauugaagaaucaugccucacgugucccacccagucuuuuuuugaaugcguuuauguuuguggccaugugugauuuucccuaguaguucugugaaauauccaggacuggucacuggggaggaagcaggcgaagagggcaccaggucucuauucccagauggagcaccuaaagagcaucacucgcuugcauugucauagaacacgugcguuucagucaguaaacggaaaacgggccugcugcaccuuagguugacgucguaaaugucaugaauucauuuuaaagcaagguagaaggauuuuuuuucuuacagagagccauugacuuaaaggaacauuaguuucauagccacguggaacaaaacaccacuugggcucuggguuucgggauauguuugucggagugggaguacguguguguaugcagaugauguggcguaagagcucuggcccuuuuaaguagagggaggaguagauagcuuuccugacagccgugugccucgugccagcuuaaccucgcuguugguugaggaaagagggcucaaggcgaaagauccaggaauggagggcagaacacagggaagaggugggaggcgggagguaggcugggugggggaggugggaggcagaucugggggaggcuugaaugccagguaacguguggccaggaaggagaugccgucagaucuguguuuugggaaaguucuggucuagaugcagugcaugaggugagugaagagacaccagaggauggggcaggugugggaagcccccguuuauggggagaggcaggaaaaguggagcaagcauccucgucugagcccagugccaggcgggaggaggccugagaaaagccaucugguucuggugacauugaaggccaccgguggucucagaggaugacugagugggagcccagugguggguggguagggugggaggaggugaggagggaaggagaggcucagugagggaggcaguucagaaucaagaccaggauggggcucugggggcgccgcaugccaaaugggaagugagugggugaacuaggaucugggugauaucacguacuuaggaauagaauagcccaggucagaucaggcacaaaaggauuguguggaaaggcagaagguuccagaugacucgugacaagcuuuggggcccagcucacaguucucagcagagccccgugaacugcgugaacgugaaugugcggaagagagaccacacucgggugaggacuggcccugccugauacauuuauuuuuguuuuggaauuaggaacagagaaaugaaaugggaagagauuaucgguaggaaaaacaguggaagacagggcuugagaucuuggccuuugagcgguucuguaaucucacaagguuugucugugccagcuuuaaagcagaguugagaguggcugcuagcauagcccagaggggcagaggccuguggcuugugaguccucuggaggagcccacccagaagggacagcggagguuccacagagagagcagggcaggauuugcaggagaaugacuuugcccuggcuaauuggggaugggcagaaauccugcuggugaauuggucugugucuugucauggagaacuucauugaccauuaaggaggaaaggaagcuuauagauggaagucaggaggccuagagggccgccucccuugcccuaccucuggcacugcugggggaccccaggugcuaacaagggagccauuuguaugagauaaucucaggucucauucucauuauaaaguuucuaagaggugaaaaagccuuagaaacuucacagacuuagaagaaagcaguauucagcagguuuuugaguaaauguacuuuuuguagcguuuaaagguacuuuuuuuuacuaguaaacuugauuuuuauuuauuuaguuuugagacagggucucacuguguugcccaggcuggaaugcaguugcgcaguccuggcucacugcagcuucuaccuccccaggcucaggugauccuuccgccucagccucccgaguagcugggaguaccggagcacccaccacacccggcuaccuuuuguguuuuuaguagagacggcguuuccacauguugcccacgcuggucucaaacuccugagcuccauugauccgccugccucugccucccaaagcgcugggauuacaggugugagccaucacacccagcuguguuuuuuguguguuuuuuugagacagggucucccucuguugcccagcuuggagugcaguggggugaucauagcucacugcagccucagacuccuggacucuaccugaguagcugugacuaauuuuuaauaacuuuuuuuuucagaaaugggagucucacuauguugcccaggcuggucuugaacucuuggccucaagcgaucucacaccccagccucccaaagugcugggauuacaggcgugagccaccgcacccaucccuccugugguucuucaaaagcacggugcugguuggcauucucaucccuaaagcuugucgguacauuagcccuuagaacacaaacugcuaauuuaugcuaauagaauguugcaauguuagcaggcaaacaagacagaagaaauuuugaacuuaaaaaggagcaggggcugggugcaguggcucacacgugcaguccuagcacuuugggaaguugaggugggcagaucacuucagcccagaaguucgagaccagccuggacaacaugguaaaaccccaucucuaccaaaaauacaaaacuuagcugggcaugguagugcaugccuguagucccagccauuugggaagcugacgugggagaaucucuugagccugggaggucaaggcuguagugagccaagauugcgccaccgcacuccagccugggcgagagaaugagacccugucucaaaaagaaaaacagaaaaagaggaagaacaacccaggaccuugaguggagugaggaacuuguuggcccugauuugugucccucugauuucacuuuaaaacugaaaccucccuuccugaugcagguuuauuugcagcacuuuuaacaucaguaccuauggucaggcuugccuaugggcucagucggguggaaucaaggaaggucagggagaggaacguaaccaggcaagggcaaggguuggcagagagagaugaacgcgcucagcgcgccugugugcgaggccagugggucgccugagaccgggaccgggcugugcgcacugagagaggaacggacggggagggagcaaugguuggcagagagagaugaaugcgcuuagcgugccugugugugaggccagugagugggucaccugagaacaggaccgggcugugcacacugagagaggaaugggcggggagggagcaagugggcagccagcuaccaagaaggggagacgcuuugaguggggaaggugcccgagggcggaucccuggcacagcucacgguuugaguuacaccccaaggccucccaggugcgggugugugucugaggccugagggugggcgcagcugugccagugggaagagaaaacaccuuaggcgccaagcuggcaucgcugcaucccagcgccauggccugcugaugacugcauucaucuuuucuuucugauauuucaguaaugaucugggaugaccugaagaagaagacuguuauugaaauagaauuuucuacagaagucaaggcagucaagcugcggcgagauagguggguuuggugucaguaauuuuuuaaagugguauuucacuuucucaaaagauggcugaaauacuuuucuauuuuuggcagaaaaauguuuaggaaaugauguauuaaaauguugguccugguuuuuaugaccauaaggauauaaggauuauuuauauugcugcaagaaaggcagcgaauuguguuuguuuccagggcuccgcuggagguaaguaggugguggcguggaugacgugcgccacaguggaccagccagugggucucaccguggugaguuaugucccauuccgacaugugcagagcugaggacaugaguuuugagccuugaauuacccugggcuuuuagccccugcuuugccaaaugcugccucucaauaaagguuuucgguuugaagguaaaggaaaauugaauuuucuguguugaaaguagcaggugguucugucagccauggucucaggggcguuuagggggaauauggaaguuuguccuaguacguugagcaagauagcgcagaguucguucauuuggguuuuuauuuaauaugauuugcauauuuuacucuaagauuuccaucucugucggcugugggaggacagcagccgagcaaguuggauguaaacagaggucauuucaccucccugcccuuuuuuuuuuuuuuuuuuuuuuuuugggagauagagucuugcucuguugccagacuggagugcaguggcacaaucucaguucacuguaaccucugccucccggguucaagcaauuccugccucagccuccggaguagcugggacuacaggcgcacaccaccaagccuggcugauuuuguaucuuuaguagagacaggguuucaccauguuggccaggauggucuugaucccuugaccucaugauccacccgccucagccucccaaagugcugggauuacaggugugagccacugcgcccggccaacuuuccugcauuuuuguguggguuugucauuuuaauaacgucaauauuuaaaggcccuuaguaaugcaaauguggccgggcaccguggcucaugccuguaaucccagcacuuugggaggcugaggcaggcggaucacaaggucaggaguuagagaccagccuggccaaccuagugaaaccccaucucuacuaaaaauacaaaaauuagcugggcaugguggugcacgccuguaaucccaccuacucaggaggcugaggcaggagaaucgcuugaacuggagguggagguugcagugagcugagguugugccacugcacuccagccugagcgacagagugagacuccaucuauaaaaaaaaaguaauaauaauaauaaugcaaacgcuugagccagaucgaggauauucuacuuucagacuuuucuuauuuuuuccagacacaguagcauaaaaauaucacuucugucuguuuugcucgguucugaaccuagauggaguguuugaugaugucucucugaaccucagagacgucucuuaggcugaccuucacccaggcgagaagcacucccucagcagagccagcccacgugcacucgccgagcuccaggccuggcgcuggcuaccugccuccagagcuuuuucuucaggaacacuccuuuucugugugguauuuucaguguuucucaguuucaguaugauaagaacaggagcauaaaauguuuggguuugacucuugaggaaagcaacucugaucauguuuuucuuuccagaauuguggugguuuuggacuccaugauuaagguguucacauucacacacaauccccaucaguugcacgucuucgaaaccugcuauaaccccaaaggugagagauugagcagacggguggcgaugggaaauggguccacauggagaugccugugcugggcacucccuucuccaagcaggucucugagcaaagugcuuggcgagagcaauccugagcacagaggggccuccagaggagauggaccuuccaggacccacagcucagcauccccaaacuaccuucugaccagagucacagagugggggccccuguccccucccacccagugacuaugggcucucagaaccuccacagugaaccaggaaccuauguuuucaccacuucgggagccacugaguucuggacucaagccuuuccuucccuugucuucugaauuggaggauugauuguguuugacuuugucauuuauuguaccaucuucauaucuuuuuauauuggggguuuugccucuggcuuuguuaggguaaaauuuacaaaaaacugacucguuuuaagaauaccauuuguggccgggcgcgguggcucacuccuguaaucccagcacuuugggaggccgaggcgggcggaucacaaggucaggagauuaagaccauccuggcuaacacggugaaacccugucucuacuaaaaauacaaaaaauuagccgggcgugguggcgggcaccuguagucccagcuacuugggaggcugaggcaggagaaucacuugaacccaggagguagaggucgcagugagccgagaucacaccauugcacuccagccugggcgauagagcaagacucuaucucaaaaaaaaaaaacuucaauaaauuuccgucauuguaaacaguuguguagccaccgucacagucaagacagaacagucggccgggcgcaguggcucacgccuguaaucccagcacuuuaggaggccaaggcgggcggaucacgaggucaggagauagagagcauccuggucaacguggugaaaccucaucucuacuaaacauacaaaacuuagcuggaugugguggcgggugcccauagucccagcuacuugggaggcugaggcaggagaauugcuugaacccgggaggcggagcuugcggugagccgagauugugccacugcacucccgccugggcgacagagugagacuaaagaaaaaaagaacagucucuucuccuggaaaacuuucuugggacaguccccuccccacucaacccucagguuuuguuuuuuuacauguauuuguccucuguguguguguauguguguuacuuuguuggucccuucggccguguuuuggcuauuaggaaggaggagugucgugcauguucccauagcagccuuuguguggguaguuucaugucucuugggucgauccugaggguucgacugcccggucacaaccauguugugguugugucugacuauaaaaugcggccguuuauuuuccagaguggcuguguccccuugcgucucauccaugauuuaugaguguuccagcauugucggucuuucuagcuguagccguuccgugcgugugugaugauaucucacugguaacggcaucuccuugugguuuugguuugcauuucucugaggacuggcgguggcgacaucuuucccugugguucuucccuuucgagaucuuuugggaagugccccagauguuuugcccauuuuuuagccgguuguuuaucuuauaaugagauguaagaauuuuuuuuuuuuuuuuuuaauaugagauggggucuuccucuguugcccaagcuggagugcaguggcaugaucucggcucacugcagccucugccucccagguucaagcaguucucccaccucagccuccugaguagcugggacuacaggcacaccaccaugccuggcuaauuuuuguauuuuuaguagagacgggguuuuaccauguuggccaggcuggucuugaucuccugaccucgugauccaccugccucggccucccaaagugcugggauuacaggcgugagccaccgcgcccagccccauuuuuuuuguuuguuuuuuuuuuuuuuuuggagauagagucucgcucuguugcccaggcuggagugcaguggugcgaucucagcuuacugcaaccuccgccuccuggguucaagcgauucuccugccucagucccccaaguagcugggauuacaggcacccgccaccacgccuggauaauuucuguauuuuuaguagagacgggguuucauuauguuggcuggucucaaacuccugaccucaggugauccgccuuccuuggccucccaaagugcugggauuacaggcgugagccacugugcccggccguaagaauucuuuauauguuguagauuuagccuuuucccuggcacacuuuugcaaguauugcuaaaagauuucuuuuauguuuucuucuacacauuugguagcuuuucaucuaaaguuaaaucuucgauccauuucaaguacauuuuguauucagagugaggcacacgccuggguuccuuucuguucuauguggauaucuaagcuugguaccuuuguuuugauuaaauaaauacaagguuuuuuuucuggacuuuuuguucucuuccauugaucuguguuucugucuuuaucccaguaccauccugccuugauaagagguuuaaaguaaaucugaaauuagguaauauaagucuugcaaucuucuuacuuuacaaaaaaaaaaaaaauuuuuggucaugccuguaaucgcagcacugugggaggccaaggcagguggaucacaaggucaggagauugagaccauccuggcuaauauggugaaaucccaucucuacuaaaaauacaaaaaauuagcuggacaugguggcagguggcuguagucccagcuacucgggaggcugaggcaggagaacggcgugaaccugggaggcggagcuugcagugagccgagaucacgccacuguacacuccagccugggugacagggccaggcuccgucucaaaaaaauaaaaaauuugggcuguuccagugccuuuauuuuuccuuauaauucuuaguaucagcuugucuuucuucaagaacccuuucugagagguuagcugugaucacacugacuguagaugaguuagauaguaauagccaaucuuccagcccacgaucacaagaccagcucucucucagaucuucuguggucuuccuuugcaagauguuacaguccauggauaggucuuguacaucuguuaacuuauuccuccguuuuuuaauauuuuuacgcuguugcugauggagcagcuuuuaaauuuuauaauuuugcauugcauuuucgguggcguguacccugacggacggacaguugguaaagucguuaauuuugcauugcauuuucgguagcgcguaccaugauggauggacaguugguaaaguuguucagcagaugucuugauuaugaggaggucucaugcgagguagcuuugcuuagcccucucauacucuuuauuuacaaugaaaaaucuuuaaauugaauuugugguucugauauuuauaaaugauauacaucuauuuuuucggagaacuuugggggcagaaaguggacuuuggcugugagaaaucaaaggcaguucuugauugguguccucugucuccacgcaggccucuguguccuuugucccaauaguaacaacucccuccuggccuuuccgggcacgcacacgggccaugugcagcuuguggaccuggccagcacggagaagccacccguggacauuccugcacacgaggguguccugagcugcauugcacucaaccugcagggaacaagaauugcaacugcauccgagaaaguaagugugccacucaccuuguugguguugugccuccuggagcagcaggcucagcaaaauggccauucccuguaucaagacucaaaaggcagugggccugccccaaccuggagccccucaggggccuguggaccuggcuggucaugucaucagacagguugaagucuucacaggucgucuugugcccagggacugguuuuauuucuaauuauuuacaaagcagugucuuguaaaauaugauaagccaaagaaacagggccaggggcaguggcuaaaccuguaaucccagcaauuugggaggccaaggcaggcggaucacuugaggucagauguucgaaaccagccuggccaagauggugaaaccccgucucuacuaaaaauacaaaaauuagccaggcauggugguguguaccuguaaucccagcuacucggaaggcuaaggcaggagaaucacuugaacccaggagguggagauugcagugagcugagaucaugccacuacacugcagcccgggugacagagugagacuccgucucaaaaaaaaaaaaaaaaagaaacaaaaauacguccacauccaaguugauuacagugaucagauaugacagcuuugucauauucucauagauuuugcagaaccacucaacuucugugcuccugucuucacagccugauaacacacagcucaaaacccuuuuuuaccugcuuaguaacgugucuucauugaauuaccaccagauuguaacugaaaauauugacguauuggacacauuguccuuugauuugcgaggucagaagaacuguuaauuuuuuaaaauaauuuuaaaucugggguucuuuauacuucuuuuugccugaauucagauuuuuacaaagaaaauugguaucuuguacuauaguuuucauugaagacugcaaacccgguguuacuuuguaggaaauuauaaauuguuaaggaggugagaccgcaagccggugaugguauccguuugugggcacagugcacugagguucagugcggcccugcuccuacccuuucacgcggugccagugccagggucacuccucagcacguggggacacgcgguuuggggcgugucccgcucacuccugggacucagcugagaacagguuuaguuauuucuagguaguuuuuguuuuguuuuguuuuguuuuuugagauugaguuuugcucugucacccaggcuggagugcaguggcgugaucucagcucacugccaccuccgccuccugggugccagcgauucuccugccuccaccucccgaguagcugggugacaggcacccaccgccaugccuggcuaauguuuguauuuuuaguagagacgagguuucaccauguuggucaggcuggcuuggaacucccgaccucaggugauccacccgccucagccucccaaagugcugggauuacaggcgugagccaccgcacccagcccuuuagguaguauuuuuuagaaugguaucauauuagcaacaaaauagauauaauuuuguaugaauuagaaaugcgguuccucuguauuuuugguacauuuuuucuuacccuuuuuaucuuuagauucuccauccccacucccugcaacuuuucuucuuuagauagaauccccguuacaaauguggaugcuucucugcuuccugcuuucuuagccgcagcggugcccuccggguuagccagguagaugggauuacgcagagccuugcaacaucugugacccaucccgugcugucggcagucaccccgugaggcugcuccugccuugucccccacaagcuggcuccuuacugcacccccaggaguaggggcugcuggguugaaggauauaaagauuuuuuguuggauguugucagaguguuugacaaaagaugcagcaguucucguuuucccagcugucagaaucagcugaagaguccuccucguucuggaggagauguuaaaaacuucccugaggucuugggcaccucuuucuugggaaagccagcauagcugacauggauggguuuaaguccuuuuauuuuuuuuuuuuugccucaccuuuuugauggccggauucccgugcugcuuuuccuagcuaucugagggacuuaggauucggacagugcuucucagaugagcucccuguguagcaggagcagggagccugggccuggguguuccuccugggucucagccagggaugcgggcauccagggucaguccacccugcccggucaggagguugucucuggaagccucucuugacuugugcccagugccgugggaccaggagccaccaaccaacucguucucaggggcacaacugugugcuggcaguuggaggagaaaguuaaguaguagaugaugugggugaguuugagaaaggcuuguguggacuaauggauuugugaaugugagucauuucaaaaacuaacgaaaaaguuuugaaucuuugauaaugaaacacuucacuguuuuucaaaggggacgcuuauaagaauauuugauacuucaucagggcauuuaauccaggaacugcgaagaggaucucaagcagccaauauuuacugguaagggcaccuccaacuucaccggagaagaacuucgggcugacagcacggaagugggccuuugggauuugggagaggggguaggagcagccacccucccccgaauaaggccagaggagggagaagcuugggcugcuaggggguuggguuucagcuuuuuaaauugugauuaacuuuaaguuuuuaucgugggaaauuacacagaaguagaaagaaugucauaauuaacccugcuucagcauuuauuaguauuugaugguuuuuguuguugguggguuuuuuuuguuguuuuuuugggguuuuuauuuugagggaaggucuugcucugucgcccaggcuggagugcagugacgcuaucacagcucacuacagccucgaccugggcccaagcgauucuccugccucagccuccugagcagcugggaccacaguugugcaccaccacgcccggcuaauuguuguguuuuuguagaggggucucgcugcugcccuggcuggcgggcuuggguucaucccuguuuauuuuuagucuuucugguguuuuugccaguuucaucucgucaccagcgcucuggcuuguguuuaaggcaaugcuggagaccauguugguuugucugauuccagccuguuacagucugagaggccacacugccgccccacaguggugucccuacagccccccgggugucuagugcugaagcccuacuuggguagcaucucaugcccuguggccacggccaggaggccuggugccucccccuuggcuaguauugagcagcauuugggucuuugagaugaaaauguaauuaauauagccgggcgcaguggcucccgccuguaaucccagcauuuugggaggcugaggcagguggaucaccugaggucaggaguucgagaccagccuggccagcauggcgaaaccccaucucuacuaaaaauacaaaaauuagcugggcgugguggcgugugccuguaaucccagcuacuaggcagggcugaggcaggaggaucgcuugaaccugggagguggagguugcagugagccaaggucgugcuacugcgcucuauccugggcaagagagcgagacucugucucaaaaaaaaaaaaaagaaagaaaauguaauuaauuuauaaauacggcagcuuuaucugugagguccugggccuuguggugugcauagcacaucccugucugcuccuagaacagacagcacacggccaaugccugccccagcccagcugaccuccauaggggcagccugcaccuuccugaggccaggaucauuggagagaauguguguuucucacccgagucuugugagagcagcccugagcggcauguuggggguguggucugcaagaagucccuucccucucccagacacacagcucaucagcugcauuuguggggcacccaaggaaaacuugccgugauacacuggauuguggcuguggcuuuguggcuucaaccuguggugcuguggggaugguugucggcuuguuaaagaaagggcaguauucagaauuggcaccuccagagugggaauguugagguguuccacagugucgacaagugcuguggguuaagucucuggacuccuccacauccacacaaggccugagcugugcugguuuucucugcagcaucaacuucaaucaggaugcgucccucaucugcguauccagcgaccacggcacagugcauauuuuugcagcugaagauccaaaaaggaauaaacaguccagguagguguuaggaugccugcuggggaaaagccgggggaugagaggaguccccaguguuucaguguggacgggacaggccccccaccccagcagggugguguggacagaccucauaugcuaucagcgcugaaaucuuuuucauuuaauuuuauauuuguugggguuuaaaaaucagugcaggcugggcacaguggcucaugccuguaaucccagcacuuugggaggccgaggugggcagaucaccugaggucaggaguucgagaccauccuggcuaacauggugaaaccccaucucuacuaaaaaacaaaaacuagccgggcgugguggcgggugccuguagucccagcuacucgggaggcugaggcaggagaaucgcuugaagccgggagguggaggcugcagugagccgagauugcgccccugcacuccagccugggcuacagagcgagacuccgucucaaaaaaaaaaauuuuuuuuuuaaauaaaauuguacaacaggcuuugucaugcauggcaaaaaaaaaauucauuaaagcucaaaccauaugaaggagcauuuucguauuuucagcagcguauucugagcuuacgcaggugauuuuuuuuccuguaaacuuugaaccacccuuucuuuucuugucuucacaguuuggccucagccaguuuccuuccaaaauacuucaguuccaaguggaguuucuccaaguuucagguucccucaggcucuccgugcauuugugccuuuggaacagagccaaacgccgucauuggugagugguccuuccuggagagaacguccccacccgccccaccugggcuccauccacugagcgucagaccuaacuucccauggacgucccagcaccgcgcuguggcaccgauggccgcccaguuccccuuauuucuccugugggcucagugugucccgcuuacggucugcacggccauuugggaugucuucagcccccaucccuccaguuucccccaggaaaucacagggacaggucuuccaauguuuguauagaugaccaagaauguuucuuaacccuguagccaacaccgggugauuagaugcucacaccaagacagucaggauucccggccacggugccgaccgaacgcauucaguggggacccuggggccuuucagggcuuucagagcagcugccuggcuccaagaggcccuuugcaguucagcucagugggacucguugcuuuuaacuugagggaaagaaacacacagguaaaauggucuccuucuaucccagcaauuugugcagacggcagcuacuacaaauuccuguucaaccccaagggggagugcauccgagaugucuacgcgcaguuucuagagaugaccgaugacaagcugugacuccagcugggggcgccacagcacccaccaccugccgccuucagacucucggggcuggugccagugccccaggggccuccugggccacgggcuggaggggcugcccagggaccuuggucucgaagccauacgugguugucugcuuuccuaaggacucccauuuccaguauuaaagagagaaucaucaucaaggcaccguagguaacucaguggcugugaccagcucgacuggcggccacuggcuguucccaugaguucagcugugacguuagcuucaguggcuccgccgcauccucacacugacgggggcuccauacggaccuggggacugggcugagaggguggacgaguucagguuuguuuuugcagcagauuccgucguucuuacugagucugcagcgggggagugaacaagugugcagauguaaguucuuacaugauaagcagauugaauacaacaccagcagcuugccuuagaaaaggagaaaggaauuccuuuucccgcccgaacaugaagaaaaaugaccugacccuguagagagaacacagugugaauguuuccccucgugugagcccagccuguggucuucuccguacccgcaacguggucaucugugcccgugacgucaccugugcccgugcguggcguccccgucuccguuggggccauuagaaugaggcagacaccaggccacucuagaagccgagccgucacaccucaggcgugugcggggcggggacggggggucuccugguuacauuuuggauuaaaccuguuucccgguuauguguagggaacagcagagugaugcacgaacuuugaacauucguuauggggaaaacauccuuuaacuucggggucgucugccagagcagggucugggaggguccaugcaguucccgcugguguggagggaaaugcccuggucuggccuccgagcccccagguccaccgucuccccuccccucauuuguaagaauagcuacacacuaacauuuugggaaggagaggcacauaacuuuuuuuaacauuugguaacuagguuaugggcucuacauugucagcuacuugggauauauauuuaauuuucuuaaauucccguuaaacucuauuuuaugguuuugauuucagauugcaaacauguaaaaccugcauagcagcgaguucucgguuuugccgguuucuuuaguucuuuacugucacugucauguaaucagcuaauucucuguggauguugcuguaaaguaugcauguuccuuucauguguauuuaaucaugauguuuaauuuugcacacuuauuuguaauguuucuuuuaaauaaaagugacuaauuuuguuguagucuggaccuguaa

SEQ ID NO: 192336 - RNA, 191123 nt, Homo sapiens
ggccagcgucgguugccgccuuagcgggcgccuccuuuucaucccucauccuucaucccuggcuuucgcgcucuagcggagugggaucugcgaacacgugaggcgggggcgcgguccccaggcugccgagauggcccugagcgacgaaccggccgcgggcggccccgaggaggaggcggaggacgagacacuggccuuuggcgcggcgcuggaagcguucggcgagagcgcggagacccgggcgcugcugggccgccugcgggaggugcacggcggcggcgcggagcgcgagguggcccuggagcgguuccgcggugcgugggcggcgccgcgugcccgcuuccucccccggcccggguucggcgcgcugagugcacuuuaccgggcggggaccgcagcccggcggcgccggccgcucugcgagggcugccggugcgcggucccgcgggccgugguggggcgcggccuuccuaggcgggagagggccaccccggcgcggcguuaggugcacggggcagacgcgcgccucccuuggggggaccguggcccgcggagcgccugcucucgcacggggugaagccucugcggccuccccgggaggcggggugcagaagcccuccgucccccgucuccgucacuggaggaggucccugggcuggggagacucgggccagaccccuccggacagcuggucagcccugcaguguggacucccaggcuugccuccaccgagcgcgguuucugugaauguuguguggacagggagauagggaaugagagagggggacgcagggaacaaaccugcugcaaacaaagcgcgccucggguggggagggcagcagccuguccguuccguggacgccguggacagagcgggcuggccggguccgugccucugcaggcggggugggguguagguaccccuguggaggccauucgaugagucuaaauucuccgaguucagacccaccuuuaccgcugucuauaauggguuauuuccaaacaaguccuuaggagcucauagcuaaguaguuacaugggguuuuguaauucaguaaaaucaucuuuguagacccuuugaguaagaagaacuuuugcauuauuuggccuuccucauuuuagaaugacagcgcuuugauuuuaggagucaggcaggguggggggccuugugggaggagugcggguucggcgucagauccuccugccugugaauucuggcccugucgcuuggaccugauacuugauugccuguuucuucggguguaagcuggggcggauaacgaugccucucgugcagaacuguucugagggugagggacccucauccagggaccagugaagccagauuuuuuguuccugguguaacagcccaauggcuucuuccuuuuuuuuuuuuuuuuuuuuuugauacgaagucuugcucuguugcccaggcuggagugcagugcaguggugcgaucuuggcucacugcaaccucaaccucucagguucaagcuauucuccugucuuagccucccgaguagcuggggcuacaggcgcgcgccaccacgcccggcuaauuuuguauuuuuaguagaggggguuucaccauguuggucaggcuggucucaaacuccugaccucaaguggucgcccgacucagccucccaaaguguugagauuacaggugugagccacugcgcucggccccaguggguucuuucugcgggcugcccagauagaguugauuugucagggcaggggaguugccauggagaagauuuaguucacgcagagccgguugaaagggagacuagacuagagguuuuuuuuuuuuuuuuugaggcggagucucacuuugucccccaggguggagugcagugaugagaucucagcucacugcaaccuccacaaccuccaccucccagguucaagugauucuccugccucagccucccgaguagcugggacuacaggugcgcgccaccacgcccaccuaauuuuucguauuauuaguagugacggguuucaucguguuagccaggauggucucgaucuccugaccucgugauccacccgccucagccucccaaagugagccaccacgcccggcuggaguuuuauuauuacucagaucagucucccugagaauuugagggccaggguuuuuuagagguaaucugggggaaaggguggggguggcugauugguuagggguauacaaucauaggggagucggaaaugauccuccgugaugugcugaaucgcgucugcguggggccccaggagcagugggcggguccagguggagcuaucauggguccguggauccuaguguaggugucagacauggaaacaaucugaaaagauaucuuuaaaggccagucucagguucugcaauagugacauggucugcaggaguaacuggggaacucgcaugucuugugaucucaagaauaauggcuggcaauuagguuacgccuuagcggaauucaggcuccucuccuccuccuagccugguggccucucauuaacuuuacaaaggcaguugaguuuuggggaagggcucuuagcauuuaaacuauaaauuaaaugucucccagagguagcuuggcagcuugaagacuaaaggcaugaggggguugccuggaucagaucugccccauugccauaauuuccucacagaucacuuuugcaaaggcaguuuugcugggaagcaguggguguguucagauguggaggugggagcugccggauuggacagaagcaguuucagcugcugagaggaggagaaagcggugguucagggucugggagguugugaagagcuggcagcuguguggaagggagcagugccuggauaugucaaccaaaaaguaucugagacgagucucaaucaguuuagaagguuaagggugugcccgugaggcagccucaggaggucacauguccccaaggaagucgggcuacagcuuaguuuuacacguuuuagggagacgugagacaucaaucaauaccuguaagauguacauuggucucgucagggaaggcgggacaucuugggugggagggcguccagggcauugguggauucaaauauuucacgauuggugauugguugaaagaguuuaucugaagaccuggaauccauagaagggauugucuagguuaagauaaauuguggagaccaagguuuuucuuaugcagaugaagguuccaguuagcugguuucagagagaauagauuguaaaugcuuuucaucagacuaaaaagguaccagacuuaguuaauuuucucuuggaucagggaaaagaccuagaaaaggaagggauucucuacagaauguagcuuuucccagcaagagacaacuuagcagaaccauuucaaaauaugucaaauauauuuuagggaaaaauauuuugauuucuuucagggccugcugucugucaugugaugcuguacuagagucaggcuggaauuuggugucuuauugcuacuuaagaucgguuuuaaugcuaauacugaucagcugugccugaauuccaacgagaggaggguauaaugaggccuauguggaccacuccccacaaucccuuaauaucaugaggccugaacuaguuuuucagguuaaguuuggaaugcccuuggccaagaggaggggucuguuagauggcuagggggcuuagaauuuuguuuuuaguuuacaggcauguuuggcaggggagugugagaggagugccagggaugugugucucacaaggacagaguugagcuuggcccuuaacggcuggcagaggcaggagagagugaaggaaggaagaggcgaggaggagacucuguuaggaagaguaucgaggcagugggaaaagaggaacagugugccaagcaaguaaacugcacgaggcugggccacaguggcccucaaaaggcuagagggagguggggcauucccuccagguggccuguguggccuccuuuagugagaggggaggugugcucuugagagcuggggaagagguggagcugcccuguggaagcuagcaagggaaaaugggguuucugaggcucauggguauguuuggccuagugauaauuaauuuucauguuauauuuguuuuuaguaauaauggacaaauaccaggagcagccucaucuguuggacccgcaccuugguaagaauagaagcugcugauuuugaucauucaguuacagaugaccacggaggccuugguguguggugcuggcacaugcaugugcuuugccaggaucaaaugccaagaagugucccugucuugcuugccuggcugguugguuuuagccgaccugugauaguggcuugaguuccagaugucacucuaggcuggggggagaugugucugagcuacuuaauuccuuucugcuaaggaaacaacaucugcuccucauguguuuuuuuuguuuuuuuuucuuuuuuuugagacggagucucgcucugucuccaggcuagagugcuguggcgcgaucucagcucacugcauccuccagcucccugguucaagggauucuccugccucugccucccgaguagcugggauuacaggcaugcgccaccaugcccagcuaauuuuuguauuuuuaguagagacgggguuucacuauguuggccaggauggucuugaucuccugaccucgugauccgccugccucggccucccaaagugcugggauuacaggcgugagccaccgcgccuggccuccucaaguguuuuuaguuuacauuaguuuauuauuuuaguuuacauuugggcacaugauguuuuucugguaauagucauacagggucagguguuuuacaugggucaucauuuaauccucacagcagcuaaggagggcaucuguugucaucuccaguuuacagauggggacacugaggcucgguuuucuuacuuuaguguaaggggugugguuucuuauuguuuucuuuauuuuugauguauuucacacugauuaaaauuuuucuuuuucuaccuacaaaugugacacaugcuucuggcaguucaccugggaaagaggaagguggcaauagucaccacguugagagggagcacccugggugggggcacccuggcuucauagcccaguuucaccauucaguuuuugagcugcucuuugccgggguuuccucgccccccgugguguugagaucugugugagagacacuaagggucagccuuucaugugcgcacacgugccucuuaaagaguaguuugugcugugcaucuuguucuguuuuuuuuucuucaaauaacagauuuuggcugggggugguggcucaugccuguaaucccagcacuuugggagguggaggcggguggaucacuugaggucgggaguucgagaccagcauggcuaacacgaugaaacccugucucuacuaauaauacaaaacguuagcugggcaugcuggcaguugccuguagucccaguuacuugggaggcugaggcaggagaauggcgugaacccgggaggcggagcuugcagugagcugagaucacgucacugcacuccagccugggugacagagugagacuucaucucaaaaaaaaaaaaaaaccaaaaaaaacccucuaaauucgggauucaagaauucauugggaucagacuuguccuucuguccuagaaaaauuuauaggccuugugaaggagaccaaagauagagguccuugggagagggucagcugcagggaacaugacucugacaucugguggaggggcuagccaugcuggauggcguggcaggcagugggcuccccaggccauaucuuauaggaggucuuggguuccuggaguuccugugugugagcgcugguucccaggaaacagauguggucacugcucacaagguagcgggugguguuuuuauaucucuucaaguaacaacguuggaccuguaguuaaaugccuuuauucuugccagaccucuuuccagaguggaucauggaauauuaacacuuguugugagcugcuuagaguacugcgaaugauuuuuagaguuauuuucuuucuuugcaaaaacuguuuuucgccgggugugguggcuuaugccuguaaucccagcacuuugggaggccggggcggguggaucaccugaggucaggaguuugagaccagccugaccaacauagugaaaccccguaucuacuaaaaaugcaaaaauuagccgcguguggugcacgccuguaaucccagcuacuuggggcugaagcaggagaauugcccgaacccaggaggcagagguugcagugagccaagaucgugccauuguacuccagccugggcaacaagaacgaaaacgucucggaaaaaaaaaaaaaaaaaaauaaauaaauaaauaaauuuuuuuuuuuguagagaaggggucuugccguguugcccaggcuggucucauaccucuggguucaagcgguucacccaccuuggccuccuaaagugcugggauuucaggugugagccagcgugcccagcugaguucauuauuuucuggaauuccuuuuuagaaaaaggaaaauguagucgugggaugcugguccuuugucauuuguugcacauuuuuccacccuuuugcuuuuuuuuuuuucuuuuuuuuuuuuuuuuuugagauguagucucucuguugcccaggcuggaguauaguggcccaaucuuggcucacugcaacuucugccuccaggguucaagcgauucuccugccucagccuccagcguagcugggauuacaggcgugugcuaccacgccuggcuaauuuuuugcauuuuuaguagagacaggguuucaccauguuggccaggcuggucucaaacuccugacccccacgugaucugcccaccuuggucucccaaagugcugggauuacaggugugagccauugugcccggccugcuuuugccuuuuaauauugugucugguguauuuuaucuacugaaguuuuuucguguuuguuuuuuuaaagagaugggaucucgcucugucacccaggcuggaguguaguggcgcagucauagcucacugcagccuugagcuccugggauuaagugaucuucucacuucagccuccugcagagcugggacaacaggcacaagcugccaugccuaguuaauuaaaaaacuuuuuuuuuuggccaggcgcaguagcucaugccucugauccuagcacuuugggaggccgaggcggguggauuacaaggucaggaguucaagaccagccugaccaacauggugaaacccugucucuacuaaaaauacaaaaauuagcugggcauggugaagcaugccuguaaucccagcuacuugagaggccgaggcaggagaauugcuugaacugggacccaggacgcggagguagcagugaacgagaucgugccacugcacuccagcgugggcuacagagccagacugucucaaaaaaaaaaaaauuuuguuuuugcagggucagggucacgcuguguuccucaggcuggucucgaacuucuggccccaagcaauccugccuuggccucccacagugcugggaugacaggugugagccacugcacccagucucuacugaaguuuuagaaauauuuagcuugucaaacuaucaguuucuuuguguuuggccuuugguaguacgguuagaaaguuuauuuuuccuaaucaguuauguaagccucauuuauuggaugauuuaguggccucuccccuacuugaaaugccauuuuaaaucuauauuaaauauucaaauauauuagccuuugcuuuuagauuuuuuauccuguuccauugaccuaucuguaugcucuuuuuucugggucauuucguuuguuuguuuuuuuuuuuuuuuugagauggagucucgcucugucacccaggcuggagugcaguggcguguucuuggcuuacugcaaccuccgccucccagguucaagagauucuccugccucagccucccgaguagcaugugccaccacgccuggcuaauuuuuguauuuuuaguagagaacgguuuucaucauguuggccaggauagucucgaacuccugaccucaagcagucugcccgccuuggccucccaaagugcuggaauuagaggcgugagccaccacgccuggccugggucauuuuguuugauguuaguuuauauuuugccuggcauccuuuccucuuauuuucuugaugguuuuguagcccguucauuaaugcggaugaacuccggaauuauuuuaucacucuccacccuuuggaauucuauuaaauucacaaauucauguaggggagaagucuuucuaagauuuaauuuucaugucuaagaucaugguauuaugucucuaauuauucacaucuuuuguguuccucagugaagguuggugauuuucuuuagaugauuccuggagacuuuuuuuuagguuuauuucuagguauguuuugucuuuuauugcucuugugaaacuauuuguuauguguucuaacuaguuauugcugaugucuagugaagauauguuuuguauacuguuuuuguaaauggcaacacuguaauggaauauguauguguaaacauacauuucuuaacaucuuuauagggauauaauuacauacuauagaguucacucuucuaaauauacauuuuaguguuaguguauuaguguauuacagaguuguguaacuaucacuaccacaaucuaggcauuuucaucaucugaagcaacccaacucccaucaacaauuccuucccauucucugcuuccgcaguaaccacucaucuggcucuggguuuguguguauucagcauuuugugugauggaaucaugcaguaggaggucuuuuggcacuggcuuuuuucacuuagcaucaugucuaugagguucacugugugaugaaauguuuacuucaauaguuuuucagucuuuuuuuuuuuuuggagacaaagucuugcucugucacccaggcuggaguguaauggcgugaucuuggcucacugcaaccuccuucuccuggguucaagcgauucuccugccucagccuccugaguagcugggauuacaggcgccaccuguaaaauuagccuggccaauuuuuguauucugaguagagacaggguuucaccaugauggccaggcuugucuugaacuccugaccucaggugauccaccugccucggccucccaaagugcugggauuacaggcgugagccaccgugcccggccaguuguuucuucuggguuuucuuagcagguaaauauuauaugguuuguaaauaaugcuacucuuuauccacgauuauaaauuuuuauucuuagaacauuuuauugaguuuuaauuuuauugaguuuaaaauuuaccuacuauaaaaugcacccauuuuaguaagauguuugaguuucgguaaauguauacaccccgcgcuaucaagauauggaacauuucugucaucccaaggaguuacuugauguccuuuugcugucaguccccucaccccagcccuagggaaccacuguugguuaaugguacuguucauuaguuuugccuguucuagaaucauucaguaugugcucuuuuugucuuccguuguuaaaauaacaucuccgggacuuaccauuguugguguguguaucaguaguuuguacguuuucucucgugcugauaaaucacaauuuguuucuucuuuuuuuuuuuugagauggagucuuggucuguugcccaggcuggagugcgguggagugcaguggugcgaucucggcucacugcaagcucugccacccggguucacgccauucuccugccucagccucccgaguagcugggacuacgggugcccgccaacacacccagcuaauuuuuuuuuuauuuuuaguagagacgggguuucaccuuguuaaccaggauggucucgaucuccugaccucgugauccgcccgccucagccuuccaaagugcugggguuguuucuucuuuuaucuguugauggacauuugaguuguuuccgguuuuuggcuguuauuaauaaugcuacuuuuugggaggcugaggugggcagaucaugaggucaggagauugagacuauccuggcuaacacggugaaaccccaucucuacuaaaaauacaaaaaauuagcccaguguggcggugugcgcauguagucccagcuacuugggaggcugaggcaggaaaauugcuugaacccgggagguggagguugcagugagccgagaucuugccacugcacuccagccugggugauagagcgagacuccgucucaaaaaaaaaaaaaaaaaaaguaaugcuacugugaaaauguuuauguacaaguuuuuagguagacagagguuuuauuuucucuugggaaaauacgcauguguggaauugcugaguagcagaaagugucuuacuuguagaaaguguaugacuuggccaggcgcgguggcuccuaccuguaauucuagcacuuugggagacugaggcagguggauugccugagcucaggagcucaagaccagccugggcaacaugguaaaaccccaucucuacuaaaauacaaaaaauuagccgggugugguggcaggugccuguagucccagcuacucaggaggcugaggcacgagaauuacuugaaugugggaggcagagguugcaguaagcugagaugacaccacugcacuccagccugggucacagagugagacucugucuccaaaaaaaaaaaaagugugugacucaucaccugccauacugaugccaugaagauuguacuguugaccauuucuaccaacaagguaugaggauuccagcugcucuggguucucuucagcacucagcguugccagucucucugauuucagggaguguaucucguuguguccuucucugcguuucccggaugccaguugcaguuguuuuccauguaugaagacuugcagcccagcguauggucuguuuuguugaacauuccgcgugcacuugagaaaaaugucuguucuguuguuggguagauuguucucuaaaugucacguaaguaaggugggugauagugcuguuuagguuucagcgauuuucucuuacuuguucuaucaguuccugaaacaggagugucgaaguuuucaaccgugucuccuuucauuucucucagcuucuucugugcuuauuuugaagcucuguagguugguguguauacuuacagaauuguuaagucuucaugaugaauugauccuuuuauuaucaugaaacauucuguuuaucucugaugguaaugcuuguucugacauuuacuuugucugauauuaacagagccacuccagcucuuuuaugauuugugauugguuggaauaucuuuuuccuuuugcuuacguuuaaccuagcuaugucuuuuuguuuguuuuuguuuuuuaagagacaggguuuugggccaggugcggugggcucacaccuguaaucccaucacuuugggaggccgagguggguggaucaccugaggucaggaguucgagaccagccuggccaacauggugaaaccccgucucuacuaaaaauacaaaaauuagccaggcguggugacgcgugccuguaauuccagcuacuugggaaucugagggaggagaauagccugaacccgggagguggagguugcagugagcugagaucacgccacugcacuccagccugggggacagagcaagacucugucucaaaaaaaaagaaaaaaaagagacggguuuugcucuguugcccaggcuggagugcaauaguaggaucauagcucauugccgccuugaaauucuggcuucaaaugauccucccaccuuggucucccaaagugcugggaaaacaggcaugagccaccacaccuggccggccucaaugucauguugauguucacuuuuacaguaaauguuuccuauguuuuucccuagaauggaugaugaacuuguuguuggacauagugcaagaucagacaucuccagcuucccuuguacaucuggcuuuuaaauuucuuuacaucaucaccaagguaacauuuccauagcacuucagaguugacagauacuuuuguaauauacuugguccagagguuacccuccaaaauguuauuucucaagaaagauaguucuuagacacaaguuguggguuuaauucugucccuuuuuacuguauguuggggaucagaauuuagugaugugggcucuuuggcugaaacagugucaggauauucagcaucuugcauuugaauagauugaagcacuguguagcuaggaagggaaugggguggagaugagacuaaaucagaaaaacuucuuacaaggagaaagcaggccgggugcgguggcucaugccuguaaucccagcacuuugggaggcugaggcagguggaucaccuguggucaggaguucgagaugagccuggccaacauggugaaaccccgucucuacuaaaaauacaaaaauuagcugggcuugguggcacaugacuguaaucccagcugcuugggaggcugaggcgggagaauggcuugaaccugagaggcagagguugcagugagccgagaucaugcuguugcacuccagccugagugacagagcgagacucuguggaaauggaagugcuucucacacuuuaaugugcagaugaauuuccugggaauuuugcugugcuauagauuuugagcaaguaggucuaggcgggggucucauagucugcuuuucuuacaagcuugcgggugucugugcucauagucugcuuuucuuacaagcuugcgggugucugugcucauagucugcuuuucuuacaagcuugcgggugucugugcucauagucugcuuuucuuacaagcuugcgggugucugugcucauagucugcuuuucuuacaagcuugcgggugucugugcucauagucugcuuuucuuacaagcuugcgggugucugugcucauagucugcuuuucuuacaagcuugcgggugucugugcucauagucugcuuuucuuacaagcuugcgggugucugcucauagucugcuuuucuuacaagcuugcgggugucugcucauagucugcuuuucuuacaagcuugcgggugucugugcucauagucugcuuuucuuacaagcuugcgggugucugcucauagucugcuuuucuuacaagcuugcgggugucugugcucauagucugcuuuucuuacaagcuugcgggugucugugcucauagucugcuuuucuuacaagcuugcgggugucugugcucauagucugcuuuucuuacaagcuugcgggugucugugcucauagucugcuuuucuuacaagcuugcgggugucugcucauagucugcuuuucuuacaagcuugcgggugucugugcucauagucugcuuuucuuacaagcuugcgggugucugugugcuggcccagaggcucacuguuggcaguuuugacuauggaaguacucacagccgucucaggguggggcuugggguucguaguggcgaggcgcauuucuguugucuggcgggaaaguccuuggccagcgagaggacacugcgggugagcugccaaggacacgcaggccucuguagcuccucuguuugagguuaggauuucuccggaaggcgugguaucacugagcuucagggaaguguuaaugaauuugggcccuugcgguuuguaggcacuuauuccucauaaaugucagaggacagucauauaaaugaacauauuuaaugacugauuccguaaauaugguaaugaauaacacuaccaauuuaggaaggaaaucuuuuuuuuugagagauggggucuugcucugucacucaggcuagagugcagugaugcagucagcucacugcagccucgaacucuuggucucaaaugauucucccuccugccucauccucucagacuacaggcaugugccaccauccugucuaauuuuuaauuuuuuauguugcccaggcuagucuccaacucuuggucucaagcuauucuuuugccucggccucccaaagugcugggauuacgggugugagccaucgcucuuggccauggguagcuuucuuggggugacuacggucuuacuaaauugugucacuguaaugucacagaauucucuuugaucagugggucgcguagcuggugauuuuugaugaaaggguagaaaggcaauuuugcugcucucuguauuuuuaaauguuauaauucagcaucucuuuauuugauagguucgaggcuauaaaacauuucuucguuuauuuccucaugaaguugccgauguagagccuguuuuagauuuggucacaauucagaaucccaaggaccaugaagugagugucucugccuccccccucgucuccagcccuccgugccuguccuuccucccugcuugccccacccugcugcaccuuccccuuccuguuucuuucauuuuaucucccuuuguuuugugucacuccucuuuucuuucuuuucuuuucacuuuuccuuuacuucuuguacaaguugcuuuaaauuauuuucguuuaaaauagccccuuuauaaaaaaaauuaugccuagguguaguuuaacaauaaauccgucauuguuucuauguuuuuuuaacuguguaaguauaacuguguuggguucccaagaccacccccagguuugauacuuccugagcgggacucacagcacucagcauagaguccuccuuuuggcugucacuuguuauggcaaaauaauacacagcaaaaucagcaaagggaaaaggcacauggguggggucuggggagaaccaggcgggagcucccgggguccuccaguugggucccacagggccugugucauucccccagcagugagaugugaccacaccugugaggugucuaucagagaagcacguuugagacuuggugcccagagcuuucacuggggucuggccacauggacaccucugccuggcacgaaacgaaauuccagacccccagcaggaaagcaggugccagcguaaagcacacgguuugugcagauugagccagcgagggaccucaucaggcagggcuuggugggaacccugcugguguccaggucccuggauaccagcccagggccggccucgucaggggccuugccucagacggcagcggggccugcuaugcucgcugucuucugcgugguauguauuuggaggagcacacgguuuauaaccgugcagugcgguggcuugucucggcguggaugugacugaugagcgcuguggggcauuucccugcugcccugcacuccgugcccuucuuucccuaguacuucuagcgccccccaguggaaugauugcagggacaaauugggauguuuuuuacuaauuacugaaaauaaggguacuccuuuuuuauuagaaguugauaauuguuuucuuuauucuuuuuuuuuuaaaaagacagaguuucacucuucuugcccagguuggagagcaauggcacaaucuuggcucacugcaaccucugucucccagguucaagcgauucuccugugucagccuccugaguagcugggauuacaggcaugugucaucacgccaggguaauuuuguauuuuuaguagaaacaggguuucuccauguuggucaggcugguuuaggacucuugaccucggccaggcacgguggcucgugccuguaaucccagcaguuugggaggccaaggugggcggaucacgaggucaggagaucgagaccauccuggcuaacacggugcaacccugugucuacaaaaaauacaaaaauuagccuagcaugguggcaaacgccuguagucccagcuacucagaaggcugaggcaggagaauggcgugaacccggaagguggagcuugcagugagcgagguugcgccacugcacuccagccugggcaacagagcgagacuccaucucaaaaaaaaaaaaaggaacuccugaccucaggugauccgcucgucucggccucccaaaguguugggauuacaggugugaaccaccacaccuggccuuuuuucuuuauucuuagguguuuuuacuuuuuaucuguuuuucacuuuuucaaaaggccaguuuguauguggagaggugccagcgaagagaagcugcuauacugauguauuaugauuuuucuuuguucauuuugaugucucucuugucugcugagcuaaguuacggcgguaggugugugugguggggauuccgggggggauguggcgaggaguuggugaacggcuugcauuucuggcccugagggugauggcauuugaauggcuuucauaggcauugggugggcauggagggcagugacuuugaguagauuguggccaguggccugugauuuucaagcaagacucauucuucccgugguuuaauuuuuuaggcuugggaaacccgcuacaugcuuuugcucuggcucuccgugaccugccugaucccuuuugauuuuucucgccuugacgggaaccuccucacccagccugggcaagcacgaauguccauaauggaccguauucuccaaauagcagagguaaauaucaugcagauaauuagcugcuaauuaguacucacuuucauguucaugcugucuugauguuagugguuuacucgguaagcuucugauauguauucaacugcuguuuuuuucagugggguaaaaucccauaggauaacuuauuuugaaauugugauaauucauguaggggucagguugaguuagcaaaucucauuucuuuguagaugaugcaaauacucuguugaggguaaucauggcagauaaggaaggguuuaguggcauggugagagagaauaaggacccauuuuacauuuaguucuuaacguuauauaaauaauagaugcucauuuguaggagaacuagaaaauaaagauaagcaagaaaaauacuaaauuuaaauuuaugaaauucuagugccaagagauaaguuguuuauuuucuccgaacuuuuccugauguaaauauuaugcauauaaacacagcuuauuguauuaguuaucuauuggaucauaacuaauuaccccaaacuugaguguuugacacacauuuauccucuuguaguuucugugggucgggagucuggcauggcugagcuggguccuuugugucaagcuugcccacagcugcaguuaaaacucgacaugggcaggcuuugccccaaggccguuggauugaggccacccucaguucuuugccaccugggccccuccaacuuagugacuuauuccaucaaagccugcaagggagaaacucugcuaaugagauggaagucaugauaauauguuaccugaucauggaagugacgucccauuccucugccagauccugugguuagcagcaagucaccgaguccagccuacgcaagcgagcacuaggaggcugucaggcucugagccaucucaguugucucggucuuccugccacgcugacugcgacagcccuggucagcauucacugagugccugcugugugccuggcaccguucaaacacucauagauuaaucuuuaaucacuuauggauuaauaauuuaaccuauacauugggcugggcauggugggucacuccuguaaucccagcacuuugggaggccggggcgggcagaucacgugagguuaggacuucgagaccagccuggccaacauggugaaacccugugucuacuaaaaauacaaaaauuagcugggccuggugacacauaccuguaaucccagcuacucaagaggcugaggcagaagaaucccuugaaccugggagguggagauuguagugaacugagauuacgccacugcacuccagccugggugacagagcgagaguccaucucaaaaaaaaaaaaaaaaaaauuuaaccuauacguugaugauugauagaucaucagugauuaauuaacugugauuaauaaucauugaauucuccuucaugaggcuguugacaauucuuacccucguuuaaccgagaaggcaacaggcauaaaaauuaauaacuuaguuuacuuugcucauaaaugguggauccauguuugaauccaggcgguuuaucuggagucugugcucuucaucagggcucagcauugccccaugaccugcuguucugaguccuuuuuacccucagcaacacguucuuagugucuuacgaugucagaaagugucccccucauaaucguuaagggaaaagguacuccauuguaaucuaauuuaaaauucucucugauagauggauguuuuguuuguucuuguuuuguuacguuagagguaguguggugaugggcugggugcgguggcucacgccuguaaucccagcacucugggaggccaaggugggcauaucaccugaggucaggaauucgagaccagccugaccaacauggagaaaccuugucucuacuaaaaauacaacauuagcugggcgugguggcacgugccuguagucccagcuacucaggaggcugaggcagaagaaucgcuugaaccugggaggcggagguuguggugagccgauaucacgccauugcacuccacccugggcaacaagagugaaacuccgucucaaaaaaaaaaaaaaaaaguaguaugguuuacccacccuuguuuacuugucuguggagagggacugccaggucaagggagcaugguuugucaagacuuggcacucugugauugccguuagaaagccugccccggaggccgggcacgguggcucacaccuguaaucccagcacuuugggaggccgaggcagguggaucacgaggucaggaguuuaagaccagccuggacaagauggugaaaccccaucucuacuaaaaauacaaaaauuagccgggaaugguggcuagugccugugauccuuucauauuuauucaacuguucucuuacaaaugaacagcuacuugggaggcugaggcagagaauugcuugaacccgggaagcagagguugcagugagccaagauugcaccacugcacucuagccugggcagcagagcaagacuccgucucaaaaaaaaaaaaaaaaaaaaaagccugccccagaaaaaaagaucuucuaaguguaucguuaugggaaaaaacaaacaaacaaacaaaaaaaaccgagacaagcauuggaaacauuuuaaggcagcccuccgaaaaauaaaucuagcugggcguggagguuucaugccuguaauuccagcacuuugggaggccagggugggaggauagcuugagcccaggaguuugagagcagccuagacaauauaaugugacucagucucuaccaaaaaauaaaagaaaauuagccagguguggugguacacaccuuuggucccagcuauucuggaggcugaggugggagggucaucugagcuggggagguuggugcugcagugaguuuuuuuuuuuuugagauggagucuugcccugucacccauucuggaguauaguggucuaaucucaacucacugcagccucugccuuugaggcucaagcaauccucccaccucagccuccugaguagcugggauuacaggcaugugccaucaugccuggccaauuuuugugucauuaguagagacgggguuuuaccauauugaccaggcuggucucaaacuccugaccucaggugauccgccugccccagccucucaaagugcugggauuacaggcgugagccgcagugcccagccuacagugagcuuugcucacaccacuguacuccagccugggugacagagcgagacccggucucaaaacaacagcaaaaaaacccuaagaccagcuacuggggaggcugaggcaggagaauggcgugaaccugggaggcggagcuugcagugagccgagaucgcgccacggcccuccagccugggcgacagagcaagacuccgucucaaaaaaaaaaaacaaaaacaaaaacaaaaaauauauacaccuacuauguaccccaaaaauuaaacacuaaaaauuaaaaauaacuagguauuuguaguaaaucuaggugcucuucaguuugaacagggccucuuaucuagucugaauacuccaauacugaugguucccuugugcuggaaggcauauuaggugcucaaugaauacucuugauucuuuguuacaauuggguaacuccuuuguuuacauucuccugcucuguucuugcaaauguguguuucaagggggugugaccaaaugcucuguguagcucaggcacuuccugggugaguguagcaguuggcagcuguagcccuuggcucagauugaagagagguuuuuuuuugcagcuuuggacuuaggccugugcugguaagguuugugaaccugggcccucggggagcuggugagggugggacuggugacugugugguguccccaaggcuggcgugugcaggagugaccgugucugugcuucacccuuucuugcaguccuacuugauugucagugacaaggcccgagaugcagcugcuguccuuguguccagguaaguuuccauggcacauuucuugguguguggcugguggguucugagagggguuuguuuggguacguguuucaugugcgucuucaguccucagacgaaggaccccgggaagucuuuggacucuguggcuuucucugagggagugugcagcaguguuugggcacagaagaccucugacccugaaaugaccacccucaguggugguuuggggugcuggugggggucaccugacaggcccaucgacaggagugcaggucuggaagaggcguggcugucaucccuggggugcagccccugcacagggaugggguggcaguuaugagaaacaucucgggccgucucccauggagaugaugggugguguugggccucugugacuggggaugaaaaucccccaacguccuguauuaacugcaccccccgugugccccagacaggggaaggugguuuucucugcugagcgcagcaggccugcgguguuggaaagauaccaaggauguguguauagacugagcgaaccuguuucaugagaugcaagaaggaagaaagcaauauuucuaaucaguauuuuacaugacaugugauuuuaaguauguauguaguuuacuaagucagaacaguugacauuuucccccucugcaauagugaaagucgaaagcugguccuaaaaccuuucggugguugugguugggaauacggucagugccucaugcagcgucaccuucacucggguguguagcugcaacuugcacagcuucuuucccagagaagugggaggagagaagcuuccuuuguggggcaguuggaggcauuggaugagggguuugugacagccuggagcugaggaaggaacgccugaguccccuggagcaggugaggccccucccgagagggcagaggcugcuuccugucuugucaaggacauaaaaagaugaucgucuaauuauuaaaguaaucuguauauauuuagauaauagagcaugaaguacaaaauaaaaccuuugaaugcuuucaucccaugggggugugauggccccugucucccuaccggguggcgccaacucuguccauggucuccccgcggggcggcaccaacucuguccauggcucaguugcugcacucaauucuuugcaccacggaccaggagaugggccuggugcgccauugucuucuuccaaaacgagaugaccuggugcgagagugucuuuucuuuuucuuucuuuuuuuuuuuuaauugagauggagucucacuuugucucccaggcuggagugcaguggcacgaucucggcucacugcaagcucugccucccgguuucacaccauucuccugccucagccucccgaguagcugggacuacaggugcccgccaccaugcucagcuaauuuuuuuuuguauuuucaguagagaugggguuucacuguguuagccaggauggucuccaucuccugaccucaugauccgcccaccucggccucccaaagugcugagauuacaggugugagccaccgcgccuggcccgagugugucuuuuuuuuuuuuuuuuaauuuuuuuaguauuuauugaucauucuuggguguuucucagagagggggauuuggcagggucauaggacaauaguggagggaaggucgcagauaaacaugugaacaaaggucucugguuuuccuaggcagaggacccugcggccuuccgcaguguuuuugucccuggguacuugagaucagggaguggugaugacucuuaaggagcaugcugccuucaagcaucuguuuaacaaagcacaucuugcaccgcccuuaauccauuuaccccugaguggacacagcacauguuucagagagcacggaguuggggguaagguuauagauuaacagcaucccaaggcagaagaauuuuucuuaguacagaacaaaaucgagucuccuaugucuacuucuuucuacacagacacaguaacaaacugaugucucuuucuuuuccccacauuucccccuuuucuauucgacaaaaccgccaucgucaucauggcccguucucaaugagcuguuggguacaccucccagacgggguggcagccgggcagaggggcuccucacuucccagacuuggcggccgggcagaggcaccccccaccucccagacggagcggcggccgggcgggggcugccccccacccgagugugucuaccugucguuuguggugggacauuuagacugcugcccucccaauuugguauuaaaacucaauauugcaaacaguccacguaaaauuguguaccguucugacugauuucuagggaugaguuucuacaaguggaacgcacguuuucagggucugaaugcaauuacuggagaggcugaacaaguuggaaguucuuuccccgucuuuuccaguugggucaaaccuuaagaauguuugccaacuucguucaaugggaaauaguaucugcuuuuauucuuacuuuucuuagcagcaguacugaggguugcguagauuuuugccgagcuuggcucuguggagugcggugccugugggccaggaggcaccaucugaguacuucucccuccgugggguccuccgggaaaagagcgcgcuggcucgggaucccgggcggacucccggcgagacaccgcagcgccaccuagugccgggaugagcaggugcuuuucggccgagccaguuuccgugcagaacaccugagccugggauccaggagagguggugccugggggcgucggugccguggagccuuucucccccuuggucucgcacacucucgcacacugauucucaagaguguuugagaauggcggaugccgucaguggaagagcucuuacaggugcuuggccgguucccucgacaccucccagacucaccgcagguucugaguuuccuguacuucucagaccccuuuuuggugaggauuguucagguaaggccagggcugcgagggguccugugccagcauuugucugcaguacagguucguuuucugcucuccagggaggagcagccugcucuagcccacuuugcucucaggauugaaugcuucucccuguaucacuggcggcucuacagcugcacccgucucccuugauuaacugagcuugccaacauccacagcgcuguagguggugcuugguguuacaguguugcuagaacaugcagauugagugcugccuuagaaacccacaggaaggggaacaucacacucuggggacuguugugggguggggggaggggggagggauagcauugggagauauaccuaaugcuagaugacgaguuagugggugcagcacaccagcauggcacauguauacguauguaacuaacuugcacaaugugcacauguacccuaaaacuuaaaguauaauaauaaaaaaauuaaaaaaaaaccccuuuaauagauaugccuuucgccaggcacgguggcucaugccuguaaucccagcacuuugggaggcugaggcggguggaucaccugaggucaggaguucaagaccagccuggccaacauggugaaacccugucuccacuaaaaauacaaaaaaauuagcugggcaugguggugcgugccucuaauuccagauacuugggaagcugaggcaggacaaucgcuugagcccaggaggcagagguugcagugagcagagaucgcaccauugcacuccagccugggcaacagagcaagacuccaucucaaaaaaaaaagagguacgcuguaugcagaaaaguuggaaaucuuggcguggcgugguggcacgcaccuguggucccagcuauuccgaaggcugggugggaggauugcuugagcccagaagguugagguuucagugagcugugauugcgccacugcauuccagccugcacaacagagcaagacccugucucaaaaaaaaguugaaaaucuugaaacauagaaguuggaaaaagauauauagguaauucuuauacacagugcguguaccguguuuaucuucuuugcaccguuaugacuuuuaaugugcacagcaugaucuuaacaagucagagucagcacugugcuuuuucaccugauuucauguaacugcugaugaauggcuccgucguguucugcuguguuucgauacugcacucagcucugucacuuccugccucuugugagcagucacggacgccuggguuugguuacagacccguucucgugucaggauuguuucgugaggaugggcccuuagagauggacuucuggguuccaggacacgagagugguguuggggucugcacaccugguggcucucagcugcucucugagcagugcuuugguggccgaggcagccccaggaacaccccacccccaaauuggauuaaacauggugucgcugauugcagguauuuaauuggcaucacgcugauugcccucaccuuagguguuacauacuccgcuucgugaccugacucugcgugucugugggcuccuuggggccuuuucuuccccacgagugugaguuuccuccggugaagggcgauggguauugccccaggugguuguuggccuuuuccuuuuuuuuuggaccaaaguuuuaauuuuaaugucaaaccguuuuuuucuccuuuauuuaguuauuuuuacuuuuaagccugcagucuuauuaagagauuuaacaaguagucauuuauauuuuucucuaccguuuauuaagacagaauuauugauucauuugggguuucuuuuggucuacaguagaaccccgcccuucccaguagguaaccaguugcuuuagugccauuuugugucuguagggaccagcaccacaaggucgguggguuucucccuguguguggagaugagagaguguagaaauaaagacacaagacaaagagauaaaagacagcugggcccgggggacaacuaccaccaaguugcagagaccgguagcggccccgaaugccaggcugcacugauauuauuggauacaagacaaaggggcaguguaaggaaugugagccaucuccaacgguagguaaggucucgugggucacguguccacuggacggggggcccuucccugccuggcagccgaggcagagagagagagaggagaaggagauaaacagcuuacauuauuauuucugcuuaucagagacuuuucacuaauuugcuacugcuaacuaaacggcagagccagguguacaggauggaacgugaaggcagacuaggagcgugaccacugaagcacagcaucacagggagacgguuaggccuccggauaacugcgggcgagccugacugaugucaggcccuccacaggagguggaggaguagagucuucucuaaacucccccggggaaagggagacucucuuucccgguccgcuaaguagcggguguuuuuccuugacacuaacgcuaccgcuagaccacgguccgcuugucaacaggcgucuucccagacgcuggcguuaccgcuagaccaaggagcccucugguggcccugucugggcauaacagaaggcucgcacucuugucuucuggucacaccucacuauguccccucagcuccuaucucuguauggccuggcuuuuccuagguuaugauuauagagcgaggauuauuauaauauuggaauaaagaauaauugcuaccaacuaaugauuaaugauauauauaaucauaucuaagaucuguaucugguauaacuauucuuguuuuauauuuuauuauauuggaacagcucguguccuuggucucuugccucggcaccuggguggcuugccgcccacaguauuccgcuuuuccauucauuucuaaugcucugugggaacucugugcguuuuaaagggaacacgguuugucaccaccuuaaugcugcuuccuucugcgaugaaguuaacugcccugggccccuuuugcagauccgcuaaaguuaacucuccuggggaggacacaugaguuucuuuuuucuuuccuuuucuuuucgagacagggucucacucuguugcccaggcgcgagugcaguggcgugaucacaguuuacugcaaccuccaucuccuaggcucaagcaauccucccaccuuagccuccccaguagcugggacugcaggcgcaugccacgacacccagccaauuucuuuuucuuuuuuuuuuuuugagacggagcuuugcucuuguugcccaggcuggagugcaguggcgugauuuuggcucuacuggagugcaauggcgugaucucagcuccacugaaccucugccucccugguucaagugauuauccugccucagccuccugaguagcuaggauuacaggugugcgccagcaccccuggcuaauuuuuguauuuuuaguagagacgggguuucaccauaguggccaggguggucucaaacuccugaccucaggugauccacccgucuugaccucccaaaguguugggauuacaggcaugagccacugcgcccggccaugccuggcuaauuuuuguauuauuuucuagagaugggguuuauuuauuuauuuauuuauuuauuuauuuuuacggggucuugcucuguugcuaggcuggagugcaauggugagaucucggcucacugcaaccuccgccuccugaguucaagugauucucaugccucagccucccgaguagcugggauuacaggaaugcgccaccaugcccagcuaauuuuuuaauauuuuuaguagagauggggugcaagacaggcuguucucgaacuucugacgucgugauucaccugccuuggccucccaaagugcugggauuacgggcuugagccacugcgccuggccaagaugggggucuuaccauguuuaccaggcuggucuugaacuccugaacucaagcuauucacccaccuccgccucccaaauugcugggauuacaggggugagccacugugcccagccaaaugauucuuuacuuucuggaaauagggacuucuuuccccauuguucaugcugagccccucccuaagcaugcuccacagggacaguggcggaggggagagguccuugcuguuacgagcaguuggcaggugccagccguccugucagcugggcagcgcuucuguuuugugagggccaugaccgaguaggauggcacgugcguggcugucuccuguguguuaagugcccugagagggcuuguccccacggaagcauggagccggcucucgcgcaggccaacuagauggaugugcuggaacaagggccgggaaggugggauggccggaguugaaguugcaguggagaugacgugggggccggagggagguugggcgucauagccuggcagcuccagcuuccacgucucaccuugccuggggucuccacguagcugucucgugggcgucgcguggggcacucccccacguggacucuuccgccuccuggcccucccaagugucccuuccgggagguggccuuguggcuguugagggagcgccuggugccucccuccuggcaucacugccgucuccuuccccccaccccauaaagguguggcuaggaugccagucagaccugccggcauggccuaaagaggaggugggcaggcuuggccaguacugguccuguccccagcaccucucccacucggcugcucugcuucgaccauguugccuuugcaguucgcgaguucccuuggcucccuucugcccugggcccuggcucuccugcuucccugggcagcagcacuuuccucccagguuuugcagccccccucguugagcuccguggcuuccguccucucucuaacgaggccaugcccucccguuuccuucguaacuuuucuuugcacuguggaaguccccagcuguuugucguuucucuccagagugucagcugugggagggaagggccuugucuguucuccguguggcagugccagucucgaucauggaggcaagcugggggccuggccuaugaacuccugguggagaaaucaggaggaucugggcuaauuagcugggcaugguggcgugcgcuuguagucccagcuacucgagaggcugaggcaggagaauugcuugaaccugggaggcagagguugcagugagucaagaucacaccacugcauuccagccugggugacagcacaagacuccaucucaaaaaaaaggaagacuugggcuuuuuuuuuuuuuuuuugagacagagucuuguucugucucucaggcuggagugcaguggcacaaucuuggcucacugcaaccuccgccucccggguucacgcgauucucuggccuuagccuccugaguagcugggauuacaggcgcacagcaccacacccggcuaauuuuuuguguauuuuuaauagcgacaggguuucacuauguuggccagacuggucucgaacuccugaccucgugauccgcccuccucguccuccaaagugcugggauuacaggcaugagccacugcgcccggccagauuugggcuuuugguuugggagcucugugugcucaagguguccugcgcugaggccgggcugcaagagggguggggagugugagcacugccuggaacacgaggccgaguccaacagggaagacuuucauggggcuacacgagcagcuggcuguggaaacaggccugugcacaagacgcauggcaggugugggggagggaggucccaggggcuggggcccagcugccggggccaggccuugcacgugggcacgguguccugaggucaagggaugcagaguuggguccagggaggagggaggggcugagaagugggcaggggcucccuggcggugauggggacagguaaaacuggggggguggagggggcaggcggggggggaugggcaguaggccugcgaccugagagguugugguggggaaccggcugcugagggcccuggucagggcagcgacuugguuucuaggguuggagagaggaggaacuagcuggaggaggacaggacucaguacagagcuggcaucuugguguaagggugcgugaggugggagggccuggggagguggguguguguggggugggcuggugaggcgugggcgaggucucagugcugaggccuugguugagcuguauccuuuuggcagauuuaucacacguccugaugucaagcaaagcaagauggcugaguuccuggacuggagccugugcaaucuggcccguuccuccuuccagaccaugcagggggucaucaccauggaugggacgcugcaggcccugguaagugcugcccgcaggggcuguggagaucgcagggaaauggcgccuuacauggggaccacggaaugauguuaccugugauuccaucuugacguaauuggaaccccgugggauugauuuaaccgggccagggucuugggcaguuuccuuuucccucugcuuuggguccugccucaggcagggcugguuucugcgcuggugcugguggaugggcuuggagccccaccuguugccagcagagggcaguggugccacgcagccggggcuccccaggguagguuucucugcaucugggcugcuuaguuccuguuuaagugcagagacugaacgagcucuaauaaaacaaggugggugaguugaaauuugauucuguuccuuugcacugggcucggguuggauguuccugacugcuucguugggacacagacccuggccucugccugcaggugccugguuagugcccuggcugcagcccuuugccagcccuuucccugcccuuucgcucugauugucucuuguguuaccuuuucuugugcuaacgaggaggaaaggucaagucucagaagagggcaaagccucuuuugggucagcguccuggaggcugcagcucccuggucagccuucuggagggggagccggcagccggcuguggccuuuggcgugguggguucagcgccuucuucucucuuuaauuacagcgggugaggcuuugagagcacuucucauccuugucucacgcuguggagccuguggucccucugaggagcggggcacuuuguucuuguuuaaaaaauauauuuuauagagacagggucuugcuauguaggucaggguggucuuaaacuccuggccucaagugauccuccugccuuugugaugaucccaaagugcugggauuacaggcuugagccgccgcgccuggaaggacacuuuggagcgcguuuuaggggagaugaugagugccaccucgccacggcguccuccuguccguggcgucguccuccuguccgcagcaucgucuuccuauccgcggcauugucuuccuauccgcggcguugucuuccugucuguggcgucguccugucugcgguggcgucguccugucugcgguggcguccuccuguccgcagaggcguccucauguccucaguguugucuuccuguccauggcguugucuuccugucugcggugucgucuuccuguccauggcggccuccuguccgcggugcccuccuguccaugguggccuccuguccgcugugcccuccuguccgcggcgucgucuuccugucugugguaucaucuuccugcccgcgguuuuguccuggccguggcagguucugccagggagcgggaggcugucagcuggguggaggggggcugugggagugauagccuggggugggggcauacguuucuugagggggaauugggaaguguccuccucaaugucugcugcuucccggucaugcugccguggucuucaggagggcagccuuugaaaugaggaaaagguuucagacgugugagagaaaacugcagacguguuuccuggagccugugcucugcccaggugaugucuguuuucuucaggcguccccucaaccuccacauaaaugugacagauucagcaguuuucaaaaaucaagauauaauucacauaccacaaguaauuuauccuucuaagguaaacaauucuguaguuuucugugcggucaucaccauuaucuaacuucaggacacugucaucaucgugagagaaaccuugauugcaccgagcaguccgucccucaccuuccccagccccugcagccguggauccaugugcugucccuguggacuugcugguugcggacaucucaccucaccagagucguacacgacacagccuuuugcgucuggccuucacugagcccgauguguccaagguucaucugcgcugugguguugucagugccucguucccuuuauggccgaaucauaagccaacguguggguauuuuccauaugccagcguguggguauuuuccauaugccaguguguggguauuuucugcucuuacaaauuacgcugugaagaacuuucaugugcaaguuuuuguuuaaacuuaaugcuuucaggccgggcgcgguggcucaugccuauaaucccagcacuuugggaggccgaggcaggcagauuacuugaggucgggaguucgagaccagccuggucaacguggugaaaccccaucucuacuaaaaaugcaaaaaauagccaggcauaguggcgugggccuguaaucccagcuacuccggaggcugaggcaggagaauugcuugaaccugggaggcggagguugagugagccgagaucaugccacugcaccccagccuaggugacagagcaagacucugccagaaaaaaaaaacagaaaaaacaaacccaacuuaauacuuucaguacccuuggguacacaacacuaguuuuuaauaaaauuuuaaacaaaauuuggaauguuuucaucuuucuggagucuuucuaaaaagauuuuucugguggcauaccugucguacugaugaaauagaggaccuccucaugccaggcauuuuugggcauugcagguacagaugugcugucuguguccccaggugccccucguuccggccgugcuggggcagcauccucaaugccuaaagaggauucauugcuaucguggaggucagggcaggcugaggcuggccuugaaggguacggggguggagggguagggcagggaggacucaggucucggacguacccacugugccauugguccauggauccucagggaaugugcguuuuauguuuuaggcaauucugguaaaggugguggauuuaguugcaauuggauucuucauuuuuugccuugggucucacugaggaaacaugaagaagggguagauggcaguggccaggguggggguccugggaauucugguagcuucaccuuaauguuugugaugcuggguguacagacagccucccacaugaccaaggacacgcucuuaggucccuaagaccccagaagaaugggccgcuacugccaagaaguaugacaugcguguggaagaccaugagccuuacccggcugguggcaugggguguggcaacugccgcagcuccccgaaccauugcagugggaaagggguacgugcugugacuaagaccacuggacccgacccaucgcagcgacaggggguccaugcugugugacugagaccacuggaccccacccaucgcagcgggagggggguccaugcugugugacugggaccacuggaucccacccaucgcagcgacaggggguccaugcugugugacugagaccacuggaccccacccaucgcagcgggagggggguccaugcugugugacugggaccacuggaccccacccaucgcagcgggagggggguccaugcugugugacugggaccacuggaucccacccaucgcagcgacaggggguccaugcugugugacugagaccacuggaucccacccaucgcagcgggagggggguccaugcugugugacugggaccacuggacccgacccaucgcagcgggagggggguccaugcugugugacugggaccacuggaucccacccaucgcagcgggagggggguccaugcugugugacugggaccacuggacccgacccaucgcagcgggagggggguccaugcugugugacugggaccacuggacccgacccaucgcagcgggagggggguccaugcugugugacugggaccacuggaucccacccaucgcagcgggaggggcguccaugcugugugacugggaccacuggacccgacccaucgcagcgggagggggguccaugcugugugacugggaccacuggacccgacccaucgcagcgggagggggguccaugcugugugacugggaccacuggaucccacccaucgcagcgggagggggguccaugaugugugacugggaccacuggaucccguccaucgcagcgggagggggguccaugcugugugacugggaccacuggaucccgcccaucgcagcgggagggggguccaugcugugugacugggaccacuggacccgacccaucgcagcgggagggggguccaugcugugugacugggaccacuggacccgacccaucgcagugggaggggguccaugcugugacugggaccaccuggccugagguuggacuggugaaaugacaauguuggcaccuacaugugugucaggauccauguggauaugucccgcacaccugcuucuuggaauauuguguaagcagcucuucagcuucacggccuucaugaucguguucuggguggggaagaauuaaccagccuaccagcccguggggccaaagcaguguccuuauaaucaucugcaccuggaaccagguggcgaucccaccguagaaccuguggcucacaggaucugagguggcuucgagggcuucucugcccucuaggauucccucauccuuagaaauuuaaccuuaaugaaaucccuaauaaaacucagugcugugggggaaaaacaucucaggucaggggagcaaaugggaggucuaacaggaugugaccagagcugguugucuccaauggcucugccccgaguguggugccucugcaggggaggccguuagcccugccccgagugugggugcugcuuugggaggggaggcaaauuugaucucuguccggucucuuaacgggcuucuaggggucuccugcagcucucgucagccuggccugggagccuccccuccucugccguccccaccccaugcuguugggucagcaggauaucccagccuuggggcuggagccagcuguggcugcccagggacuugcaggcaggugaggcgugccaccuucuggccaggcuggcugugggagaggcagccuccuggugaggggcugugggccacugcguucaggcugccuuggagggcuccacgguguccccugggugcagggcuccgaguccuucucggcuugggagggucuuguggccacaugugucuaguucugcaguuucuuuguuguggguucgguucuuuacuuuuuuuuuuuuuuuuuuugaugaucuuguugguuuucucuagauuguucccaaguuuucuguucuuccaucccaagugggagacacguguugcacagccugcauuuggaauacccagagggugggugggcgggacggcucgcugccccauuccccuccuagcugcugggacaggugggaauuccuguagcaaagucaaaccagccaggaguggggaagugcuuuuuauuuugacaucuccaaguuccacguugagguggagagacauucguuuuuccccuuccucccgagguguaaaacggucuucucaaaggcuuaggagagccgagcccugugccaccccccggcauaugcuggcaaagagugaggcgugcuguccugccguuuagggcagagcacccaggcgguuuggcagcagcaccucagaacuauucagagauuugcccucagcaagagugagcaauugucugacgcagccggcugaaaucccugggaagggaaugaaugaaacugccgugaagcaacgccuggcggggccgggcuucuggcagcuccuggggccagcacgucccuuccagagcgucugaagcccugggcggcugcuggagcaucucgagucuuuccagagucauguguguuguuuccuucugucucuuggaaggguccguuuggucugauccagguugccucagcaggaggaagucgugcugggugcugagcgggugggagguuucaccuugggcuuggcagagcugcaggcagaggccgggcgccugcuguacaugaugaaacuugcagguggauucugcuuaggguuucaucuguuuccuuugaugcacuuggcuucauugucauccaccuguucauuacugugggcgaaacaggugaacucucaacaaguaccaucgaaaccaggauuugaucuucauuucccucgaagcguaguucccuugcagugaggguuuuuaacuccugugggagggaagcaaguguuuggcaauguaauuucccuggaaggccccuguacuucagcuuuaaaaacacgcuuugguuuagucccaauuuaagcauuaagauuaaugcaaauugaggaaauucaaggaaggagaaaaacacauuaaaaauggaaaaugggcugggcacaguggcucaugccgguaaucccagcgcuuugggaggccgaggcagguggaucacuugaggccaggaguuugauaccagccuggccaacauggugaaacccugucucuacuaaaaauacaaaaaauuaguugggcaugguggugcgcgccuguaaucccagcuacuugggaggcugaggcaggaaaaucgcuugaacccgggagguggagguugcagugagccgacauggcgccacugcauuccagccugggcaacagagcaagacuccaucuaaaaaaaaauuuacaaaaaggaaaauggcugucauuucaugugugacucugcuugcugauugauaguugugcucucuugguuucuagugcucugauuggaagauugucgacuguguggaguggguuucucccuguguguucucacaauggcugggaggcggcggcggggcugggggacucggacugcgagacggggcuguugacuaugaaagugguaauaggaugcucuuccccuuaucggcuguuaggcucgagucuccccuuugcagugcgguuucuuuuuauuuuuaucauugacaaaagcacaacucuuguuaaaggauaaaauagucacacacaacagcauuaaaaaccaagaaagccaaagaacgcuggcacugucagccucacucccagcucccgcucggcccuugugaagagaggugcugaagccacucugcuuuuuuauaguuaauaaaagcagccagguccccaaguaggagugguuguggccaagagugugugggccgggaaccagggcuugagcugcugugagcugugcccaggcccuuugcugacuccgucucuccugugaccugaggccagggugagcaccagcgcccgccccaccugggagggaagcagcagaccucucaccgcagaggcuggugugaggcuaauuagcacagucagucuuugaagaugaaagaagacagcugauuaucuaaaacauuucacauuuaggcuuugauuucucuucagauuuggggaacagcacccuacuguuucauuuaggguucaguguggccagaggaagaugacccacgugguccuuuuuaguuguagugcucucuuggggcaagguuuuggauggagaaaauaggacaagagcaguuugaauguggguacuuuccagagaucaugcuccuguagcauuugggugaaacgagguaccccaggccacgcugguucggucuccucguggcguuaaggaaagaccuggagcagccagcuccuaacacucauuucccaucacucagcauuuuauguggggcgggcacagugccgugagucuuacagaaaccugcauggugagccgcacgccuuugaguccccaucagcccuggcccaucccugcugagguggcgcgaccugcucacagacgugugcucacaggcagcccgucgcggggucaugugcuagacggggagggggcuuggcgggucaccagccucaccccgcucaguucuuagaugaggaagagacaggcagagagcugggcugggcugcugcugagugggcuagagcugggucucaguggccccugccccagucguccugaccuguggccccugugcagguuggggugccccugcccucuccccugccccgcccucaccuggcucacagacccgugaugccucacugcccacgcagucaccuuagaggcaccuucccucuaaggcagaugucccucaggcuuugguccuggcuguugauaucucagcucugauucacccuugaccuuuauuaccugauuucuguccuugguucucgagcccuccuucuguggacccguuggguacacgugugacacuucagaacccgcaagucccaggucacaccuguuguaccaucacuuuccccuccuggccuguuuacccgggagcccagcaacaaaugggagcuucugugcugcuguccgugcauacggcccaggagccgggcucauccccgagacgccguguucccucccgcuguccgcucacaccugccuguguggacguggcucugacaugucuccuuccugguucauugcucaucuguucucauguggcugcgccgccacccuguccuggggguccuugucccagcacguggcucugugcuucacgucauccugagucugucccgcucugccgccugguccaggugggagccauuuccuucugugaaguguucccucuggaggcccugggcuccccgacuacccucccgccucuccuguggcugucggcugcaguaaaggugcugguggagggugugagccauccauucauagagugccagacucugucccaugcugccucugugcccuugauccuggcagcacaccugcuguccuguggccugcguaaaggguggccucggaagccuguggccuggguaaagcguggccucggaagcuuguggccuggguaguggguggccucaucuuggccucggaagcaggagggcucaggcuguggcccacgccugggguuccccauccccccguguguccuggugucuuugcuuggcucgccggccuccaugggcuccccagguggcagguggcucucagccaugcucuccguccucaugcuuguuucugcccuggcagagcugcucaguggccagcccgugggaccccugugcacccugccgcccccagcauaugucagcagcgccguccgggggagauguggcaucagcacagccuuguccuugucucugcccguucuuccuuccuugccucuaugugucugcuuuuuucucuuccacaugguguccacaguggauaaccacauccacuggccuccugguugguggauccuccuccugcugggcucagagcugugccacccccaccugcacugcagagaagcucagaccccucucugaccucagacgcuggagccugagcccccugcuucccaggccaaugccccuucaggucccugcaaagccacugcucuuuguggucucccugccgccguugcccucccuuugccgcugagcccgugggcugcuugguggcuugggagcugcauacaauucuauuuugucugguuuguuuucaggcuuucuguggcaggaauugugucucuugcaucuuuuuuuuuuuuuuuuuuuagacggagucucgcucuguugcccuggcuggagugcaguggcgcgaucucggcucacugcaagcuccgccucccggguucacgccauucuccuggcucagccuccugaguagcugggacuacaggcacccuccaccacgccuggcuaauuuuuuuguauuuuaguagagaugggguuucaccguguuagccaggauggucucgaucuccugaccucgugaucugccugccucggccucccaaagugcugggauuacaggcgugaaccacugugcccggccauggaucauuaaccucuuuucuagcaucuuaccucuguggugguucacuuuugcgagcuuuugcugggccuuggaaggugcgugggcucgcugcuccucucuucugugggaacuguugccuuugggcagggggcacaccccagagguggucacacacaccugaacgggagcacagucauaagucccugucaugcaaagaugggcugugcagaaugagcucggaauagcagccagaaggcucagugaugggggaguuguuuaagcuggaauacuguaaugcugcuggcuguuuauggcugugaggucacuacgugggcugcugagaacauuuuaaaaugcugagugagucaugaaacagucaugcguccccuaacaaugaggguaguccugagaacugcgucguugggcagugucgucgugugaacaccguagcgugcacuuaaacauagaugguguggccugcugcucccaggccagguggugcggccugcugcacucccaggccaggugguguggcccgcugcucccaggcugcaaaccuguacagcaccugacugugcugaauacugcagggaacuguaacacagugguguuugcacaucuaagcauagaaaagguacaguaaaaauauaucaucagcugggcacgguggaucacgccuguaaucccagcacuuugggaggccgaggcggguggaucacgaggucaagagaucgagaccauccuggcuaaaauggugaaaccccaucucuacuaaaaauacaaaaauuagccgggcgugguggcgggcgccuguagucccagcgacucgggaagccgaggcaggagaaucgcucgaacccaggaggcagagguugcagugagccgagauugugucacugcauuccagccugggugacagagcgagacuccgucuccaaaaaaaaaaaaaaaauuauauguauauacacacguguauacaugugugcacacacacacacacauauauguguauauauauguauauauaaaauccuuuuaugggcucacuaucaauaugugguuccucauugaccagaauguucuaugauguaggacucuagugcgauacacugucaugaacagauugauaaauuaggugaaggaugaugccugugaaugacagacguaggaagccacaaucauuuuguguuuuccacacucucuuugagagcuguguugccuugguuuauggaugaggacauggacccaggucaggggcugccaggucggugcugggguguggagcugggccuugcauggcccccaccugugaagguaauuaguguuuaccuuacaguccaaaguuuggugaaaaauaacacuucguucuggaaagauaaaagcuagaugugauuauuucgaucauugaagcauuuuugugugaaauuaccuuuuuuuuuggcgucaguggcaugaucucagcucacugcaaccuccaccucccgggcugaagucauccuccccccucagccuccugaguagcugggauuacagguggacgccaccacaccuggcuaauuuuuguacuuuuaguagagaugaggucuugccauguuguccgggcuggucugggacucuuaggcucaaguaacccuccugccuuggccucccaaagcgcucggauucuaggugugagccacuacacccagccugaaauuaguuuucauuuugauauuuguuuucuuaaaauucuuuauaauuugucagaaauuuauuuugucagaaacaguauauuuuuucacucuggggcucugauucuaaucagucauuuaccaauccagcaaugaaaguuuucacuuccgucaauggcuuuuuuccucugaauguguggugguccugaggggagugcauuuugcucgcuccugggggaggcaguggucuggccuguccccaccagugcccccuaggccccgccuugaggacaagcucucuucuguuucugagcgcucucccguccugucuagggcaacugcugcucuuucuaggggugguaguggggcucuuuaagaugucccucgcuuugauuuuugcaggccagcaaaugcacuggacguugugguuuuucuggccuccaguagugguguggugggaagguucuuuuccugcccugcugcugaggggagccucgagcguaccagaguuccucagugaagccuuugcacguccugcagggugcagcccagcauggguuucacugcccuccaggaaaggccuggcccuggugggcucgcugcagcacaggcacggaccuggggcugugcucucaaggcauuccagccuggaaaggguuguuuugguguuaaagauccucuuccgugccuguccuguggccccucuguguggcaugcccaagaguggcuuugaacauggcugcccuccgugugcugagccugcgggggcacggcuacccuccgugugcugagccugcgggggcacggaugcgauugguugcuucccaagauaccauuucuuggugucggagcaggacucgggauggcagaaaggggaacagacucgcucuccucaucugcagagucggcaugguuauguggggccacagggugacccgcuggccuggagcuagcguggucucagccaucugccucagugccggccggcacucacagcuucucagaagccuguguuaccagccagagccaagccugaacugguguggugugggggcccuucucccagggccucggguggaguugcuuuucuuggccuagauuuggcagugccugaagggagccucaaaccagcaucuccugcuuggcagcgggugagcuugcucccgaguagcucgacagccugugauuuacugggcuuggagaacaugccccaggggggggaagcuggcucgcacguugcagagaagccagcuuggguggguagccaucgaaagguggggcggguuaggaugauugcugagaaacuccuuuuguuugcagcuugugcugugcugguuucuagaacaacaaaaacagaccugcagucauuccucauuuaccaugcagggcuguuuuccucuaaucccuggugucaucaccucugucuaguguaugcuuuucagcaggugguuuuaauuugguucccauuaugcuuccaugaaagugggcugugccccccauuuuauggccuagcuuaugagcacucaagaccauugaugacuagagugcgcucucucuggccgcguccuccugcugacagguaccccaucccaccgccacgcugagcacuggccacugcacacugcacacuuucucuggugaagauggccuuacuuuucagugaaauaaauggaaacaaagcccugucuucauugacucguuccuucccugucgucucuuuugcccuccugcacccaugccugggaaaguggauaacuuuuggggcuuuucucugugugugcugaaugcccaggaggcugccuguguaauucagcuggaaacuguccccaggguagagagaagugugaggagaaaaagacccuucgcccuguaaaugugugggguucugguuucucccuuacugcagaugguggcgggcccuggccuuggugcugucuccuguguguagcuggggacgguggaagcugggcugggccuuuccagguguggggcauccaggccaguuacaagagaugaugcuugcuuucccgagaacucaucaccacuuguaucuuagucugcuguagagaauguuguacuacacuucauaggaauugaguaacuaaacaacguucaugugugagggcacucuaggaauuucacagugucuuggauucuuuuuauuuagugagagaaaccagacgacguguuagcccguugccaaguaagacugggggacacgucagccuguugccgagagagaccaggggacauguuagcccguugcugagagagaccgggggacacgauagccuguugcugagagagaccggggaacacgguagccuguugcugagagaggucauuucccggaucuuuguccugcguccgcccacagcugcacagcugcucuucugguuuagguucuggccuuucccacugggguuuuccagcagccucuguagcggucuucguuguugagcacuucacuguucauccccagguucuccauccagcugcuguuggaaucuggucauguggccauggcugcaggugauacgguggugcucuuugccuguaggaugagauuucagccgcucgcagguucauuuguuguggaacaacguacuccacagcugguggcaucagugacagccgcacucuugcguggaucgauucuguggccucgcaggguggggugcagggggccguuuguuacugcccuuugaugccugggccucugccgagaagaccacguggcaggugccuugaagggcugggugcggcaggggcccuugacugaagcuggcucuuccugcauggcagccggcuucccggagggagugucucaaggggaggugucuggagaggcccugaaagaggccgccaggcuucugaccugggauugggggucacuggcaucacuccugccugccucuguugguuguggcaguuggaagccuaccaagguggugggugagggacccuugauuguccgucuggcaaacucuguuccccacugagcuggccagccggcugcagugacagcuucucugugaagugucuugucuucuuaucccccaggcgcgguccggcuucucguugcacacuggugggcuucaggccgucagcccaccucccagggaauuugagugugugcuuggcccugcgacugcccccgaaccccgcgucccguugcggggagcucgccugugccccacgguuucugcucagcaaguguuggcucuguaaaccgaugacuuaggguuaaaacacauauuaaauuagauacaucuggacuggugugaaauaauuuaacuuucgauuuuauauuucacacaaacuaaagauggggaagaguucuuaaaguuaaaugagaacuuguuuugggcaaacaaggaucaucuccauucacuugguagggaacguguuacuauccauuucgcuaaagagaaaggggcuaagucucugaucaccuuggugaauguguuauucugaguggcucagggaggugggugcugccacugccccauuuuacagacagaggaacaggagcgcagagacccugcucugcuccacaggcgugacugguggucugucuggcugucuccuuccuguuuugaucguaggugugggaucugcaccacaggugugacugguggucugugugccuuugcugcuucuccacucagcgcuuaggagagccccccagcgggcuccauggagagagucuaaguucccucuccuuuuaagaagauguuucuauucuacacuuaaguaagagaucaggcaguuuacaggguucauaaugcaaauaaaagacaccaguauuuagugaaagccucuucaccuugucugagcaucuccugaugggcggcaccugcuucuucauuuuuccguguggugggcgacagcaggacagggguggcguggugugcggugcagauagucugagacagaugcaguucucaccuugacugugaaauucuguuuucugaaggaaaggaaauucauucgcguuuucuuagaagggcucaguucuaggauucuucgauuaugaggcuuggauauuuaugugaaucaucgcauuuguccuccagacuuuaaagcagaagguaaaaccucagguugagaauucaggagggcuagaaccaguguuugagagaaaaucugauauuccuguuuggucugauggacuccaggugaugacguccgugugugcgcaucguggggaccgggcugccaggugugugugugagacacgggcugagcuggucacccuucucauuuguuggugaagcaugaaugcagauggaggccuuugugugaggugguuuggccuguaacuuuuauccuuuguaacuuuauuuauacgcagauaauuuuuaaaaaccuacugagauaucuucuuuuuccaggcuaguagugcccugaacuuaaaccugggcacguuuugugaugccauugaugagggagggguggagaggcugcagucuccaugaggggacuggacuuaucauugcaucccuauuuucagaugaauuuuugggagaugauuucacuagucucuuauaauuacuuuaucauguacagaaacuguuuucuuuauuauuagguggugaguguuuagaauaaaaauucugaaagaugugaugaauuguuuucacaauuuguguguauguuuuaaacuucuauuuguauuuguaacauuaaaaaucuuuuuuuuuuuuuuuaggcacaaauauuuaaacauggaaaacgugaagacuguuugcccuaugguaagguuuauuuuuaagagacgauaucuuugugaugugaguuugcucauauacaaucaagugucuuuccuuaacauuuuauucauagauauaggaacuguacauugguauguuuggacacuaucguucuuuuuuuuguuguggguuuuaguaacugaacuuuuuuuuuuuuuuuuuuuuuuuuuuuuuuuugagacugagucucccucuguugcccaggcuggauugcaguggcacaaucuuggcucacugcagccuccgcguccuggguucaagcaauucuucugccucagccucccgaguagcugggacuacaggugccugccaccaugcccagcuaauuuuuguauuuuuuuuuuuuugagauggauuuucucucugucgcccaggcuggagugcaguggcacuaucucagcucacugcaaacuccgccuccuggauucacgccauucuccugcaucaaccucccgaguagcugggacuacaggugccugccacaaugcccagcuaauuuuuuguauuuuuaguagagaugggguuucaccguguuagccaggauggucucgaucuccugaccuugagauccaccugccucggcuucccaaagugcugggauuacaggugugagccaccgugcccggccuaauuuuuguauuuuuaauagagaugggguuucaccauguuggccaggcuagucuugaacugcugaccuagugaucugccugccucggccucccaaagugcugggauuacaggcguaauaacuggacuuuuugucacuuuccuaguccuuugauaaagagggauugcugccaggggucucgugagggaggucugggcaaagcccgugucaugaucugagguuggaccuggcuucuuggggcccaggagcagccauguuccucugauagccacagccaccaccucuuuugccuucuuccuaauucucuuaauuuauucuuuuugagacugcaucuuacugugucgcccaggcuggaauacaugacacagcucacugcagcuucgaccuccugggcucaagccauccucccaccucagcccccugaguggcugggacuacaggcgagcucuaccacgcccggcuaauuuuuuuagcaguggggucuugcugugcuguccaggcuggucuugaacuccugggcucaagugaucugcccugccuuggccucccaaagugcugggcuuaaagguaugagccaccacgccuggcucaauucucuuaauuuuagauugagccucaauuucugaaaauaagggcaguguuuuucuccacgcagagguuuaccaucuggaaaaagagaaacuucuuagagccuuuguguguuuuagaagcuauccggacugggcguuguggcucacgccuguaaucccagcgcuuugggaggcugaggcggguggaucacgaggucaggagaucgagaccagccuggccaacauagugaaaccccaucucuacuaaaaauacaaaaauuagcugggcaugguggcacaugccuguaaucccagcuacucgggaggcggaggcaggagaaucccuugagccagggaguuggagguugcagugagcugagaucgcgccacagcacucuagccuggcgacagagcaagacucugucucaaaaaaaaaaaaaaaaaaaaaagaaacuauccgaauaucaaauuugaauaacuuucuuuuuuugaaaguuuuucauuauggaaaauuugaaacauguauaaagaagagagaauggcgugcacgccccgugucucucucaggagugugcgaguuuucgugugcagccuguuucaucccugcaccgcacaggagggacacacagugccaucucaccuguguguacuuccauacaugucucuggaagguggggcucuuuauguccucaccacacccgagaacgcgagcagccguugccaggcccugucggcgggaggagcguccuuggugacgugaacacagaccucccucuugggcugucgugcuugucacccacgcucauugugcccacugucagagccuucugagaaguuacucagaugcucuuucagcugaccugguuuuauaggcaagcauuaugaguuaaacggcaccucugcccgaggucacggcacccacauaaaacuggugaacguucacuuucugucauuucccagccucaaggcagagcuuccugcagggcacugcagcuccagcccccaucccccugcucuguccccgccccacugccccuuccuccaucuccuugucuuccaucaccucaccuaacucucagcucugucuucagcuucucuucuuuucuccuguccccugucaguugguugcagucuuguccauuucacuuccagcccaucucugaagccgccaugcacuuccaccccagcccuugucugucccgggaaugcuguccuccuggccucagcuugcccucgucgcagcacccgggcgucuccugcucgcaggcucucccugucgugcugugcccagugcuaccuugagccuccccuuggcucagccuccuguccugcuauugucaucacugcaugacaccgagugauucccccugaaaaacagagcaagccacaggaaccccguggccuguguguucuccccagccgcagugugcuccauggcuucugggguugcugcagugugcccuguggccuguguguucuccccggccacagcaugcccguggccugcguggucucuguggccgcaggaugcccguggccuguggggucuccguggcugcagugugccuguggucgguugggccuuugugugugcugccccccuucagauuggcucccugcccucugaguacuugcucuccugaccuccacugauguugcuucacagcaaggaagucgaguagguucaacuccagcagcucuugguucaugauuugggaugaugggggucuuggugaugucuccugccucaaggccccuguggagccggcuguugguuucggggacacagguggugcagucagaagaugccugcagcccuuccugcgcugaguccaguucuuguuugcagcugccacuguccucaggugccucgauggcugcagacucccugagagcaaccagacccugcugcggaagcugggggugaagcuugugcagcgacuggggcugacauuccugaagccgaagguggcagcauggagguaggcaccaugagggcggugccuggggagggccacgggguggggagggguugcuguggggggcaggcgccauugaugagggcggggcaggugcuguuggggcaggugcuguggggaggcagucgcccuguugcggggugggggaggcaggcgccaugggguggggaggcaggcgccuugguucuggacacaguugggggcacucucuggagggcaggccgagccguaggugagcgucugguguggcuggugcuguggcuuuuguguccaguggugauggcagagaagauguguuaguaacaaguguuuucugcuuucauucauuucuuuaauccuagaaguguuucugauuuugagaggaaugguuuucuuuugguuauuuucugacugcaucucccaguuggaagaacugcagcuggcguuggcaggaagguggcgugugcgucguguggcucggagucagcguggcaggauggcggcgugugugucguguggcucggagucagcguggcaggauggcggcaugugugucgucguguggcucagggucagcguggcaggaggcuggcgugugcgucguguggcucggucagcguggcaggaggguggcgugugcgucguguggcucagagucagcguggcaggagggcggcgugugcguugugugggucggagucagcguggcaggagggcggcgugugcguuguguggcucggagucagcguggcaggagggugacgugugcgugaucguguggcucagggucagcguggcaggagggcggcgugugcaucgucguguggcucggagucagcguggcaggagggcggcgugugcgucgugugguucggagucagcguggcaggagggcgucgugugcgucgugugguucggagucagcguggcaggagggcggcgugugugucgucguguggcucggagucagcguggcagcaggguggcaugugugucguguggcucggggucagcucagccucccuggcguggcagcgugugugcgucguguugcucagaggcggugcggccucccugguguggacgcgcugugggggaaagcugcaucggaucagugaugagucugaaugacaggcucccuuucaaagacuguuggagaaagugaaaccgccuuucuugcuggcagaaaugaugucuuagcagucuguagcggccggugugaacggguugguucucaaggagacagacuuuucuaguguucuuagggugcuguguguuagcgaccuucaguuuguuucaagugcuauaauacgugugguuugggaaggaauuacuugguuaaggucagcucacacuccguccuggaugauggcaaauuccagagacgcguguuguguugcaguguugggugugcagcucacucuguaggaaguugcucauuaggcacaguguucguggcuaguuucucaaagcugcuguggggaauguucagugcuguaccaggcaggguucuccagagaagcagagcccauaggaugugugugugucggcgaggcugugagcuggagaccaggagagcucauggugguucuuggccaaaggccucaggguggagacccaggaagagcugauugguuuuagucugaagacagaacaaguccaguugagagauugccaggcaggagggcuuccccccuccucagggagggccggcguuuuguucugcuggggccuuccgcuggcugaacgaggcccccugcauuuggcaggguccucugccugacuuugucuacagauucacaugcugguccagagccccugacacaagcacuggaagcaggugugaugaaauagcggggcgccccacggcgcagucagguugccauguaaaguuaagcaucacaagcacugaaauguugguacagaaaauaauccaguauccuaguucucucgauaaugaugugcguguugccacauacacuucacguaauucuaacgugguuggguuuuaguccccgucuuguguuuuucucuuccgucuuucucuacguuuccuguauuucuaacuuuuuuccauuuuuaucuccucgguuggauuuucguugucucuguuaguaccguucucuucuugguugucuucuguugaugaggacggacuuacgcucugacgggcuguuagauuucugguucaucccacuccuccugccagccuuggcucgaggcuuuguuagggugggucuuucucagcucuuuuccuccagggauuggucuuuccuccacagcaugguccuugcuuuaaguauguagccuuucagggacuuaggugaaagucacggcuuucucucccguccugcugggcccgggucuccggggcccucugaggguugcacagucuccaaguucucugcggcacucggccucccagccauucucugacaggugcgucugagucucgccuugugcuuccuuaucuuggagugcccagggauccaagggaauuuuugggcagaguuuugggccucugucucagcagcucucuucuccccaacauccucucccccacauaugagcccuccacucauugagauugcugcuuccugggcuguuuccuugguacgguguagaaaguaccccugcggggaggagguggagguggcccaccugcagcuuccccucgcuggggauuguugcccugccuugguugccaucaccugcuggccaacaguggcuuuaagucuuccguccgagucucaccauuguugaggucgggagggcauguguagaagcagccugaggucauugucuuuguggugccgucuggucuuugugagguggcugagcugcgcgcuugcgugaggagaauggcggcuggggugcaccggucuguggggcguuaggggagacugggggcuggggugugccagccaugggccauuaggggagacugggggcugaggugcaccugcccgugggacguuaggggagacugggggcuggggugugccugccuguggggcguuaggggagagugggggccggggugcaccugccuguggggcguuagcggggagugggggccggggugcaccugccuguagaguuuaggggagagugggggcuggggugcaccugccuguagaguuuaggggagagugggggcuggggugugccugccugugggguguuggggaagagugggggcuggggugugccugcucguggggcauuaggcaucuugcugggugucugauggucuccgccacgguccuaagauggcugaugauacucucuucauaccaguuacccuacauuacaguguaccccgaaauuuagcagcuuaaacagugcacuuuuuccucacaguuuuggugggucuggaaucuugacguggcucagcugggucccuggucagggucucuccugaggcuucuuaaacagugcacuuuuuccucacaguuuuggugggucuggaaucuugacguggcucagcugggucccugguuagggucucuccugaggcuucuugaaggcgccggccuggccacugccgucucaaggccugcauugcuggggggugugcuuccaugcuccucauggguugcugucgggacccggugccuugugggcuguugguggggaccuguuugaaguccuuaccaugugggccccuccgcagggcagugcacagcaugguagcuggcuucauuggaggcugagaggcggguggaaaccacggcuguuuggaagguggcagcucucaccagacucugcguauucuguuccuugggagggaaucauugggcccaggccacaccccgugugagaggaacgcuaggcggugggggucgugggcugucuuggaaacugccccccuccuuguuuccuagacuuggaaacugagucccagagggcuagagcuaggaugagucauucgaagcagguugauggcaucagcaccagugugugaguucugguucugccgccaaagccuaagcuguuuguccucugggaggcugucucaggcuacagccgcagcagcugcccugaacucucacuggacaccuuuucugcaugagaccggggaagcagggcccacagccaggcggcccgcccugcacucacccuuggcaggagcagcuguguacgcgggggccuugcucagcgcagggcugggcugcacgccgagcgcagacucugacggcuccucacacagcucucugcguaggacugcguucccauuuuauagagggggaagugggggcauggagcggcucaggagcuguucagaaucacacagcaaguaggcguagagcaggccugaccaggagccaggucccagggucugugccaugggccccuucauggcguguccaggggaugacaaugcagguuccccaugugggugugaagagggcuacacguugcugccuuuugaggggcauucgggaggcaggaucuguaggaacuggugaccggugagacgcagcaccuggugaugaaggggcgguguguggccugggcgguggcagugguggccguucaggaaggggcugccaggaggcagagggucccgaaggccgggugcuuccccagggaaggcgcugguccugucgucuguguacccaucaucugccuucucuccugacuuucccuaaucaaagcuggacacuagcugaggauguucuggacucggggcguguuuuguggcccacaccaggaucuuccuggcaguuugugcugauggcacugccuccagguucucccuucuuauccggucucugcaaagugcauggaauuuucacaggcacgcuuuaagauucaaagugacacugaaugacugguuccagucaucaggaugcugugagcuacaaagcugaucugaggaugcuuugcuuugcacagguaccagcguggcugccgaucuuuggcugcaaaucugcagcuccucacucagggucagagugagcagaagccacucauccugaccgaagaugacgacgaagaugacgacgucccagaggggguggagcgugugauaggugcguggggucuaagcggcggccucugcucuugggcaccgucgggccaauuccccucuacuccaggaccacacuuccuucuuccuugcuggugccggcacugucuggccacccguccccuucgcugagugcacggucacugcccguccucuggcuccugaacccaggccugucccugaccauggacagucucuuccugugugccguagaagcccuuuuucccaccgccucgccuccuuccugaccugggcugccuguucugggcagcuggguguguccucaggaaacaguucucccaggaaauugaguuggggucccuggggcucaggucucuggcuccuuggccccuaaacccugcucaguuccuuaccucaggagccauuucaaacucccuuaaaccacauuacaccuugcaggggucuccauccacugcccuguucuccuccuguggggucuccugcugcacagagacagagccaucagcggagccccucauggcggccauccugggcuccuguccacacacuguccugcccuccugccgcgguuggaugaagucuucccuggacccaggcagggccucuucauguccccucccugugaggcccccauccucccaguaucucccagcuuccugaugggcaggcggggccacgcugccugugcugugcugcacucugcucacauccccgccgcucccuccagggcagguuucuccccagucaucugcaccccaccucgaccgugaccaucagggcgccuguggcaccguugccagccccgagccagcauccacuccggcccuucccuugaccuuugcuucucagagcccucccugguugcgugguaggcgcccgcaucugugcugggcggcucugagucccgggcggggcccugggucugccccuuccccguguccgcagccugccccagguucauucccgucucccacccgcugcaggcaguccccccugcccgcauuccagcugcugugcuggcuccagacugucucuccacccuccccuguggucacucagcgagcuuguccaucagggucuucccagggcugcuuggugcccacaggcgaaggcuucacccuugcuggggcuugcagggcccucaccgugugaccugaccccucccugcauccucuaggcuucugugugguucuuaaaaguucagccugccgccaaggccuggucccugggagagacgucuucgugcagccgcuggcuggggguuuucucuggaagcuucccagcccacuuuggucacccgugagcugcgggcucuuccccuggccuggguggggcccuugauguuggccuuccccugggggcaggcagcugcucccuguagccggcuuuaaugggguagaucucuuucuuaggaacagagaacuugggaacauggcuguaugugaugauuugagaacggagggaaggaaauguucuuuuccugucauuaaaauuaauauuguuaauguaauucccuucggcgugugcacugaguagcguacaggaugggucaccuuacagcugggaaacuaggaacuuuguguggacucugucacgcaucaccuuccucuuccuacagagcagcugcuggucgggcugaaggacaaggacacggucgugcgguggucugcagccaagggguaggugucuguggccgcagaagcaccccggggggugggccggccucuccugugcgauucagcagcuacaaauacccaacagcuuuggaguggcagcgcggcccccuccucggcccccuccaacuuauguguguugcuuuacguguuggcgugaagaugguucccgaggcggagcuucggucuccuccguccuccugccucuggcuggcccugccgggucacgagcaggccggguuuaccuguuuaucuucaaaauguucccuugcuuuuccacauccucaucacugugccccccaccuaucguuccccacagaugggggucacggcuccuacaaugacggugcucagggaagagcccucuuuuguggggugagcaggugccagucccucauucaccccucacuagcaccugucauaccugugggagucgacaugcacccugcaccccaggccucaguggaggucguggggcagauccaguggggccuggccuugaacacaacagguggagcccuggccuggaggagccgguggcccugugggcucgggcugugcagggacagcgauacacgugaagaagaugcugaagugucggggaggccccugcuguggaggagaggaggcaggugcaggggccagcaggugcugaggugucagggagguaccuucuguggaggggaugaggcaggugcaggggccagcagaugcugggguugggggaggccccugcuguggagaggaugaggcaggugcgggggcaguagguguugagguggggggaggccccugcuguggaggggacgaggcagguggaggggcugacaggugcuggggggcggggaggccccugcuguggaggggaugaggcagguggagggguggcagguccuggggggcggguuggccccugcuguggaggggaugaggcagguccaagggcuggcaggugcuggggggcagagagaacccugcuguggaggggacaaggcagguggaggggcuggcaggugcuggggggcagagaggccccugcuguggaggggaugaggcaggugcaggggccggcaggugcugaggugucagggaggucccugcuguggaggggacgaggcagguggaggggcuggcaggugcugaggugucagggaggucccugcuguggaagggaugaagcagguggaggggcuggcaggugcugagguaucaggguggucccugcuauggaggggacaaggcagguggaggggauaaggcaggugcaggggcuggcaggugcugggggaugaggcagguagaggggccagcaggugcugggggacggggaggcugguuuuugccauugcucucccaugcgucugugcuggguccguccauaccaugaucucugggaggagcuccacagggcugugcaggggcucacauaggccuuuguguugcuguacgcaggggauggcuuuucagcccagagccucgucugguugggugugaugggcccacgcagugagaggcugggcaggccuucccaguguccuuccuggaggccccuggccaggaccuuccccacggggccaucuccagggacuuggacccugugagccagccucaggcggccuccauguggggccgugagcccaucaccuggccugaugggugccugcacagucagcguuugggguggcacagaggaagcccggcuccaguagggagggucagggugaagcccucagcguucgccugcugccucgguacccucagccgucacugguggccugcagcguccgcguuacagugguacauggugaccuacccugugccgcgugugcucacucguccccuuugaaucuggcugcaggcuccuuuacccugcagcguguuuuagcgcgggggcuccaagcagggugcgggcuugccuggaguuggccucuucucuccuggucucuggaggaaaggauggguguucaggccauucacacgugucacgcaugcccuuggcgacaggcugguggugccccugacggauugcugcguuucucuuucagcaucgguaggauggcuggcaggcuucccagagcccuggcggaugauguggucgggucugugcuggacugcuucagguaugugagaagagcaggggaggcgugugggccugacccugaguugagaagcccuggcuuuccuuauauccuuucacgcuugcuuuucauugagcuguuugucagaacuccagaagcucuuuuuucccccuuuugaaguuaaacuugagaacucuuguuauuucugguauguugcuuuuaucaauuccauucuauuuaaaaaccuuaaggaaaaagagagucaguuuagacauauacccauguagauguuuauucugaaaggaaaagcucuacugagugaguuggggcugcuccgagagcuuucugugggagguucgggucuaccccucgccuacccauuagccacguguaucacucagaccuugaagugaggcuggugugaccaaggccugaguuugaauuggauuucauuuuaacgaaaugugaggcuuugggaggccaaagugggaggacggcuugagccugugaauucaagaccagccugggcaacgaagcgaaaccccaucucuacagagaguuaaaaaauuagccagacguggucccagcuacucgggaggcugaggugggaggaucacuugaggccaggaguuugaggcuucaugagccaugauggugccacugcugcacuccagacugggcaacagagugagacccggucucagaacaaaacugaguguagacagccacgugugcugugccgcauuucucuugucagccuucagggaguucugggucuugggaccguguggcuugugggugguaaguugugggcugggaugugcggguggcagggccugggauuucagccuggggccugcaguccugcccuggugugcucacacgugugaggcaucgaucugugaccuccccagggaauucucccuuuugcuuguguaaaugucucucccaguuucagaagcggagggucgagagcaggcguccagcuugcucaggaccccgggcgugcuguugcucuucauuagccuggacaccguggcgaaagcugugcugucagcacuuuggaggcuccaguucgcguugccugucagucaccagggacagcuccggagccguucacaaagccuuguuuuccuucuggaggagauuucuugugcacuuagccuccagccugcucagugacaauuucaggagcacaggaaacaaugugucagauacgggucauguuuuucagagcagugugcaugcaugugugagaaauauucuuccaguggaaacauugcuagcagaaaacaugcucuuuaccacaacugcuugaugggaggcagggguuggagggugcuacgugcuuggcuucucuguaggcgaccuccagccuuguuucaggcgugucccuggagcuccuuucugguggucauggugggcauauguccuccugucgccuggugccaccugcggccuucacaacaguguggugggcuccaggccgggccugccugugccugucuggacuuugccucucuccuccagccgcugggcggccugcucaucaggccuagugcgucuccuaaacucacugugugucuuucccuccacaacgugcagccucucuggacuguguguuccuuacucuagcucaccuucuuggucuaguuucauuuuuccuggcugguuuaaucuucaggugcuuuuuaaccuuuauuuuuguuauuuuaaugugcucauuccauuuuuguagcuagguucugggacgggguggccuuuuuacucuugauuucgcagggccuucaucccaaaguagcugcagggccaucaucccgaguccucgcaggaugcagcucuggucagugccugccuucccuuuuccugggugcucagugugugauugucaaccguggcauaaaaaggcggcucuggacagcgccugcuuucccuuucgcugggugcucagcaugugauugucaaccauggcauaaaaaggugcagccucagagcaggaugucugaagacaccaggaagccaggaguugcugggguguggggcggcccacagcccugcaugguggcugcuccaaucuuguccuucccugggacgugugguaagcugccagccucuucugaaacggguccgagaaagggcauuaauuauauuaacuguaagaacacccagcacccaggaggguuaacuuacuccccgcuccuuuccugggcuggguuaugcagugaguggaacugcacccauccccaggggguucaggaucuguguggcugauguggcugucccccaagcgugcacgacucccucaggaccuggggcccccuccugacucccaucaccagcccugcagcauuacccuggaccuaggaaguagcgccagaccccaggcuguggcagaagcagggugccuuggagaggagugugucugugucugugccaaccccauugguuucucccgugagcaaaccaacugaaccugugcccgggcccagcuguggguccugcugacuugcccgagggcaucuucugagacacucgguguggagcgucuggaagccacggcacuacgcugugccucccccucgcccgccgccccgugucagcaggagccucaccacguggguuccuuucuguugagcuuuacgguuucaucgagguuuuggacugggugauguguucauucaaaagucaaaccaaagggaagaagacagccuccccagaccccagagcccccccgcaggugaccuggggcacccguuucgcaucccuccggggacugaugcaggugugagcagauggauacagagguuuucuuguuuuguuuuugagauggagucucgcucugucgccaggcuggagugcaguggcgcggucuuggcucacugcgaucuccgccuccuggguucaagccauuccccugccgcagcccccaaguagcugggacuacaggcgugcaccaccacgcuuggcuaauuuuuuguauuuaguagagacgggguuucaccauguuggccagucgggucucugucuccugaccuugugaucagcccgccucggccucccggagugcugggaugacaggcugagccaccgcgcccggcuguuuuguuuuuagagauggggucuugcucuguugcucaggcaccaugauagcucacugcggccucuacuuccuaaguucaagugauccuccugccucagccuccgaguagcuaggacuauaggugugcagcaccacaccuggcuaauuauuuuauuucauuuuuguagagauggggacuugcuauguugcccaggcuagucuugaacuccuggccucaagcaguccucuugccucgguuucccaaagugcugggacuauagaccugagcccuguaccuggcuaaaauugucucuuucauuuuacacagauaauggcuuacuugucacacuuuaacaccaaacgcaucuuugaggucauuuuacauuagugcuguuccccuugcucuugaugaucugagacccguguaccugcgacacucuuuacccgccuccucucucucucucucucuuccucucccgcucauccgcccacucauagcuuccacuauuuucuguugucuucccuccucugagacccccccugugcuuccaggagugccuuaagcuuggaucugagggcgggaacucgccccggcugcuuggcuucucccugugccccugguguccauggacaggguccccuguccgguuccacugugccgugguggugcugggccucugaggcgagccggauggacggacggcauccccuggacccugccacccuugccaccgugccacagugaacacgugucugauuuagaaguagacauuggucugacaggcauuuguuuugguauuuuuaagucacgguaaccuugguguuuugucaaguucauucagauguuaacuaaaucuuugugaaaggugugaagcaucuuucuccaaugaaaacccuaaaggacgcaagugcugaugugaaaauacgcaaggggcucacggagccucugggcagacaguacacgucuggaacuuguuuaauugugauugagucugucggugacagugagcucugaggagcccgcugguggacgcuggugucugucucagccccuccucucugggcugggcacgcaggaggugaggcagccacugggcggacaggcacucuccgauuuuccuaaguauucuuguccauacugauugccagcuagucauacaauuuaguggguuuuccuaaacauuuauuugcugucaagucaauuuaauuagaaucaggagagcuucugaaccaccccggggaaauuaguacguauaaaauauuaugacuugaucgauggccauugcaauuguucauuaaaaguucauauuucaaauacugugaaaaaucuugaaaugccaauucauuauuguagcauuuaauucugaguuugacuaaacaguggggugucauuuaaagaaggucuuccugcucccuuuuccacugacgucuuccugugcugggauuccuguuuuaaguuccuacuuuucugaagugucuuauuucuuucuaugggagcguggguguugcccguacuuggagcgacaccacuguggugggaaaaccccaccugggacggcacagacgggacggucucuuuguuuggggacugaccaagacuuguccucacucucgggagaucugaagaggcccugggguaggcacggcuguugucuucauacucaguugcaguguguuauuucuucagccaacugauuauuuguuuuuuuauuuugagacggagucuugcucugucacccaggcuagagugcaguggcgcgaucucagcucacugcaaccuccgccucccugguucaagcgauucuccugccucagccucuugaguagcugggauuauaggcgugagccgcugugcccagccuugauacuuuaaaaacuuaggaauggguuuuagugagccuuacgugagccuuacaggcagaggauauggaccugccaggcugugcuccuugccaugcugugggcuuugaaccaaaagcugacacgugggcuguggucucaggaucuuuguugcucucaguuuccaggagacugacaaggcguggcaugggggaugucuggcgcuggcagagcugggcaggagaggccuguugcugccgucucgacucguggauggugaguagcugaggcacggucaggggggaugucuggcgcuggcggagcugggcaggagaggccuguugcugccaucucgacucguggauggugaguagcugaagcacggucagcugcgucaccaggcuguccguggcaggcugcagcccuucgucugaacccaucuccgcgguguggcccugccgcgggcacgcccagaagagcuugagaacaaggucugucuaccuuuuucucgcauuggccuuuguaauuuccuaauugccucuuuugucugcuguggaauuuuaaugccacagauuacccuguguagcugguuuuggagggccacgaauccuuguaaugucugauuuucuuacuccccaaaaccgguuuucauucuugagggacauugucgccccuuaaggacacaugcaguggcaccugcuucaguuguagaaccagguaccccuggcagcauccugggucaccuggagugacguggugcucccuggagaugaggcucacgccagcgugaaaccagggugggaacugggguggagggccaggggagcucugcaguggccagcagugggguggggacagagggcacagcauggcagaugcaggggcacugccccagaccagcucuugugccguggccacacgcagcccugucuguguuugguggggagagucccuggguguggcuggcagugcccucugagggcaggaaggaaaggaugucuguacaggauagagugggggcccauccugagagggccucaccacagagacuugauucuguccaaaauaaagacaccugagaugugguggccucacgucuucccaguguggagcugugguggcgucugaagugaccgcuuugcacuuggcauuuugauguauggggagagcuuuuagagccugcaguucuuuuuuuuaaugucucugcuuauuuuuuuccagacuucuuuaauguuuagaccucuuuauugcgaucuaauuuacaugccauaaaaugcacucauuuaaguguacgguuaagugguuuuuauauauuuacagaguugcgcaacuauugccauaauuuaauuuccgaacauuuucauugccuccaaaggaacccuguguuuaagaacucacucuuuacucuccccagcacccccgcccuggcagccaugucuccagugucucugugaauuugucuuuuauagacauuuccuaacaguggaaccuacgacaugugaucuuuggcguccgaauucuucggcugaguuucucugugucguagccuguggagugccuccuuccuuccuguggcagagccuuguccugcuguguaaaugcaccacacgccacguuuuguccauccuuuucaucagcugauguacaucuggguuguuuccaccuuucacuguuagguuaaugcugccaugaacaucguguacacguuuuugaguggauguuggguguaggccuaguagaaaugcugggucauacgguaacuccacguuuaacuuucuaagaaccugccaaacuuuuuccaaaaugauugcaccauuucaaguuccugccuguagugugugaggguucugcuucucugauccucaccaacacuugcuuuuaucuuuuuuuuuuuggacgcgguuucacuuuguugcccaggcuggaguguggugaugcaaucucugcucacuguaaucucugccucccaggaccaggcgauccucucaccucagccuccugaguagcugggaccaccggugcccaccaccaugccacauuaauuuuuuuuuuuaguuuuguuagagacagggcuucaccacauugcccaggcuggucuugaaguccucagcugaagcaguccacccgccuuggccucccagaguguggggaauacaggcgugagccaccacacuugcccccugcuucuuuaaaaaaaaaaaaaaaaaaaaaagccguccuagugagugugaagcgccaccuuguuuugcuuuucaucugcuuuuccccagugacugaugacacugagcauuuucuguguuugcccguuuguaugucuucuuuggagaaaugucuuuucaaguucuuuacucauuuaaaaaaauauuuuuuuaauuguuguuguaaguaagaguuuuuuuauguauucuggauauaagucucuuauuggauauaugauuugcaaauguuuuauugcguuccaugguugccuuuucacuuucuauugauugauugacagagucuugcuccguugcccaggcuagagugcaguggccccaucacagcucguugccaccuugaucuccugggcucaagccauauucccaccuuagcuucccaaguaguugggacuacaggggugcaccaccaugccuggcaacuuuuuuuucuuuuuuugagacaggaucucauucccaucgcccaggccggagugcaguggcgugaucucagcucacugcagccuccaccucucaggcucaggcggucugccuaccucaguccccuaaguagcuggggcuacagguaugugccaccaugcccagcuaauuuuuguauuuuuuauagagaugggguuuucccauguuguccgggcuggucucgaacuccugagcucaagcgauccccccgcuucagccucccaaagugcuaggauuauaggcgugagcuacugcaccuggccuucaugccuggcuaauuaaaaaaguuuuuuguagagaugggggucucacuauguggcccaggcucgucuugaacuucuggccuccagugauccuccugccucagccucccaaagugcugggauuguaggcuguaccugguguguuuucaauuucuuugauggugauauuugacccagguuuuaaauuuuaauuaaguccagcucaucagucuuuuucuuucuuguguuucuggugucauagcuaagaaaucauugcugaccccagaaccaugaaguugugguuucauuuaacguuuuguuccauccgaaguaagugacucguaauguuuauuugugacacuagaugugugugagggugugugugugaauguguagcugggauggaaugaagucccugccuguggggagccagcuccagguucacucaaaggagacaagagacucuacuggcuugugugugugcucugucaugucuuauggcaacaugcacugaccccaggcagcuggggcgagaggauauggguguuggcaucauaaacgaaaaggguaaagcuaugguucagaaacugacacgugauguggaauacacuggcccaugaccuucgcaugguugguuggccccuucugccuggcggugcccuccaugugagcugaacccucuuugcagcccccauucuguuccuggugggacauggagaagcugugcugucucugcacagggcaaggguucuuucaggcaggggugaaagagaucccaucuuggggcugacucaggaggugacagggcugacauuugaugagcauuugcagcaugcuuuuuauguuuuuguuuuagaccucacaccauuccucugagagccgucuuguuuauauaaagcuauaguugggagccacgugugguggcggugccuuuaauccuagccucuugggaggccaaggcaggaggaucacuugagccuaggaauuugauaccagccuggacaucauagugagacacccucucugaacaaacaaacacacacacacaaacacugcagcugugggagccaggaagucuuucuggugucacagcucaugcucagcccuucggccuccuccaugucacacggcugagcugucccugcaccuccuugucuccuuggagaguuacugugguucucugucaguuugguuugaaaagugaaaacaggcugggcacggcggcucaugccuauaaucccagcacuuugggaggccaaggcggggggaucaccugaggccaggaguucgagaccagccuggccaacauggugaaaccccgucucugcuaaaaauacaaggaugugguggugcaugucuguaaucccagcuacucgggaggcugaggcagaagaaucgcgugaacccaggaggcagagguugcagugaaccgagaucgcaccacugcacuccagccugggugacagagcaagauccugucucaaaaaaaagaaaaaaaagcgcgaaaacaaaugcuuggcaaauaaaugucguagaaagacacaauauagaugagcauguuugaugacuaaagcuuuuguuugucuuagaggaaauguggagcuucauuggugcaugcuaaaggaggaagaaguaaaacuagggaagucaggugggcaggcagugaugcgauguuugccuggaaggcacccugggucuuucugcccuuaguccucugaauagggggacucugccugcuggacucaggaaaaaagcaucgcauuuucuuuggguuacuuuuuagggaauccugcugauuccucuccacacauacagugcacacacacacagaaucuccaucuguugugcuguaagccuauuucuuggucucugacucugugcacaccaccacgcccagcuaauuuuuuaaagaaauucgaaaguagccugcgcaacaaaaugagauccuguuucuacaaaaauuguuuuaaaaagguaguugggugcagucccagcuacucaggagguugaggugggagaauugcuugaguccaggagguugaggcugcagugagccaugaucgcagugcugcacucacgcgauccuccugccucggccuguggacagugggccauguucuuuuucucuuugcaucaucaccucuguuugaggacuacuguuaaagggcuacuuggucuuuauuuuaggugauucaaauuccaggacuuuucuugagugguccuggcguagguccuuucaccuuuuuuguggcuccucuuugaacaccucuguuguuguggcaggaggaggugggcacuccucaccaugaguaagcuccuacaauguuugugaacccuuacgguuuccuuuguuggauacaagaagcacagguggggggauguauugguuuaaguuuaccuuuuuuuuuuuuuucuuuuuuugagacagagucuugcucuguugcccaggcuggagugcaguggcgcccucuuggcucacugccagcuccaucucccagguucaagugauucucaugacucagccucccgaguagcugggagucaggcgcccgccaccaugcccagccaauuuuuuuauuuuuaguagagaccagauuucuccauguuggccaggcuggucucgaacuccugaccucaagugaucugccugccuuggcuucccaaagugcugggauuacaggcgugaggcacugcgcccagccaacuguacuauuuugauaaaauguauacaugugcuccuuauuaugcauuuugugguuuucaucaguauuuugcuuuuugaaaaaugucaaguguucugaucucuuuggacauuuuguaugaacccuauuucccuugcuauccuuauugauugagaauugugcauauugauuuggguaauaauaacuagcacuugguguuuuucugagcuuggauguguagauucaugucuuucaucaaacucggguaguuuucagucauuguuucuucagguauuuuugcugccccucuccucuccuugugggacucuuguuauguuaauacacauguugguacucuuggugguacccuaugagucucuuagguuuugcacucauuucagcucuugagucuucuuguuauguuaauacacauguugguacgcuugauggugcccuaugaguuucuuagguucugcccucauuucagcucuugaguccucuuguuauguuaauacacauguugguaagcuugauggugcccuaugagucucuuagguucugugcucauuucagcuguugaguccucuuguuguguuaauauacauguugguaagcuugauggugcccuaugagucucuuagguucugcacucauuucagcuguugaguccucaguuccagaauuucucuuuaguuucucuuuuaauaauuucuuuuugagacagggucuugcucugucgcccaggcuggagugcaguggugguaucacggcuuacugcagccucaaccucccaggcccaagcagcucucccgccucagccuccugaguagcugagaccacaggccugcugcacuggaaaaaaaaauuguagaaacaggaucucacuuuauuguccagacugcuuucaaauucuuggacucaagugaucuuccugccuuggccugccuugggauuauaggagugagcugcugugcccagccuguuuuuauaauuucugucucuuuaucaacauuccauguuaguuuaaauguuguucuuuuggucuccuuuaguucuuuguccacaguuuucuugagaucugugagcauauuuuugucuaagacugagcacaguggcucacacuugcuucccagcacuuaaccuuugcuuuaaagccuaaaaaggaagaaaucuuugcauauguguuucccaaauaacagauuugagggcuguguuggugacauaggucuguuuauacccacuguguggcuaaagcaggucucuguuaaauuagcaucuacaaagcuuuucuccugccuucccucaaacuuaggaagcucccuaugcaaucuucaggcugggguccuucacugcccccucucaaggaggccuaccccuucccccagaaggugcagucugucaccccaugucuuauaaaguguaauggucuggugucccaaagccacagagaagcccauucuaaccuuccugcaacuuucugaagguuggagagcauguuuguuuuacugcuaggaggcucaaggucccugugaaccugcaucagguaguaagcccugcaugucggaaauacagacugccuaacucuuaucuaaggugauguuuugagaaaauuuuuaaauguauaauacauuuuauaaauuucgaaaaaauuuuaauaaacauuaaauuuuuauaaguuuauauaaauguuauaaauuuugaaaaauguacagaguugcauuggagcacacgcucucaguguucaucgaagacguacaagcagcgucuuacgacgauguugcugcagcugccuuggggucuuguuaaaagcaccauucaguagauuaauucccaccuguggacuguguuuucuggcuuccaaaagaaacugucauguuuuucucucuggaugacgaaaacucugcacguacuuccuaugacaagugcgauuggcgcccacugcucuuggcaguugaggugaggacacagcguuucugugacggugaaggggacaggguuuggagggagauucagacauuaaacaaggaaacgaagggagcaauuucagagaauggauaaagucguuaagaaaauacaaaagggcggugagauccucagugauggggccaaccagugacuugaauaagacuuggggaagaccuccuggggcgacauuuacgcugagagcuucuaccgugaaggagccgagcaggauggacuccugaccgcagcaucucaaagaggaacgaaggcucgcacgagcugggacagcggaaagagcagaagagugggcacagaaaagcgccugggggccagauccuagaggggcuucaggaacacagugagggguuuggaaauuauucaacauaaagucagauacuggggaauacacgggggugcaguggaaaggaagagcgagggagagugaggccauucgggagccaccacaguguucggagugagaccagagcugugaagaaagagaaaaggaaauacgcugcauguaggauucugaacucaacgacuuugcuguucuauucagugaaagagagugagauaguaaggucagugagugacauguuggagccuuccacauaguaauggucuacaaaguuauggauugaugaguucacacaggagggagugagagaugaggaaggugaauggguggaaaagcuugaaccggguucccaggcucacuggcauggggagguggagaaaaggggaggaagcagccgacauggaaacccgcagaggcuccuucagaagggauauuuuauaggagaggaguccgauucugagagggggaagggguggaggaccagaguuuccucacaggcucuggagcacugagguggaugguaaauuccaggagagcagcuccagcugaggucuagggacagggcauucccucccugguagagccguuggggcucagugccgaggcuggcucaggcucuuguggggggcccugcugucuguccagcccuggcuguggccuggccugacccugcugcccccugcaggccuguguaccucaguucccaggugaucaaggggcccugggagagguugggucugagcacguccugacauggccccaguguccaguuccccgccuguuuuuguuggcuuguuuaaucuugguaggcuuuuaagcuuucagguuuucaggaaaaugcaaagcaugagacaucuuugacuuuguacguggaccgauuguucuuuuuuuguguuaaugguguuuuuuuccuugugugaacguguguguuucguguugcacuccgcccugcucucccucccucccucccuguagaacguggcauuuuggcugaacguuaacacuggugggggcagacggcagugggcccccguuaagacuguuuagaaagggcguugucggcaucuucucuuacaugugaauucaaggauccuuuauuuuuuuucagcuuuauugauauguaauucgucuaccauauaauucacccauuuaaaauauauaguuccaugguuuuuagaauauucuauuauuacuuagaaaauuguggcaaaauauguauaacaaauuugcucuuuuuauuauuaagcauguuaauccaguggcauuaauuacacucucacuuuuguacaaccaucaccauuaucugguuccaaaacuucucaucaccccagauuaagaagucacucgccccugaugcuccuucccuucaacccuuuguaacucuagucuacuuucugcuugaaaaaggacuuugccuguuuuagagaucuuguacaaguggaauuggacaauauuuggccuuucaugucuggcuuauuuuauuuagcaucauguuuucaagguuaaucuguguuguagcauguaucagaauuuucuuucuuuuaaaggcugaauaauauuucauuguauggacauaccauauauuuauuuauuuuauuuuuacuuuuauuuuuauuuuuuuuugagacagagucuugcucuaucacccaggcuggagugcaguggugcgaucucggcucacugcaagcuccgccucccagguucacgccauucuccugccucagccuccugaguagcugggacuacaggcgcccgccaccaugcccggcuaauucguuuuguauuuuuaguagagauggaguuuuaucauguuagccaggauggucucgaucuccugaccucaugauccacccaccuuggccucucaaagugcugggauuacaggugugagccaccgcgcccgacccauauauuuauuuuuuaaagauaggaucucacuguauuguccaggcuggagugcaguggcuauucacaggcccaaucauaguacaccacagcuuccaacuccugggcuugagcgacucucccaccucagccuccugaguggcugugauugcaggugugcaccaccgccccuggccauauuuucuugauccauucauuugucaguggacgcuuggguuauucccaccuuuuggguauugugaauaaugcugcuguggacauggauacaagaaccuguuugacaccccuuuuuuuaguuccuuuggguauauacccugaaguggaauuagugggucaugugguaauucuauguucagcuuuuugagagcuuaucacuuuuuguauguaaaaauuacgaguguuuaguucuuaagucggaucaugcauaaaugcagaaacguaguuaaaaaauaagucucuuuuuuuuuucuuuuugcuauaaagcucuaggaaucgauuuugcuuuuagagauagacacaaagggcuuauccugguugcaaugggugagcuauugcagaugaccuuuggaggaauugugucggaguguagaauuuucacaguguagcucgccaugcaucaggcacauguagccugugccacaaccauugugcuugggcgggguucuccaugcugcccuguugcaggaggaugcucugccccugcuucucccuauuugucauuuaagaugauuccuggugcuuuuuggugagcgaucaaaugguguucucagaaucuuugggcccuugacaacggagggcuguauucuugggggugugaugugagagcuccuugucugcagggugugaggcuuuggguccugaguguggaccguggcaugugaugucuugucacggcucccugcacggcuguuuaguuucugaaagcuggaaguauaauauuuuuguucuuugccaaaacauacugguguauauaaacagaagugcccaggugagcgacucagcacugcgccuguguuuaugguucugcgucugaccgugugccuuuuaggcugguguagugguugucugaggugggugccugacagggcugggggaccugcugguguccuugcugcugcuuuagggacagcuugaagcaguguccucagauaccccuuggaauugugacaaacucuguaucccucuuacaaguuuuauagaacucuaaccaguugcaaauaacuauuugccauccugaguauugucauuuuaaaauaaaacuauugcgucacucaucugaauaaaucugggaaauugagguagaauaaucuaccauucuucguuaaaaaauuuacagggcugggcgccaugucucacaucuguacucccagcacuuugggaggcugaggugggaggaucacuugagccccgggagguugaggcugcagugagcugugaucgcgccacugcacuccggccugggccagugagcgagacccugucuaaaaaacaauuucauaggcaaguuuuucucucacagaaauuuuauucuuccuuuuucuucuuaagcccauauuuccauuuacuuuuuucccagagcauuuuacccuaauguaauguauuucugugccuaagaaucuuuauugaucuaucauuuaucugcaacgaaagaaaauaacauaaacauaaacuucaacuuuugcauuuuguauggccauaagaugcuaguuauuuauuuauuuuuuccacagguguucaugaccuuuuuuuuuuauuauuuuuuuaacuauacuuuuaaguuuuaaggugcuaguuacuuagaaguuuuuuuagauuggguuuuaaaaaauuaugaguacagaguugaccaaaacaacauaaaauagcauauuauugaaauuuagcucuuaauaagauagcuguuuaguuugaguuaucuuuugaugagucaggcuuuuuuuguuuuuauuuuuugaaaugauucuugcucugucacccaggcuggagugaagugguaugaucuuggcucacugcagccuugaccuccugggcucaagcaauccuccugccucagccucucaaguuggugggacuacaggcaaacaucccauugcucagcuaauuuuuguauuuuuuguagggauggggucucccuguguugcccagacuggucuugaacuccuuggcucaagcaguccucucaccucagccucccaaagugcugggauuaugggugugugccaccaugccuggccgugagccaugcuuuuaaccagaauaaggcaagguucugcaacaguacaauuuuugcuuuuuauuuauguauuuuuuuugagaaaaggucucacucugucacccaggcuggagugcaguagugugaucauggcucacuacaaccucugccucccaggcucaggccauccucccgccucagccucccaaguagcugggaccgcagguaugugccaccacaccuggcugacuauuuuuauuagagacgguguuuuuccauguugcccaggcuggucucaaacuccugaccucaagcaauccauccgcuuuggccucucaaugugcugggaugacaggugugagccacuacgcccggccccuauuuuuacuuucaguuuuaagugcuaagaagucuuauucauucaagucuuauucaaguagcuaggaauggcagaaauuuugcuuuagcaaugcugguguuucaacuuuuuccaagcucacgccugaccucugugcucugucacugagcagcuucaguaggguggccucaguccugugaagugaugcguugacagccaccugcauggggaagcauuucccagucucuggagcaguucccaucguaguguccacugcaugguuuccaguguguugggugagaggcugccuuucuugaaaagugagagaaagggcuguugugagaggggacauggggauggagaaacccuuucucaagcagagccuuaggggcugaggcuccggaagucuacgcuccuaaagcacucugaagccugaggaccccauggauggccauugaguagccccaggggugcuucgcacaugccgguacuugaccacugcuuuaaacccaugugcacacaugcacgcucacacacaugcacgaugcagaagugcauacacacguguacaugugcacacugacacaugcacguugacacguguacacccaaucgaaugugcacaacuacccccacagauagcacacacccacacaaucgaaugugcauacacccacagauacacacacgugcacacccguacaaucgaaugcacacauccgcagauauguacacguggacacccacacgauugaaugugcccccccacagauaugcaccuuugcacacccacacaauugaaugcacacacacccccccacaggcacacgugcacacccacacaaucuaaugcacacacacccccauagauaugagcacguggacacccacacgauugaaugugcauacacucacagauacgcacacaugcacacccaaucgaacgcacacacaccugcagauauguacacguggacacgcacgauucaauaugcauacacccacagauacgcacaugugcacauccacacaaucgaaugcacacccccccgcagauaugcacacgugcacacccacacaguugaaugugcauacacccacagacacacaugcacacccguacaaucgaaugcacacacccgcagauaugcacacguggacacccacacgauugaaugcgccccccacagauaugcacaugugcacacccacacaauugaaugcacacacacccccccacaggcacacgugcacacccacacaaucuaaugcacacacacacccauagauaugcgcacguggacacccacacgauugaaugugcacucacagauacaugcacacccaaucgaaugcacacacacccgcagauauguacacguggacacgcacacgauugaauaugcauacacccacagauacacacacgugcacauccacacaaucgaaugcaccccccccgcagauaugcacacgugcacaccggcacaauggaaugugccccccccgauugcacacgugcacacccacacaauugaaugcacacacacccgcagguacgcacacaugcacacccacacaaucgaaugcgcacacaccugcagauauguacacaugcacacccacagaaucgagugugcacacacccauacauaaugcgcaugcacucacaugauugaaugugcacacacccagagaugcacacacacacaucuaaucagaugugcacccccacacagauaugcacaugugcacacccacaggaucgaaugugcacgccuaaucagauguguacaccccucccacauauguacacaugcacacuaacacaaauguguacacacccgcagguauguacacaugcacaccuacacagucgagugugcaugccccccacggauaugcacacgugcauacccacacaaucccauauacccacccccacaaucacguguacacacccccgcagauaugcacacacgcacacccacaggaucgaaugcgcacacacccacagauagcacacacgcacacccacacaauugaaugcgcaccccccacagauaugcacacgugcacacccacacaauagaaugugcacacacccgcagagaugcacaagcgcauacccacacccgcagacgugcacaugcacacauccacacgaucaaaugugcacgugcaucugcagacaugcacaagcagacaccuacacgcacucgcagacaugcacacccacaugggcgaaugugcacaccccccccacacagauagcacacguguacacccacacaauugaaugugcauacacgcacccguucacagguuaaucgcugccacagcuaucagcucuuuuucauugacuguuacggcaaaauauucuaaaggauaacauagauuuauguuuauuugcauuuuauguuuccuuaugguucauaugaguuuauuggaaaauuagcaacauacacaucauuuuggggaauggaaagugaggcagaguaagccagaacauucacuguaacauuauaagcaaguagaauaaauugauaauaccuucaccaguaaugcacuuucccuaguggaaauaaauuauuuguauaaauagccucuugauguuuguguguuauuuaguuauacaaaucacauuuuucuuuuuuacauauggcacuuuaauguuaguacugaaaauguuuuuucugacauuuuuucaguaauugucauuuacaucaaauaugcagcuagagcuaauagaaaaacaguuaaaacaauuuguuguaauggugagauauuuauaaggaaacauuuauaaaagaucuucuguaagacagcuuagacuugaaaauacauaucagucuuagagucauucagguguuuuuacaaccaaaaguagaagcaccuuuuaauauucaugcuuaauauuuauaaaaacugaauuggaggguuuuuuguuuguuuguuuguuuguuuuuuugagaagcagcagcugcauuuguaaaaaugugaaagugccaguucagagguguuguagcuugccaccuuggaaggcguguguguggccguagcucugugaacacacgugugaacccggcguuaggacacccgggcccuccuucguagugugaacacucuggccguguccugcagcuucgccuucuuagcuccuugcugggauuuuccagcaucccuuagacuuguccucuuuuguccuuugggucugaggucacacugggccucuuggcucuccauggagcucagugugggugugucuugccggcaggcagguuccggggccgcagcauccccaucgcccacccggauguuccuggggcuguaggccgccagcuggcacagggccacggcugccgucugcuucugcuccucgcugcuguccaccgcgcaugcgucuggagccuccucgccggggccuguggguggggccccgucaccgucgaggcugccuggcuuggucucaggguggcugggcccauccucagaaccuucugucccagucuucuguggaacagcagcagcagguucugcagcucguggucgaccggggaaggcaggccucggagccuggguguuacagggguccuucaccgagagauugaguggaagguccugcagcucugagaagcuggcgguuuccgccugggggcugccuugguacguggguucguggguggcugccagguuuaucucugauuucuuggagagguugagggggcccaucccggagcugucguccggacuggaaggcgcggccuccgagacgagagaggcgcuuccggucggagcaggagggucuccguucacaacauugaggcuagaagaagccaagaaaaagcuuaguaggagcuugcuuagaaaagcaacugcgugaagcagugugagcaaguauaagccuggcucauggaacccaaccagaaacauucccuuggagguuuugaaaaugacauuuucuuaccuuacuggagacucugcuguggucucagcagccugggcagguaggcauucugugcuuuucuuaacaggccugaaggcugugaggcuuugcucuggcggguagagucuucccagugcgcuggaggcugccuuguuggagaggucguacaggccuucgcaggucuggcucgucugcaugaagucgguggggcucggccucccuggggagcccguggcugcacucccugcgcgggggcucauuuuggacccuuccgugucucucugcccagccuuggaggagucuuuagccucaggaauuggacuuucgaacucgacguguuuucuguugggguccgaaggguuuaaccuggaaggacucgaggcuggauagaccaggguggcuucuucaagcaggugagagcucugaucucgggugaggccagugacaggugggagucugagaccauaggaggaaaaugcagacucuggccuguaaaauccguaaggaaucggcagguuagagggauauugcuggaaaaaccuguagugaucguauguggcuggagauggagccaggugcuuagggaucggccccgggugaggcaggaagugucucgggucuuggguuccguagacugacagcaggggugcgucacacucaggcgagcucccagccagcagguaaggcgaguagaugguggccagcccgugcucuguguaaaagugaggcggguacucugggauuguggggugcauguaaggggaaauggccccaagccccuuuguagaugagauuuuauguggaaacucugguggaaggaaaggugagccggcuuuccagggguagccaggaguguggaaggccgacuugguguggaaagacacggccuuggcagugggguuguguaaagccagugucucgggcgccucggcguugucuggccccuugagucugugcucgccgacuggaacaaaugcagaaggccgagcugcgccuuccagagcaggcugggcaccgagggcggcuuccggagcugggcucuugcagggugaugcccuguggagggcuggcuucugucccaggcaccuguggguuccccgggcuugcagcuccagguuuuccuugaugucuucccuggcagagcugugcugaagcuucgagucgaaggcagagaguccauuugcgacagacuuggaagaggcuggcuucgccguggcaucgggcugguugguuugcuuggggucuagugaguuagauuuagggcacuugggaacucgauccugcucugauacuaaaguaaucgaguuuuuacaaagaccauacuucaugugauuaaaaagaugugacuucucauugcaaguaaagggacauuggaaacauuuauacuugaagggcuuuccuggaggccuggggauguaauguggcuuuuuuggcuuccgcucuuugaggagacucauuuuccuccuuaugccuuggacucuggcuguccagguggcgugaucacugucgacgccgcgugcacuucgugguuucuaaagaggcaccucccgcuuugcuuucuuucccgaucacuucuaucagaagccagcucugcgugcugagggucuggcgagagccuccgucaucuggcggcugggagcuguaauaaagagcagucuuggugucaggacagcgagugaggggucggcgagaagccggccucggcucgccacagugccacaggaucccugaagcagaaccccugaagggcugaaacugccugcuccugaggggagcagcugccggucacagaagcagcccugcccuacccuugguaaccuggcugcugacuccccaccguguuuucuguuuucugagucugaucugaaagagucaccucggggccuagagguggagugugguguguggugcguugagugucuguucugagaaugccuguaagccuuugaguuuugggaacuuucauccugugaccuggaccuuuccucgaaagcgcccugccgggggcugaggacaccgagcccccucccagggucuggacagaguccugucccagggcugcccgacucugcuuggggguuacacgcuugaagcagugggugugugaucggccacacucucacgugaaauacgaagggguuuguggcuguuuccccuuaacauguacccacagucacagagugccccucacuuuuacacagagcgugggcuggccaccgucuacuugcuccuaccugcuggcugggagcucucccaagugcugugcgccccugccgucggccuguagaacccaagaccauggaugcugcugccuccccuggggccgaucccuaagcacucguggcaguuucugcccacuuuagccacgucguugguguauucuagugugcuuguuuaaaaaugaagaacauucgaacacaagacucuacccuacugcuucuaaagucagcuuuaucauuaaguagcauuuauguugucucagauaugaauacaaaugcuauauuuauguugacuuaaaugguugaaauacuguuggugaauuuguacauccugugagugacagcagcauugugagacaugcuuucacggucacccgguuccugcuggccaggaggcauggccagcagcgccugcccguccagaugcaccaccaaauggaagaaccaaagcuuugccacacuccugcccgagaggagaccagagugaguaguauccgcuuuagagaugguugggucaugggaggaagcuguccuggcccuuaaccuuuagggaguggguucagcccucuggccacacccacucagguccugggacccaccagaggcugugugugugaugucagagcuggccugcucuuuuggauucuuccagagggucucugugucccccuuaccagccucagguuuccuucagaggcugugccgcacgcccaaggcugagaacaaaggcuguuuuucuuuuuuugagacagaguuucucccuuguugcccagucuggagugccauggcgcaaucucagcucacugcaaccuccgccuccuggguucaagcgauucuccugccucagccucccgaguagcuggaauuacaggcgcccaccaccaugcccagcuaauuuuuuuuguauuuuuaguagagacgggguuuugccaugugggccaggcuggucucgagcuccugaccucaggugauccaccugccuuagccucccaaagugcugggauuagaggcgugagccaccgcacccgucccagaacaaaggcuuugagagucugggacuguccaccuggcagcugggccuggagcgacucaagcagcaacugugccugggagacagggugagugggagaugggguggaggugcaauggaucaaggcuaagcacuuuaauucguauuaaaaauguaaaaaagaaaaggucuuuagggucuaaauauuuucaaacagcuuaaaaauaaaguuaaaugacccaaaugccuaucagugauagacugaauaaagaaaaugcggcacauauacaccauggaauacugugcagccauaaaaaggaacgcgaucauguccuucgcagggagaaauggauggagcuggaagccagcauccucagcaaacuaacgcaggaagagaaaaccaaacgugcauggucucacccauaagugggagcugaacagugaaaacacauggacacagggaggggaacaucacacaccagggccuguuuaggggugggggucggggggagggagagcauuaagacaaauagcuaaugcaugcagggcuuaaaaccuagaugaucgguugauggguacaguaaaccaccauggcacacauuuaccuguguaaccuacacguucugcacuuguguccuggaacuuaaaguauaauaaaaaaaaaauacauuaaaguaaaguuaaauggagggcugggggccguggcucaugccuguaaucccagcacuuugggaggccgaggugggaggaucccuugagcccaggagauugaggcugcagggagcugucaucccaccaccgcacugcagccuggugggcaacagaaugagacccugccucaaaaaaaagcuaaauggaaaugacuuaagaaaacuguuucaacugcaguauuuuuuuuaaggaaugggcagaugugcccauucuugagucugugagguuuuauguguagacaucaggguggcuaaaagucaagugaaaagccgccccuugaaaauagagcaacgugugugggagccuaggaggcagcugucccugaagcaaggcgccaccccuccucccugcacccguguccuuccucccacacgccaggggccaggggugguggcugggcuuucauauggcugccccgaacucuggggaagugcucugauuuuguucucagcaaacugguuucucuacugauuuauucauauuucuuucuuucuuucuuuuuugagacggaguuuuggucuuguugcccaggcuggagggcaguggugcgaucucgguucacugcaaccucugccuccuggguucaagagauucuccugccucagccucccuaguagcugggauuacaggugccuaccaccacgcccagcuaauuuuuuuguaauuuuaguagagaugggguuucacuauguuggcccggcuggucuugaacuccugaccucaggcgaucugcccgccucagccucccaaagugcugggauuacaggcaugagccaccgugccuggcucauuuauuuauaauucuuaaaaacacaaccacccuucccccuacaaacugccucuauuaacauacuuuaaguucuuuaagacauuuauuuacuaagaagugguuuggguagaaaaggggcucugcugaccugccaccuucgcugugaugaguuucuguguagcagggacagcgaggcacgguuuggaugaggacaagauguuuguuacccuacaaccagggagggugucgggugacacccugggcucagaccccgcgcucagcacccgucucccaccgugggcugccacagaagcuacaaggcaccgggucaaggccaagcaaaugaaacacguaaugauagcucugucuuucuaauuucccccuauuagaagaaagaacgugaaauaauucuuuaugggcucagucccuaccguguggggcagaccugcucugggugaugaaagcaguuucccugccucccuucaggaaguagagaagccgggugccugguuccagccaaacgcugggccagccagcucagucaguggggccugugccggcaugccucgccgcgcucccugguucugaaggcgugagaaccucugcaagucagguucccaugauuguauaggauguguuacggcagggaucugaaagcugaugauuucaucacuagcuggaagcaucaggaucgaaacgaugacaguugcaaaauguucaucaagugagagcugcguccucgcgagaccgaaacgccgccucuagcaccugaaacacaagcccucagaggagcagaugauucccucaggauuuaagaaaauugaggacuucaguuuucgaagccgcauuauuucacauugcugauaccucuagcgccugaaacacaagcgcucagaggagcaaaugauucccucaggauuuaagaaaaugaggacuucaguuuucgaagcagcauuauuucacauugcugauacuuuuaggcaaaaaaaaaaacaaaacaaaacaaaaccaaaaaacaaaaaaacaaaaaaacccacaaaacccguguugguuagauuuucucaaaagcuuuacaacaggcagguuacguguaagcucugcuguugcccaaaauaguaauuagggaaauaauugcuuuuaaaugaauaugucuguuuucuagucagauuugcccuuuuguucuuugaucaguuaguucacguaagcggguguggcagggaggaagccccugguggugagaguguuuggagcucaauugcucgaagggaauuggugucgauauggagucucgggcagugguuuuaguaaccuuggauaaaccgaccucucaggcuugcacaauuugcuaauuaaaacagggagcacagcugcuucaguuguaagccgggcguaggucaccugaucuguaaaacuacaauagugucagagaaguaagugggauaacauuguugcuuugguaagcuuucaaaugaugaugaugucagccugugaguucuguguccugcuuaagugagguuuauaaggaugaagaaaccaaacccgacggccaguaccucaggcugucacagcugucugugggcacagcguuugaaauagucucuguguggucaguuucuaccagcccgacuuuguacucuggcagcugcugguguuaaauauucccaaaagaguauguuguugcccaaacaguguaacccagaaaucuagcuguuuacaguaauuuggauuuguauuuagaggugcaguuuuucucuagaggggauaaagaagugcggagcgucuuucucuccugggggagguguguuuccauuuuaguuaauaacaugcccggagagcugucugucugucuguuaauaaagcagagucucauucauuaucugcuuucauuugagaacugcagugcuagcguguuuuacagugaagaccucggugugauccugaaggaggguuucauccuccucucauuucccacuggaucggcaggaagcguuagcaggguggacaugccacagagcuuccagaucuggaucaaagguggcuguugcugaaauacuuaugcagagucuucccugacugcugcuggcuaaugugugcccucuucuccaacacaccuccuccgagccuggccuggcacaaagccuucuuucuccaaguuauuucagaucaagcagccaauguagacagugucuacacuaaagggcguaagaacaguggggugcaguggcuucaaacaugcucaggauccagcugagcuuucaccaggcuuuucuugccauauuuacagaugccacucugugccuuucuaaauauuuuaaauguugugugcucagccgaugcacuuggcuucuggaaagugcgcugagcugagagcucgcuucucuuccugcucaacgugcacugggccggguguuggggcguagcugcccacacagacagugcuuugaagagugagugguuucgguuggccaugggguugugucuaaauugccaauauacugucuuuccaaagguuccuaaguguggacaguuaaugcagcagacaguuguuaggguaauagugagaaguugggaugcuuaacaagcuucuaaggaguuugaacuuugaaaaauagacaagagaaagaguucuuaaaaaaaaaaacuuugauaggacacagcggaaguaauuacaguuuaacuuuaugggacguuucugugacaggcuggguaacuaugcuugucaugcguccuaaccugugcccugagauugugcuguaauguuccuuuuggugguguccagcugucuggcaaggagccugcucggcuggagcauugugaagggcaugcuguaauuacaauauugugauguggcguuguugcauaacucaaggacacaccauugucgccuacccacugugaugucgcaagaacgagauuugugaguuuuacuccaauugagcuuuuccagugauugacugccacucccucccagccuuucgguucuuuaaaaugaaagauaaaccucaggacaaccaagaccuggggaaaagacagucuuugggaauguaauuuggaagaauggauccagaaaaacaaccaggggcucuuaacucuaguuucggcaggagaucccgaguuacagaccugagcucguaaacaaacgcucaccacuuuacagucgccgccucauccugaaacuccggucagaaaugcuggaaggccuuugcuaaugcgcagugaaaauuaggggcacagauguggacggacugugcuuggucaguaauuguucuccuccaaaucaaguuuaugagaaauuucauauaaggaaaaaaacccuuuuguaucugugucuauauguacagaagaccuuaacaaccaaacagaaacuuaaccccuuugguuugguuuuguuuucgaaagcuuaugcccaauuuuaaacuucauguaagcuuauguacuuauuuuaaacuuuaaaacuauuaaaaguuaaacuagauaguaaauucggcacugucuaaugugcauacaccacaaacauauaacccuaaauucagcugugucuaauguguauacaccacacauauauauaacccuaaauucagccugauguacuuauaccacacauauauaacccuaaauucagccuaauguacauauaccacacacacauauauauaacccuaaauucagccuaauguacauacaccacacauauauauaacccuaaauucagcccuaauguacauacaccacacauauauaacccuaaauucagccuaauguacauacaccacacauauauauaacccuaaauucagcccuaauguacauacaccacacauauaacccuaaauucacccuaauguacauacaccacacauauauauaugacccuuaccucuuguuagcauuuauuguaguuuguuuuugagguuaggagcaguuaagcaauaauaugaauuuguguugguuuaacuuuuaugaauuuuagggcagaacaaggaguuaauuuccagauaagcuuguucauguucuuagaauaaagugucagccucauuagaaguuuuguaaucguggucugcaucccagccaugcaccugcuggguccugaguaauccucggagcccagagcaaggcagagcagacacggagcaaacgcugcguucagcuggguauuuuagauacgucugagaagaguuuuaaaauaaaacuugaauuugaaaagaaauagugaguacuuaccagaggugggcagugcugggauguggccggucuuggugccgguggcuggcggugcucaggaagcaguaccuguucucacgcuugcugggugaaacuggagccugcuguuccagugggagggauuuaaguguaggaguugagcccucggggcguagagaugcaccugauauuccuccugcccgcagcuacgauucauguguuugcacccaccgagcugcugcgggcagccuccccagcacuggacccagcaagcaaguuaucucgccgacucccagcgcugucuccagacucaacugucugugagugcggcgucggugcugccuggacggccauaugucagagggcuuucgauguguccgcaguuagaauagagauuacuauauucaucagaaucacacccgaugaauauuuggcgucaugauaaagacaugugagacuuuccuuuagaacuugagcauguguacgcaggaggcaaacacuuggauugauucucaagcgcgcauacccugggaggcacaguauucauggcguccuugccaugagguccagugaggccuuugaggaucuguggaccuuccacccucuacccugcuccugagagucucugucccugguccuccucaggagcugagccggcagggagggagcuuaucccagagccuggcugcagggaccugccggagcuugcccgacaccaggcaccgcaagagcugcggagcagggugugugggugcgggggagggggccagcugugcacucccgcaaaccacccuccccccacuuuaaauugcagaggcacuuaacuugggggccaguuuuuaccuccacacccccccaccaaaacugcuugcuugcuuaaucggaggccgcaccccaguuguagcgaaggcuggcauguggugucgguuugaggacugggaaaggaggugggaugagcuggugucaggcccuuggaugagccugaggcugcagggcagaggcugcagggcuguggcauagggacgagcuggccaggacagacaaacugguuuuuuuuuuuuuuuuuuuuuuuuuuuuugagacagaguuucacuguugcugcccaggcuggagugcaauggcaugaucuuggcucacugcguuucuccugccucagccucccgaguagcugggacuacaggcgccugccaccacgcccggcuaauuuuuuguauuuuuaguagagaugggguuucaccguguuagccaggauggucuugaucuccugaccuugugauccacccacgucggccucccaaagugcuuggauuacaggugugagccacugcacccggucuguuuuuuuguuuuuguuauuuuuuuccuuaagacuuaagauuuuacauggcuuugcguuuacuuuuauauuuaauuccuuuuuuuuuucuuuugagacagggucuugcccugucacccaagcuggagugcaguggugcgaucacgguucacuguagccucaaccuccuggacucgagugauccucccgccucagucuccccaguagcugggacuacaggcacggucacuaugccuggagaauuuuuuguagagacaggguuuugccauguuuccuaggaugguuuaauaccuuaaaauuuuuuuugguggcuuuuguccauugagacauccauauacuuuaugaagucaaaaagaguuauguaagucuuaugacaaaaaacagcaguucccugucccucuuaccuauuccuggauagcaaacuaucccaaacuuaguggcuuaaaacaagcaccguuuuauuacgucuuaggauauauugugucaggaguuuguggagggccuggccgagugcugcuucuguuucauggacacugacugagguggcuccgugggagaaagcuggcaggugacuggucuggaggguccaggacagcuuuacucaccugccuucuguccuggaggggcagcuggaauccugagaucagcuggaaccucauccucacuuaguagcacuucagaggccucccuagcaggguggucagcuguaugauggcucaggacuucaagagagcaaggcggaagguuccaguccuccagaaggcugggccgcagauugucagggugucccuucugucaccuuucucugcugaggcagccucgugcugcccagaugcaaggcgggagccgagggcuccaccucucagcggcaggagugccaggugucugcgcuacgacucccucugcccggaagccccaccuuggccuuuccuaagcugaguguucugacccuugccauggaggguccagugaggccuuugagaaucuguguaccuuccacccucuacccugcuccugagagucucugucccugguccuccuugggagcugagacggcagggagggagcuuaucccagcgccuggcuggguguuuaccuccucgauuccagccuuacugaucuguuggugguucugugcccucucucccccucucucccuucuccacuccuggucgagguguuguuugguggcuucccuucauggaagaugggaauuugccucucuuugccccuucugcccccaugucugccuuccccgucacccaggggguuuugccugccucucucuugcacuggaaggccugcugcucggaucccaugucgucuuucucuugaguuaaucauuuaguuugacaugaggcacacaccuuuuauaggcucuugagaaagugcaagagagauuuuuuuggaggucuugaauuauugaaaauguuuuuaucuacucuucaaccucacugauaguuuggcugagucuagaauuucaggccagaaaucauuuaccuucagauuuuugcaaguguucuucauuuucuuucuuucuuuuuuuuuuuuuuuuuugagauggaaucucgcucugucacccaggcuggagugcaguggcgcgaucucggcucacugcaaacuccaccucccauguucacgccauucucuugccucagccucccaaguagcugggacuacaggcgcccuccaccacguccggcugauuuuuuguauuuuuaguagagacgggguuucaccguguuagccaggauggucucgaucuccugaccucgugauccgcccgccucggccucccaaagugcuaggauuacaggugugagccaccacacccggccgcaaguguucucuauuuucucuagcuucuaguacugugguugagaaccuugaugccauucugauuccugauucuuucucucuuaacauuuuagugugaaaauuuucaaaauacagacaaguuguaaggaugcuccagugaacucucauaugcccaacggugggguucuccaguuaacacagcugucuguguucccuucccuuccccucccuguccagcuuacuuacccuucccuuccccuccccuccccuccccguccagcuuacauacccuucccuuccccucgccguccagcuuacuuaucauucccuuccccuccccguccagcuuauauacccuuccuuuccccuccccauccagcuuacauacccuucccuuccccuccccguccagcuuacuuacccuucccuuccccucaccauccagcuuacuuacccuucccuuccccucaccauccagcuuacuuacccuucccuuccccuccccguccagcuuacuuacccuucccuuccccuccccguccagcuuacuuacccuucccuuccccuccccauccagcuuaaucgucuugcugcauuucaggucaguugcagacaucaguaugcuuugccccaaacacuuuucaggcauauucuuauuaguuuaugauucuucuuucaaagguaagguuuacauucagugaagggcacaggucuuaagaggaucauuuaacgaguuuugacaaauguguucucccauuauggccccagagaguuccgucacagcagugccacccuuccccacccagaccguggcaacugcaggcugauacuuuuccaccauggauuaguuuuauguguuguagaauuuuaugucaguagugauuccugauuuuuauggacagcuguuucucaccugcagguucuuuccuuuauccucaguagucuuaguuuucuuaacuuuauauuucaacacuucuguuaaguacuugguuucugauuuugguuuccaugagcucuguuuuguucugaguguuccuuuuguagcaucucauucucaugcaguacuuucaguagcuuuucuuaucuaaggauuuuagugauagcuuucuuuuaguggggaguggaggaguggggguggauguucuccguguguguguguguguguguguguguguguuuaaagaccuggggucuugcuguguuacccaggcuggacuugaacuccgggucucaagugcuucuccugccucagccucccggguagcugggacugcaggagcgccaugccaugccuggugcccucccugcaucgucaguguggcugccugccuuccagggccucugcugagcaccucggagagucagcccugucuccugccccagugcuccuuggguuaggccuacccugccccuccccacagaguucucuggugccacagaucuggagcuuuuuagggaccuguccuguggaucagggggagucugaguugccucccuccaggggagggcugggcuucuuggucugaggcauuuccugcugucccugcacuuccaggcuccuccgugguccuggugcugccuucccugcccuuccucuucuacccuguagcuuauuucuugaaaaaagaaaaugguccguuucugcuguuuuuagugggauuuuacccgcuauuuuuuacauguucaacccccuguguuacucagaauucuugcgauuagguuuuugaccaaaucuuaggaaccgucauggggguggcagcugauguuucuugcguguugaugguguggggcaccgugccaggugcaucaccugcacugguccauuuacucagaagcaccacgcaccuggccuguggaguccccccacccacaggucgggaacauggccgagguacccagcccagagggcgaugagcagaguuacaccagagguggggggugcuucccuggguggggaaggagggguaccuggggugguggcugcucuuggggguaagcaccggugccaguguguguuggggggugccagggacccaggcaggugcuggcgccgcggccucugugucagggccucuuucccuaggggcacacaggcuggaagugcaguccugguugagcuuuccuaguuuccaggucgggggugaggcacaggacauggccggcucggccccuuccucuccauccuguccagcucagccccuuccuguccaucuugugcggcccagccccuuccucuccguccauccuguccggccuggccccuuccucucuguccugucuggccuggccccuuccucucuguccauccugucuggcucggccccuuccucuccguccuguccagcuuggccccuuccucuccaucuuguccggcccggccccuuccucuccaucucgucuggcccggccccuuccucuccgucuguccuguccggcccggccccuuccucuccguccuguccagcucagccccuuccuguccaucuuguguggcccagccccuuccucuccgucuguccugucuggccuggccccuugcucucccuccguccuguccggcucagcccuuuccucuccguccugcccagcccaccccggucccuuccgcagcagcauccucuccagugcacugugugcugggacucaagucuuggcucuuccaucuucacccuuugugacuuggggcagcaauugcugaccucccugggccucggucuuccuguccgugaaagggacuugugagcaucucucacagaacaccugugaugaaggaagggcgucacaucuuggaucuucuuaaaauacaagauuguuucuguuuuaauccuuuguguuccuugugaggugcugcauccagaggaaaggagaaaggaaaugaaaacucugcggaaaauccacaggccuggcaucagccucccagucugauuuugacgcggcuguaggggagacacagcaacauucuaucccccgagggcacagcuucaggaacggcuccgggccggagggcaccucucgccuggcuguguugugucucagggcucugcgcuucuaaagggacucaggccagugggcagaacugugggaugggacugggaggcuuagggggugaggguguaagcccugugccucccuccacgugcugcguccggcaugccacguccccucguccagcccucugcugcccccuccacgcgcugcguccucugugcuguguccucuuguccagcccucugcugcccccuccacgugcugcguccagcgugccguguccucucguccagcccucugcugcccccuccaugcgcugugucccaugugccguguccucucguccagcccucugcugcccgcugcucucuuugggacuuccauuguuuccccuuccccuuccuuuccugguuuucuucccuagugaggugcccuuccugcugcugcagggcccugcuguggccucugccuuccgucccuggcgguagugagacuggcugagacccaggggaagcuuggagacuguccuagauuucggagauggugguacacaggcuugcuggcuuggguuagggcucuaggcccugccuucggguugucuggaagccgccagccaggccuggacaccucucugcccccgucaccucggagcagcagcccaggagcgggucacagcccuuccccuguguuacauggucaccugccugagaaccccugcaggccccuguguuuugggaaguugauuuaacugaacagagcgcagcugagaaggggcgccucccuccccacccacccucauugccugggaccgcguguccaggagccgggccucgggugucuggucucugggccacacaggcuaacauggccaagcccagcugcacccccgggguccucacccgccaugugccuguggucguggccaaggucugggcccaaccugcucugggcgcugugggcaccgcucagccauuuucuacagguggccgaggagacauuugguuucucauuaaaaagaaacaggccgggcgugguggcucacgccuguaaucccagcacuuugggaggccaaggugggcggaucaugaggucaggagaucgagaccaucuugucuaacacagugaaaccccgucucuacuaaaaauacacaaaaaauuagcugggcgugguggugggugccuguaaucccaacuacucgggaggcugaggcaggagaauggugugaaccugggaggcggagcuugcagugagccgagaucaugccacuguauuccagccugggcaacagagcgagacuccaugucaaagaaaaaaaaaaaaaaaaaaaaaaagaaacaacccugagaacaucagugggguuuuacugacugugucagacaacucagcgaugcagagaaaugaaaguggaguugauuuggcucuuguggugagauacagccaagguguaugagagaauuuggggaaagcuuucuuucuggacauuuguugacguugaugaguaguggagggcuuuauuuguaaguugaagucugagauuugucaugccaauaccuaaauuuuaauuuguuuguacaaauaacgccacaauuuaauucuuuuuucuuuuugagacagagucuugcucugucacccaggcuggagugcaguagugcgaucuccgccucccgaguucaagucauucuccugccucagccucccgaauagcugggaucacaguugcgugguaccacgccuggcuaguauuuuguauuuuuaguagagaugggguuucaucauguuagccaggauggucuugaucuccugaccucgugauccacccuccucggccucccaaagugcugggauuacugggauuacaggcgugagccaccgggccgggcccacgauuugaauuuuuauggaacuggggcuaacuuaauuuuuucagacgagugggaguagagcaaacggccccugucuguugccccuuuuuccuaccaaggccccuccaggcugucucuugccuggugagugugaggagaugggugggcgcggcccugugggauggugcucuguggcagggcuggcaguuucuggguguguggccuguggguagccuuuguacugggcgcacaguccccggcuccucccuuccaacaccuucgcccugagcggccucggaaauggggcuucuggcggcucugcaggcaccgucagagucagagggagggcgagcggcuuuugguuucuguuuaaacagcguccugucgcucccuccucuccugugcggauuggcgcugcggcuucuguguugagagggaaacuugaaacccugagcuauguauggcuuguuuugucuuugauugggaaacccaauucagguuugugaacuugggccaaguuuaagaauucccacaguuuucuucagcuccucuccucccugaaccccgacagcgaggugucuuacgcuucggcauucucacucgccugacucagacuuguuaguuuuccagagcaacucauguggccgccgucuagggaguuuauucagagggugccucuacaugcacagcagccagguacagaagucaugaguuaaaucgcacaaggacaaguaaaaugaaaaaaauuagcacucagaucuucuuuuuuuucaugcuacaaaauaacagugaaaaaccuaacgaugaaaauagaugcgaacagacaaaaggucaaugggcuugaucccuucucauccucucuccugugucuccuggaggcuucugcaccucugugucuucccccgcucugcugcgucuucuccaccucgaugucccccucugccugcugcgucuucuccaccucgaugucccccucugccugcugcgucuucuccaccucgaugucccccucugccugcugcgucuucuccaccucgaugucccccucugucugcugcgucuucuccaccucgaugucccccucugccugcugcgucuucuccaccucgaugucccccucugccugcugcgucuucuccaccucgaugucccccucugccugcugcgucuucucaccucgaugucccccucugccugcugcgucuucuccaccucgauguuccccucugccugcugcgucuucuccaucucgaugucccccucugccugcugcgucuucucaccucgaugucccccucugccugcugcgucuucuccaccucaaugucccccgcucugcugcgucuucuccaccucgaugucccccucugccugcugcgucuucuccaccucgaugucccccucugucugcugcgucggggcugccuaccgggcuuggucuucagggccacuguuucuccucagcuaaguccugagagucacauuuccauccauugcagugaaaucuuuuccuucagguauuuccagaccuugguuuuggccccuuuucauaucuuccuuguuuccucgcugugguuuucauuuccccuuucgucuccuuaaccuguuuuuugauggugucuuuuuagguuaucucaaguucauuucaagcucugaaaguaggaaguaaaguaagaaccgcguggcacuagcaaucacuaggcauuguuccaagcacacggauaaacugagaauccucguggucgccccgggggugggacugccauuguccagagagaccugcuuuugccuguggugccacacgggucccucucacaggaugcgaccaugguggcuuugcgucaugucaccucagccaggcaggaccuucugcuggaacccccuucccugguaguccucggagagggcugugcacaaucuggaggcagaagcgaagcaguagcccccgugcgcggcagcucuugaggcugugcugcuguuggcugugcuguuguuggcugugcuguuguuggcuguuuugcuguuggcugugcuguuguugccugugcugcuguuggcugugcugcuguuggcugugcugcuguuggcugugcugcuguuggcugugcuguuguuggcugugcuguuguuggcugugcuguuguuggcugugcugcuguuggcugugcugugcugcuguuggcugugcugcuguuggcugugcugcuguuggcuguguuguuguuggcugugcuguuguuggcugugcuguuguugccugugcugcuguuggcugugcugcuguuggcugugcuguuguuggcugugcugcuguuggcugugcugcuguuggcugugcuguuguuggcuguguuguuguuggcugugcugcuguuggcugugcuguuguuggcugugcucuucugcuguuggcugugcuguuguuggcugugcuguuguuggcuguccuguuguuggcuguccuguuguuggcugugcuguuguuggcugugcuguuguuggcugugcuguuggcugugcuguuguuggcugugcuguuuugcuguuggcugugcuguuguuggcugugcuguuguuggcugugcuguuuugcuguuggcugugcuguuguuggcugugcuguuguuagcugugcuguuguuggcugugcuguuguuggcugugcugcuguuggcuguccuguuguuggcugugcuguuguuggcugugcuguuuugcuguuggcugugcuguuguuggcugugcuguuguugguugugugugcugaccccggacccccuacaguauggcugugcauggacuggugauuuggcccccauggccucaucagcccugauccaucccugcauugaauucguauggggcuuguggugagucuggacugacucagcuuucuaaaagcugaaaagcaaaaguuaauaggucugcagagauaaauggacagacccgguauccuccugagagcucaaaacaccucccaauuauugauaacuaaauauguaguggagauauagauauguauaaaacgcacauuacauacugugugugcacauacaauauuucaacagcagaggcgacuggcaugauuccauaauugauacagaaccguguagcuagccguuggagaauacacauuuguaggcaccugaggaacauucacagauauuacacagccaggccauaaaacaagucucgagacauuucagagacucacuggcggacagaugguauuccaugcucacaaaguaaugaaauuaaaaacuggauacagaauaauaaaggaaaggugauaauuuuuaguuagaagauauacaaauguguaaaucacaugagucaagucucaggagguuuuaaaauaaaaaguuaaaaaaguuuaaaaauaaaaauaaacagucacaaaauuauucuaucuaaaauuuugggaugcagcuaaggaaacuuaaaccuuuaaacaggugugacgaaauuguggccugcaggcccaguggggccucagccuguuucuguacagcuuuggagccaagaaggguuuucacauuuuaaaaauguuaucaaugagaauaaacacaaccaagcagagucugcgauguggacugcauguggcccacagggcccgagguucucucuggcccuggcaggaaucacuuggugacucggccucagacacguguacagaaaaggagaaagguucacucugcacagggcgggugggaagagggcagugagcagaacccuagaaaugaaggagguggaagacaaagaugagagaggacacacagagccaaacgcagcucuucgagagggcugaugggaccaauaaacgcguggccgacgggcagaaagcaggagccuuacacacggaagggagcccucgugcagccaccguggagauggaaaauggcauguuaagaauaucuuuugccaggaaauuugguagcuuaggcaaaauagacguuccgagagaaauguaauuuaucaaaguugacccaggugggaauagaaaagugacuccucacugcuucagcgcaucugcuuguaagcgggaacgauuacuguugaccccauaggauuuuuaaugauuuuguugagacgcaauucacaugccauucaguucugucauuaaguguacaguucaguggcuuguaacgcauuugcagaguuuugcagccaucgccacagucaguuguagaacauuuuaccccacgcuccuucgcugucauccccaacccccccgacagauggauaaacccccccuccuagacaccacagauggguucucugugucuacccauucuggacauuuccugugaauggaaccgugcccccugugguccucugugguggcuccuugccccgagcguggcguuggcgugguccgugggcgaugcagcccccagcagugcuccuuuucuuuuccuuguugaagccuguuccaucguguggcaucuuagucagcucaggcuguggaaacaagucaccacagaugggggcucaagcagcacaaauguaucccucacaguucuggaggcuggguguccaaggucgaggugccagcaggcucggcagcaggcucgguuucuuccggguuuuccugggccugcaggcgcugccuuccugcugcgugcucgccguucggucugugucuugguguccuuguuuccucuucuuaggcggacacuggucauagcagauccgggccccacuugcguggccucauuuuaccuuacgcaucucuaagggccacaucuccagauacaggcacucgggggcacugggguuaagacuucaguauguggauuucagggagacagaauucagcccacgacguacauggaggccgcauuuuauuuauccaucugucaguugguagacguuuggguuguuucccacuguaggcugcugugaauaaagcauucgugugugaguuuuuguguggaugugguuuuugucuuggguauaggccugggcuuggagcauaggacuguucggaaaguuaagggaaugaacguauucagagcucagaaccgugucuggcuugcgaugcguucuguuuugagguuagugaugaugauggagagcggcucccgaggacgagagcucgugauggagagugccucuuuaugcccgaugugaauguggcuacucagcuuucucucucucuuuuuuuuuaaauuaauuuauuuugucgagacagguucuugcucuguugcccaggcuggagugcaguggugugaucauagcucacugcauccuugaccucuugggcgcaagugauccucugaccucagccuccugaguagcuggaaccacaggcaugugccaccacgcccagcuaauugucguauuuuuuuucuuuuucuuuuuuuguaaggguaggguuuugccauguagcuggucucaaaguccugggcuuaagcaguccaccugucucagcuuccuaaggugcugggauuacaggcuugagccacugcauccagcaacacccccccuccuuuuuuuuuucuguuuuugagucagggucuugcucuguugcccaggcuggagugcaguggcucacucacggcucacuguagcuuugaacucaugggcuagauccauccccugaccucagccucacaaguagcugagacuacagguguuugccagcacacccagcucauuuuuucuuuuuuuuuuuguagagacggucucaccaucuagcccagguuggucuugaacuccucgccucaaaugauccucucaucuuggccucccaaaguauugcgauuacaggcaugagccacuguuaauggccccagcuuucuuuggguucguguuuucucaguguauucuuuucugucuuuuaauuuuuuuauauucuugcauuuuagauguauguugaguaaaaaucuaccguaugugauuuuaagcuggugaguuuaguccauuuacuuuacugacauguuugggugucuuugucuuauuauaugaauuuugcuuuuucagauuuuuuuuuguuuuuaaaaguugugguuccuauugggcccccaacccagucccauuccacaucuucuuccuuguugguuuggaaucaucuauucuguuuccuguguuucuucaggggucguauucagcuuguaccacgaauauucagagccaacagccagcuucuuagccuacccuccaaguaacacacagcacacccugaccucgaucacuuuccaucugacauauuugacauuguugaguuuuuaguucuucuuguuuaacauuagacauuacagguugagcacccugaauccgaaaauccaaaaccgaaaacuuuuugaaugcugaguugacacucugcaggugaugggcugcagucaaaacacagguaaacaacacacaguugauucagcaccccaaggggaaaaagauccucccagcccccuucagcuuugauaaauccuuuccacauaagaccagguucccucaugcaagcacguccacaaagggcgaugaaaugucgggugcaggccggacgcaggcgcugcaggcuccuuaugaggcuccacaugggcgagaccugugcgcaccgcucguguguuugcguauccucugcucugugguguacagauacuguugaaaacaucagaaaggccugcagguuacuuguauggggguguacagauacuguugaaaaugucagaaaggccugcagguuacuuguauggguaacaguggucagaaaaggggcaagcauucacguuugcaugucgcacagaaagucagacugcuggggggagcugggcagcaguguaagagcacggugcuggagugagugccagagaugaccuaagaaacaggaggaaugguugacguucugugcuggaaacgaugaccagaaaaacccugcacaaagcuacacgugaaauuucuaucacguauugaaagaguggaucugucagcaucgcaguggacacaagccacuuaacagugccaaucacaagacaagcaaagcucuguguaaaggcccugaucgcauucaugaagcucuguccuugggacucaucaucuacgaaaggccacaccuccuaacaccgugcucuugggagugaggauuucagcaggaauucuggggaacagaagcauuggggcgucgcaucucccuguggccuuccucccuguggccuuccuccgccugccagcugcccccucacccugcuguccaccucacggaccccucuucgccccauaugggccacuuuggcccccaccaccccuuccuggaugugcagacccuaugcggugccaccugaugcuucaagacugaauuuuccagaggggcagggaaagguguuugcuuuuuuuuuuuuuuuuuuuuuuuuuuuuuuuuuuuuaauuuuuuagagccagggucacucuguugcucacgcuggagugagugccaugguguagucgcggcucacugcagucuuggccuccuggacuaaagcgauccuuccaccucagccucccaagucacuguggcacuaugggugcaugcuaccgugcccggcuaauuuuuuuuaucuuuugaagagaugggaucucacuauguugcccaggcuggucacgaacuccugggcucacgugaucuacucaccucggccuccugaagggcugggauuacaggugugagccacugugccuggccagguguuugcucuuaaaaagucauuucucucuuucuguguguauuuguguuuugagguaaaauuucacauaacauaaaaauaaccauuaacuuuaaagugaaaaacucagagcauuuaguacauacccaauguugcacagcuauuacuucugucuacuuuuaacacauuuuugucaccgaaaaaauacucugguguccauucacauagucaugacacaucacgacacaugacuguauucccaaccccuggcaccugccaggcuguuuucugccucuacguuuacuuauucugagaauuuuauacacauggagucugcaaugcgugacccuuugugccugguucaucuguauuguagcaugugucaggccuucauuuguuuuuauggcugaauaauauugcuuuguauggguagacuccccccccacuuuuuuuuuuuuuuuuuuuuuuuuuguagagacagggucucaccaucuagcccagguuggucuugaacuccuggccucaaaugauccucucaucuuggccucccaaaguauugugauuacaggcaugagccugaaucugaaaaagcaaaauucauauaguaagacaaagacacccaaacaugucagugaaguaaauggacuaaacucaccagcuuaaaaucauaugguagaauuuuacucaacauacaucuaaaaugcaagaauauaaaaagauuaaaaggaaagacagaaaagaauaugcugagaaaacacuaaccaaaagaaagcuggggccaguaacaguggcuuaaugccuguaaucacaauacuuugggaggccaagaugagaggaucauuugaggcgaggaguucaagaccaaccugggcuagauggugagacccugucucuacaaagaaaaaaagaaaaaaaacagacgccccaaugcuugcguuccccaaaauuccugcugaaauccugacucccaagggcacaguguuagguguggccuuucguagaugaugagucacagggacagagcuugaugaaugcuaucagggcccuuacacaguugacggacacuuaaguuuucccaccuuuuggcccuugugaagaaugcuucugugaacguuugcguacaagugucuguuugaaucccugucuuccccuuuuuugggugcgcauccagggcgggaucgcuggaccgcgugcggacccucgcugcgcauccagggcgggaucgcuggaccgcgugcggacccucgcugcgcauccagggcgggaucgcuggaccgcgugcggacccucggugcgcauccagggcgggaucgcuggaccgcgugcggacccucgcugcgcauccagggcgggaucgcuggaccgcgugcggacccucggugcgcauccagggcgggaucgcuggaccgcgugcggacccucggugcgcauccagggcgggaucgcuggaccgcgugcggacccucgguguguuacugaggcguccccaagcuguuuccacagacgcugugcugcccugcauucccaccagcaaggcgcagagcuucugguuucuccauguccucaccaacaccuguguuguucuuuuuuaaaaaauuauaaucagccucguaggugugaggggguaucuugugauuuugauuugaauuuuucuuaaugacgaaugacacugagcaucuuuucaugugcuccuugguuguuuguguauuucucuggauaaaugucuagucaaguccuuugaccauuuuuaaauuggauuguuuguccuuuuguuguugaguuguaaagcuguuuguaucuucuggauauuaaacucuuaucagauauaucauuugcaaguauuuucucccauucuguugguugucuuuuuuuuucuuuugauaaugucuuuguauugugucguguuuaauguaaacauuucaccauuguuuuaauucccucuuuucaguucuuuucugugugugugcaguuuuugggugugugugauguguacauacacacaugcacauauacaggugucuaaaaaguauuuuguuuuuuuguuuuaaauauuugacacuuuuaaauuggaguugagauucuguauggaguaacguauuguugaaugacaggaaaguaugaagcuugucggaguguuauuacuuggcauagccacaggagccauacaaaugauacaaccuugcugcuugugucucaugguuuuuuuuuuuuuuuaauuuaauuuaauuuuuuuuucauuuuuuuuuuaaauuauacuuuaaguuuuaggguacaugugcacauugugcagguuaguuacauauguauacaugugccaugcugcugcacugcacccacuaacucgucaucuagcauuauuuuaauuuguuuuaguuuuuuuuuugaaaaagggucuugcugugucacucaggcaggaguacagugguaugaucacagcucaccgcagccuugaccucccaggcucaagcgauccuccugcuucagccucccaaguagcuggugcuacaggggcacaccaucauaccuggcuaacuuuuguauuuuuuuguagagaugggaucucccuauguuguccaggcuggucucgaacuccugggcucaagugauccucccgccucagccucccuaaaugcugggauuacgaacaugagccacugugcccagccagccuuuguuguuuuugaaaguugaaauucauguuuuuggaucaaagcuaagcugugacauauaaacaugaagugaucuaguuagguuugguuauacaccaugugcagaaagcaaccucuucaugaaucuuuuaaugaacaucuuucuaccuggaagaaacccuuuaccuacuaaacuuacuuucacaccuuccuaauuuuguugucuuccguguuuuugcuagcuccaggccuauucggcauuuaaaauaaaaugcagguuggccagucuggcugggcaguucuacagguacuacggcuggaggaucccaguugacuugaaauucagguuuugcuugugaaaguagcuggcuggggcuucuguugaugacagugcuguguggacggccugguucgcugggugugccucacagacacaggacacuuuuuaggguugcuuuugaaugugccugaggugagguuccuguguuuuccuuguacuuaccuucauauuuucugacccuccuguggauggaaaaucgacugagugugugaagggccugucggugugaacgggcccugcucagccgguccauggcugucuuaggaucccgcuugguggcgaggagggugcggcucguggguggcugccuggggcuaccccguguagacuugcugggacuuugucuagacaagagaacugcugucaguggcgcuuccugcggggggaugagugcggcucucagcgccucuguggggcugggggucuugggccgugaggccggggccaggcugcguggcaacccugagucccacccucauugucuuugcucggggccccgagaggccauggggagccugccggcucuguguccuccccgcacuggcuuuuagggaaagagagucucgugggucauccggccugccggcucuguguccucccuacacugacacacuggcuuucagggaaggggagucuugugggucgucuggccugccggcucuguguccuccccgcacuggcuuucagggaaagagagucucgugggucgucuggccugccggcucuguguccucccuacacugacacacuggcuuucagagaaagggagucucgugggucgucuggccugccggcucuguguccucccuacacugacacacuggcuuucagggaaagggagucuugugggucgucuggccugccggcucuguguccuccccgcacuggcuuucagggaaagagagucucgugggucgucuggccugccagcucuguguccucccuacacucacacacuggcuuucagggagauugggccuuguguguccuguugggugagcagacacacaagcugugacuucagggcuacggaaguugcucugugguuuccggcacugcagacuccaagugugagcccuguagugaggacaaagaguggagguuggaguucagaauuguggacaggcuccugaggaccagcagaggcuggaggccagggcuugcccgccgggaguguggcuguggaaagauuccaguccacagugggggcugcugcccagacucacccugaauaaagugucuucagagccaccuguccugccuguucauggcagugacccagaaagauucaucagugggcggugaguugggaacagaaagaaaacccuugagauaacuggguuggagacagggagcaggcuugucauugugcacuggugacauggccuuuggccuccccagccgucuggccugggccucgugguccugcucuugggcuucauguguccuugggugucagcuccagcauggcguccucugggcccugcugcuucugaagugccugugccagggacacugucuuggggccaguggaggucugaguaugggggcugggaguccuaggcagugagucauggcagaacuggccccugacuuccugguuaagccuuuaauucucccgaaugccuguuuuugcuucuuucaaguuguugugcuugagccacucugucauuagcugugggcguuccgagugccagcgcacaguguugagcagagcggguaggagcgcccuggcuucagggagggcccccgcccccugcauggcggucacgcugcgcugagcguccccuccccucugguggccuuucgcagugguggaggggcaggaacugacuggcucuuuucccugugguggcugcucggguggcagugagcggacagcgagggggacagacacagguggaaggaaccacgguggguuucauuaacaaugacaguggcucaggagauccugaggcugauuaauuugcaaacagcaauuacuugggauugcuugaaaagaaaguucuagcuuagaacaggaaccugaggagggcuggccacacuggaauccagugcccacugugacaguggagagccagcagacgccacuggcuuugauggaugauggagaggguccuggugucuucugccauuugugggggguccuugugugcuguguuugcaggcaccaugggucucccuggacgggguucgguuccaccccagcgcccuugucuuguuucaucgcccguguccgggcuguguaagaagcauguccauuugucccgagcggagggucucugccccgccccugagggaggccaggaggcccuuguuggaugcucuggcgggcggcacugggacacggccauugcacccggcccuggacacagggcggccaccgcauccggcccuggacacaggguggccagggacuuggcggggggagcucuucagaaucugucacaugcacgugaaugcuuuauggcuuugguauucuucuguuuaauuuuaguaaaaccgcggcccguugcaagaagagugugggcguuggcagcuuugucccaggugcugcaggguugggguggucccugucaccgccugcugcuggugggggucagcugcacggaugcacggccucgcaccagcggcagccccagaggccaugcauagggcaggccccgguggucagggacccacccaguccugccaggcguugggcuugggaugugcggccggcugggggcacacauucaugccgcagguccccgugagucugggccgugugccuggcgagcccugaauuccaccucacgucagccgcugguucacgucagccgcugguucacgucagcugcugguucacgucagcugcugguguugaguguucgcaugaugcuuuucuuucuugggggauggaucaguggauggagaaauaaagcugugagggcauaaaaucaauguuuguuuauauugauaaucaucccuuaaacucagauccaggggcgucaagagaccugagcccggccccggugugccgcgcacuggccauguguccggagagggcugugauugcggcugucagcccuguccauuggagcugcagcuugguaaaugcacagauggauuuugagaagguuucccucuaaagaugugggagucuuugcaccucaccaagcugugcugguguggccguggcacauaccgggcuuuuuacgucucuucuagggagugagucggugggcauaggauggcuaagguaugggaauuuuaauagggaauuuucuaguaaaugguucuguuaguauuacagcuuauuuuagaaaguaaggugcuuucauagagaacguuuaaaauuauuaagagguagacaauucuuuuaaaaaccugaaggucuuuuuuuuuuuucuuuuuuuugagacagagucucgcugucgcccaggcuggagugcuggagugcaguggcgcgaucucggcucacugcaaccuccgccucccagguucacgccauucuccugccucagccuccugaguagcugggacuacaggcgcccgccaccuugcccggcuaauuuuuuguauuuuuaguagagacgggguuucaccguguuagccaggauggucuugaucuccugaccucaugaucugcccgccucagccucccaaagugcugggauuacaggcgugagccacugcgcccggccaaaaccugaaggucuuauauuguggugugaguuuauauuuauuuccaucauuuuauauuugucagauuuuuaugcaggggggcugcauaaugucucccuggagagccucagccucuguggaagaguugggucaggagaagccucucggcggaggaagccggagggagaagccucucgguggaggaaccuucacccagagaccagccuggggguccuuggcccagacgggggaggugggaacauggccuuggguucuuuccuccuugcaguuugggugaauaaugugugaugaggccuaagaggagauuuauaaagaguauaaucucucagucuuagagaaaaguguuucaaaguauggguucucagugucuguauugaaaaaauaaaaaauucagugaauggguagguuauuuuucgaucugaggguuauuucuaagcacaugauuuaucuuuagcacgggagggugaugccccgccaugucuuuuuagcuuagggacugucuucugccgugaguuggccucucugccugugcacguguguugccggccccggcucagcuguggcagaagucagucaccuguggaguuauggaaguccaggcggccaccccaggccggggccucauuccguuaaguagggccaggugucuguccucucacgcguccgagguggcugccggcgugcgggugugacugucgaugagagcucugagcugggauaucuggugacggcugccccugcuuggucuugcgguguggcuggggagaggauuacuggguggaauguagccguccgccuuuuguguugaccucuugaccucccuuuugggaggcuuauuaaugucaaaaagugaagauaugaggaugggaucguaauuucuuuguguugcuuuccaguagcccagggaccaagcugugggaaccaggccuccaugugcuggccccaccguccucguggugccugugucuguccaggcuuaguccucagaucagcugcuucaccacauuggcugcaggcuggguggcagaugcccccaggaggaggagaagcauuucuucccagggcuuuggccugugcugugugccuggaaccuuuaggugcuguggcuucgcagacccggacgcagcguggaggccaagcggugucuguacaggacccuucagugaugaggguggccaggcuccagccagguccuagggaaagcucuccgagagcgacggcuuaagcaguucugaaaaauugcaaaugaucuguguucuuggagaaagaaugggagagaagcacucacucacaauaauguugcaccuacugugugcggguagggugcaggcagugugguccagugugagcggggagggugcugguugagggguuagugcucgggacgcagccuuuggacccagugcccucccaaaacucugcucaucagugccccugagcucagcauugaccccuggaggaacugggcgccuucccuggucucagacuguaagccuccucgggaagcagcaguuggcuccugaugcagcuggccucagauccuguugggagagcaggauuggugaggaaccuggagaggaguaggaggugcugccugauagcagaggugggugaugggggcagagaggguagcaggggcccaguucaguccugucugguuuucacguggagcuuuuuauagaguugugcuucucaagccuuucaaaugccucacagcggcaguccgacgugcagucagugacagcugaguagauuaccacccucaggacuaaaugcaaaaucaucuucacugggugcagcauuuacaguuuuggugcuggaaccuccuaaccaguguucuuaggggcugucuuaccagugaagggagcugccugcuguugacgcuccacaggagguuugcggcauggcugccaucuguguuguggccugggacuuucuuagagaguggguaaaagaugagucaucucuugugugauuuaucagcuucacuugugcuuccagggcucuuugaagcgucucacuuuuuaauuucaugaagaaacaaauguagugcagagaacagaaagcugcugugugaccugcgggugcccagccuguggggcuuccucaucgcccccauccaggcagaucgagugccggcucucugugcucuccaggagguggccuuucacagcagggacguucugugcucuuauuuuaacaacuguaagaaucugagcuuggugacaguugggugacccgggcucugugucuucguguuggccagggugugucauacaccuggccuggccugcgugccucacgugugguggggauuugugacuguccccagcaccuugacagaggguccuugacucugcgacccugcacagugggugguggcaggugggaucuugguucacaggcacagguggggagaguugcugggccagcguggcugggugacuuuccuguggaaagagcgggcuuggggcuuggugcgugaucccaccgaggccgggguugugcuuggggcacugggggagagcagagcaggugaugcauauccgggcgcccacccuagcagcacaggaagggcugggaucaccacuccccggggcaccguggggacagcgggggccugcucacuccccggggcaccguggggacagcgggggccugcucacucccuggggcaccguggggacagcgggggccugcuuguguuggggguggggcuccuugccccccaagggcaggccgagcaccaagucugugcuugccccacugugcagcguugcaggugcagcagacaugaggccagcugcugcucccugcaggcagcugagggccucugggaaggcuucucuacaacguccugugggaacuggaaacccagaugucaguggaaccagguguucuguccaucacugccucuuaccuccuagcaaauucaacacuggcguuuuuuuuucugagcaaguugagcugcauuuuugggacaggagccauggcugugugugcuggugcugaagggagggucugcagggacggccacacggauggcugugugugcuggugcugaagggagggucugcagggacggccacgcggcucucgggagccguuuccugcgcucgggcucugcaccggcaggcuccacgcugagggucccuccacauccaccccaucgugggagggaggcucagugcucugcaggggccugagcagucggggagacacccccugcccacagccacccucucugggcuaugugggaggugcccacguuuccacgccuuccucguggaggguguggcgggcugucugugccgcggggguacucggcugcacugugcacagcccucaccgcccagugccgaaaugggaaggccugacagggcgaugcggucugcaccagcuacaucugcagaaguccagcacgaugcaguuuaugccuggcagugauguuuguuuuuaaaauuaguaaaaccucauuaguuaucagaaggcguaacuauaugaugauuuuuuguggagggauuauuucuaccuuuugugcagagaaugccuggaucccuucugccccuuggggucacauauugcaguggggacuguggugcucugaggguuaaguuguuucugucaccuggaggcugcuuuuuccucaggcaauuggcguucaacaaaugacaggcugucuagagagaaggguuuuucaauuacauggcuggaccuggguugccaaaaggaagccuccugggguguguucuauacgcgacaugcauuugcuguguguaauuggaaccaugagaaagguuuuuguucagagcuauuggauaguuuccuuauuuuaaaccuguugaaucuggaaagaguuguuuuugaaauuuuuuucugauaauaacguuauauaaaaguuuauggcagaggaguuucuguuccacacgccccuccccgagcuuuguggucgcccaggugccuggcugucaaggcuggccugucccuuguguucagggucccgagaugucagagcuggcagcccaaguccuccccuuuaucccgagcaggagaagcaguccucacuccauuuuucaccccaggguauagcagcaccuaccacccugggaugaaucagagccaagaggcuugguuuuucuguucuuguuaaggaaauugaucaucucacacccucucaagcuguuuuacuuugugcaaaucagauuccuuucuagggaccugcgaggagaaacauccucagcuucuaggacucccggggaugccgucagcagccaggccuuggcagcugccgcuucaccugugcuggcguguggggcccugacgucucuugcgggugucauggagcaggauuggagguuucugagcagcaggagggcaggagaaaggccccaggacuuugcgcuguggccuggccuggaaggaggcuggcugggcccuucuggaugccuguagcagcacugccaccugggcagaggccccagaggccccagaggccgaggcaggcuuuguucucugcugcugggacucagcccugcgggagcacagggaggacagcuggaagcccagccccucuguggcucuguccacagcuggggacagcaguccagugugcacgggccacccacagcccucucaggaacuggccucuucucuuuaagacagaggagugcgccaggugggccucuggcuggaccuccuaggccaucaguuuucccagcaggaagugcugaucagacugaaggaaggccugcguguguguguuggcccagaugccuguuaguggacgcugugucugcacagcugucucuggguggcugauucaucccagcagcugacuacgauggugcuaaagagaaccaucuuacacggacuuggggacagaaaccugggcuccccuaccgaggucagguccuggggguguggugggaucagcucccccagcaccuccguggccugggguggggggucuguguccucccuugggggcuucucacagggcugccaagcaguguccaggugcaugcguugggcgugcaggaggccugaggccauuguccaugcuggccacugccacucgcgguugucuguugggagucggucuguccaguggaugaauaaauugggacucagcgguuugcacccagaugcccgaggcuauggaguugccggguggucgugccuggggcugccuggagugguguugcagugacugucccuggggaucuggccuggcagggaugccacauuugggcagcgcuuuccucuugaaggugccacagccuguuaguuuugauguguuggccacgaacaggcugcccuguuagcacagaaagugaacgugagcagugcgagaaggcucagaguggacuuuccggggcaaacaacugagggccuuuugggcgucacagauuugguuuaguucggaucgagguaaucaucuugaacccgcuuauuagagucaguggcuuuuucugucucacagccgccuucuuguuugguuucgcgucucacaugcauucugugauccucacugacuuuuuagaaggaaaauguuugacauuuacaagaagugagagauacucuugcaaaucauccagcaguuucugguuugcagauugauggcagcccuggccuuuacccucagugccuccugccggugauggugcugccggcucugaccugugugaggagggccuuggagagcacaggucccccagggggaggacuccgggaggugcuuugcgggagggagucauggccgagagagggaacgcagagcugccguguguggccgugcagggccuuccacagugaguugugggguccugggggugagagcugaugguggucugaccauggugggaggugguccgguccuguagaggcguggcugccgcaguuggggcgggcucugggaauggcgcggugucuggauguggaggagugaggaggagccggcccugagcugcacccaaggagagggcuggccauggcgggggcaccacaccggaggacagcucuucugugggcacugggcuugaagaagcugcagcgcauccaggugggguguccugaggaaagguggcuuggagaggggugggccccugccuggagcccuggcaggcuggggagaccuuggugucuggcagggaccccggaauguccugcugcucccccgggccucugugugcagcgcccugcgucguggcugggcugagaggaggcaguuucccuagccccucacucuggcgaauuucacauucuugauaccacgguaucuuugaacuuucuauuuugaggaaaguucauuuuuauguaguuuuaguaaguguauaaacguaauaaucuuauuaaaaguaaucaccauauguauauaaaauacacugugcagaaacauccauuuuuauugcuguuuauagagaauaaaagauccuuagaugcaaaaagucagaggggaaauuugcauauaauauucguaguccuacaguuguugcuuaugguguuuugccuaagaccauuucuaggugcauuuuucugggagauaauguaucugaugacaguugcaugugcagauaaccggccucucauguauccaucccgggagugccuuuucucagacuguguguaguguuagugaacuugauuggugggugugaaguguacagacggcgugugcguggagcgggucgugugcagagccccgaacgagacccuggcgugugcguggagcgggucgugugcagagccccgaacgagacccuggcgugugcguggagcgggucgugugcagagcccugaaugaggccuuggugugugggugcuucagcgugagggccaccuggggaggagugcuuaucuggggaggcugagcuggguuggaggcuugggugcucccccuggcuccgugggucuccauugcuggcuucauagcuguguuccguuuucuuuguucagcaguugaucucaaguauuuauuccaaagcacuugaaauacaugaaccuaauaaaucgaacaaauacaguaaaacuuuagcuucuuggaacauccccauauacuuacaccacguccuaaaauccucucaugucuauguaaaaaaucggguagccuggguaacgugggaugccaucucuacaaaaaauuuaaaaaguagcugggugugaugguggcaugcuuguagucucagcuacuuaggaggcugaggagggaggaucgcuugagccugggagguggaaggugcagugagccaagauuguggcacugcacuccagccugggagacagagccagacccugucucaaaaaaauaagaaauaaaugaaaucacacuugugugaugucagauuacccauuaacccacuuuugaauggagcuggaaggauaauccacaccuaccucggauuucucugcguggcuguuuugcauaggagcccugcauggguuauucuugaagucagcacuguaggagccguggccggcuuugcauuuucauccugguucaccccagaccugcucugggcagagccaggcauccccugggacgcucugccuuugcguguccacgacaguacaauuccaggcacugccuggcaucugcgucucucccuccccugaaccaggggcgccucucccuccccugaaccaggggcuccucuuccucccugccuggcaggagcugcguuuccuugagucuccucagacucggcagaccccugggugguaucaugugcuauucugaaggagcuuuugcuucauggcacuugaaaaaaauccuuucacuggaucugaguuggugagcaugcaucuuccuuucguagguuuguuuucugaccaggccgugggucuaacaggagccccgaaccucugggugggcuccgugucgcuugcgugccucacucaucuggcaccgugaccgcgcuccggcccugagccccacuucucugaagccucacguguugcccguguggucugcuccucaccgucuuuucucuuguccuugcccaguugucgccgugauccugaaggcgcugaccuacgacgagaagcggggugccugcagcgugggcaccaacgucagggacgccgccugcuacgugugcugggccuucgcgcgugccuaugagccucaggagcugaagcccuuugugacugcaaucucgagguaggcccauucgucgagguacaucggaugcgccgugcccccugacggcgccgugugucguuuccuccaugagaggugugcacagcagaugcucgugaaaaggugaaauuacuuggccagaggaucugugacaaagccaccgcuuggaggucaagcuccuuuucugugggugagcaaccagagcagaaguguguggaggaacauucuggaggucuuggccacccugcaggcaguggauucuugggcgcaggugaucgacaaccagagcagaaguguguggaggaacauuccggaggucuuggucacccugcaggcagcagauucuugggcgcaggugaucggcacgcuggguggcgugggaggaagcaaguggggcacgggaaucgccugugcgugcucccugcggucgugggucuuggcgagaggcgaauucugucucuaucuccuuucaaguuccucuggaauacagcaggcauguuggacauggcagucuucagaugguguuuguuuuuguugaggagcuggauuuuguguuuuuguggaccagcacuugagagaauguucaguagcaauagccuucgcuggcaugccugaugucagcuccucugagauguaagugaacacuucagaaccucugggagguagggagacacuuuuucccucuggcuuccugaugagaaaacugaagccagcagguuucaugggaucaccagaaccccagaagcugugcggccuguggcgggcggggcuccugccucgguguccagugcgcgcacccagcugagccccguagugguguccugugccagggacuuucaggaucugauacuuuuugcuuaggaaacaugcaaaacauguguccccagcgcaggaaacgauucaauucaauucaaccgugugcgcugguuuuguacacugcuuuuggacugaaaugaguucuuuugugcugaagaaggcaggugcuuccuuucuuguugugcaugaaggagcuggaggcgggacaccgaggaaggcgacucagugucacuguccgucaugggugugugagcccacggcugaaucaucacaagguuucacacccgcacuucaccugacaacuuuuacuaggaaaaugaacuagggaaacugacuucagaauuaugcccaagucuuagaagcuccuccugcagcuguucaggagccgagcguccccugcucacuacaagacgccugaaggggucaugggaugcagcgucugaagcuuccaccuggaagugcacugcuccuuuuggucugggcggggcggggcgccgguggcagaugccccugguggcaggcucaggcuacugugcuggguccccucugccccgcacgccccgcgagcaccagcagggccuccccggcauguggcggggccagcguuggccuggggcccgcuuggcuuugaucucguggggcuucgucuuuuggacguccugggugcgccuccacuguggcuccuggguucccucacgcacccggguguaagcgccacugccuguguccgacaagcagcucguugugaggcacacgcugguaagcagcucguugugaggcacacgcugguguaggcuccgaagggucucggugacaggcgcuuuucucuuguuccugcccacugcuguuccaucuuaccaaauacucaguagcguccggagagggaccucaacccgguuacuucccugggugugcagcacguggccagcgucucauagucuagauucuugcaucagagcgaagccugagaggagccgaggguccuccuccuauccagggagaccguguguuucccgaggcagcugugaacacgcacgucccucuuguccugcuccucuucggaggagaacagcgcggcuggagggugcuggugcuggccaacguguuauggagaguguggcuuaccugaggccagggaggucugggguggcugagagcggcuguggccucugucugcugcucuccccaguggccacucuggcagcgcugcugggcaggggcuuggcugcugguggucuucagggagcagugccuugcagaguggagcagagaagacggagagguccggcuuuaggccccugccgagcuccugaggcccugccgcgugccugugccagccugcagcgcugcugucugugugcgggagcucuugugugugaucagccucaggaaaggcucuuccuguuacuuccuugugcugcuccugcacuucuaggaaguugauccuguaacuaggaagugaaagcaaaaaaauguaucuuucuuauuguugauaggaauagucacagaacgagaaaacuuccuuacguugauaucucauucaguuuccuuagcaacccugagaggugggcaggggccaccgucauucugguuucacugaggaagucaggacagcacugaagacaccuguccagcaccuugugcugacggcuucccagccaggcccaucaccugguggccgaaggcuucugagccaggcccaucaccugguggccgacggcuucugagccaggcccggcaccucguggccgacggcuucugagccaggcccggcaccucguggccgacggcuucugagccaggcccggcaccucguggccgacggcuucugagccaggcccgucugggcagcagcucccaggcccuggcccggggcucagcgcugccucguggcugagaagcuccucaccaccugcugugaggccguggaaagacccugaaugcagacgugugacggcugcagcugcaucuggccccucagauggugguuccccuuucauggugaaaauccucacggauuuccuuuucagccucauauuuugucuaagagcugucaacaucacugaaaccugggccugcccuucauccuggggaggacucccugguccagugucacaggaggagucgggccaggguugagggcuggcacaggacaugggggugagacgaaaccuccacucaccugggagggugucuaggugggcacggaacccagggucguguaugggccaucacucauggguucucuguuuugggggaaagcugaucccacuggagggugacuguaaugagagucuccagaucaggugccgacuuuggagaaaugcaggugcaacuguccgaacaaaucaaguccccgcuacuggacggggcuggcagcucagcuggggccggagagaaaagucacgagcaagaaaguucuuaccuaagguccuggacaggcagauacauaacuucugccuuuggcaacguuagaugucaucguuccagaguaaaauaccuauaaaaaccugccgaugcgcggggagccuggccuuggucuggguguggagggcugggggccggccggucgguagguccuggugcaggcgggccccgugcuucauggagguuggcgccgcucgguggccugcucgcuuauucuuaggccugauucacagaggcuggggccacucagugaucuguucgcacauucucaggcaugaaccuucagggcuggacuccuguucuuuugugcaguuuccacaggggacccucuugcuccagggucaucuuucucacuuugaagccccuugagccgccccugcacagccuccuguuggccccgugaggguccugacuggggcuccucuuuuggagcagcugccacguguggaccggcacgggcauggucguggucugcccagcugggugugggguugagcccaucaugcuguggggugcucccuggggguugugugugugugggucccacggugggaggugggguuggggugagugugacuucugucuggggcauguugggugggcgugcaaggggguccugggacuccugaguuucucaggccugaaggacuguaggacgcacugugggcugcaggcuugaagaaggaugugaguuucuggaguagccuggacugcacagccagggccuccccggcauguggcggggccagcguuggccugggucccacuuggcuuugaucucguggggcuuugguuuuuggagguccugggugcgucuccaccauggcucccggguucccuugcgcacaccgagccagcagcugcuggggccucagggcucgcagcucacaggcuucugacgccucagccuggagcuggcguugugccccucgccccuuuaccugugccaucccggccgcagacccaagggugcccuuggagccgugcccgccggccugggugucaggcuuguccaacggguucuuagagaaccugggccccaucccuccuuggcccacgcagacuccaggcauccggccgggcgggcugugagucaggcugcaccaggugagcgugugggaugcugcuggugcgagccucccugcccaggagcccugcgcacccggguaucgguuggggugugcccuuccagaucucccucccuugguuugucauaggugaccacauuuuaauuaccagcuuuuaugcccgucaauuugggaacgugauacaaucuugauuucucuaacuuucacaaguucuucgguggguccuguaacagugggugcuugggaucagagcaucagaguggaauuuucgcagggaaauggaaaugccugaucgagcugggcgguggcagcagccgcuccucacucuucaggugccuggcucuucugagagucaguucggggguuuaguggcucacuuuuucuaauugguuccuagcuuuuugcuaaagaaacuuggauuaacuguucuuuugccucauggugugaauuuauacuguuccuguuuuauaaauaccagaaggagcuucguagguaacuuuuaccauguguugaagguagcauugguuuugaaaaccugauuuccucagugucgcacacggguagcuuaagaggugggauaauuguuggaguagugaauggauuucccugagaagccaagugcaauuuaggggcagugacagugcgaaguuaaagugggacagagugguuauguguuaucugcaaaaucccuccuaaccaguaaucacagucuaauuugcaagaaggaaaagaaagccgagcccuacgcugcugcugcugccauuguguguccagugauuuccucaccugaaacucuuuuguaagcagcucauguugacaucagcuccgcccaggcagccacggggcccuccccugccagggggcagccucugacuuucggccuccaccucgagcaaaccugcugagcggcgcggcccagggaggauccgccgaggccugcagauccgagaucucuuccucgggggcaggauuguccuggaaaaucaggaaauggcaggcauugcucagagcuacgucuuguucucccucaccgguguugcucaguggcacagcuuccaggggaagacaacacguguuuuucaagaaaaguuaaguggccauuaccgagcagaguccuaacccugugaaacccggcaaauccugccuccacgucagcucaggugugacucgaaagcacuuaaaaaauucucguguuuuaccacuguguugauuagugugagcuuugguucuuggggguuaggaaaauucagccauaggcagguccgauaugauuugcaacuuucaaaaaacaggauggcuaaauaacaaauuacuagucugauauuuuuuaaaugucugacuuucaaaugacacagaauuauuguuucuuaagguaaaaacaguguauuuggcuuuuuauugcuauaaaauauuauauaaauaagaaaacuugagcuggggugaggucugcacuuugcuguaccugccgaaaaugaggugccuggagcuugggacaagucgaggcgugcacuuccccuugacucggacaggaaagagaaucccuuucuguuugacacagaccauuucucuguguugggaaauccuggugaaguaucacauaaacuucuccagcgaaagcaaacgggcgaggacaccuagggcacguuucagcgcagacaggccggcccuucucgcggccucgcagugucucucuccagguucccggggaugguagaugaacguggugacucacucaggguguuccugcgaagggaaacugagaggcccacgugggacguuggguguccuguuggaguaguccuuuaggaaggagcuuuuauauuuauauuuaacuagcaucauuaaaccuguuuguauuuauuucucgaugagccaguuuuguucugagaaugagaaaauagagccguuuuaauaaauguccaaaucaggacaguguuaaauuuguuguaaguccauauauaguugauuggucgaauuaacuugggagucuguguuuaguuaaaaacagcguuucucaggcguugcuguauuuucugugagguucaguaaaauauacacgcaacagcaaccauuuugacuucucauggcaggagccagcuucguugaagugggccaggcugaagugaggccagcuuugccugcugcagcccuguggucuguguccaaauugcugaguacugccgggagagggagccgggagugccugcgucuccugcugucagccggucugacugccugagcggagcuguugaaguggacugaacaacaguaaccuuagaggguuagacuuggugaggaugguagaugauuuuaaguuucuucucuuuuuuccauucuuucuucauuaaucaauguuccacacuuuaaauauaguaauuuaaacaaauaacacauuucaagaauucaguguaacaugugaccuuucaguaguauuggcuggagccggcggcaauaaagauagaagccuguguuccucuuguggcaaauguuaaaggaaaccagaaauucuugauucauauuuuucccuagaacacguggcuuuacagguuucaaaaaaugaaacucuuguucauaugguaaauaugacacacauuucuaugcauucugaaaagauuuagaauaaacugccauuuguuguuaaaaauagcaguuauauaacuuuuuuuuuuucuugagacggagucuuccucugucgcccaggcuggagugcaguggugcgaucuuggcucacugcaaucuccgccuccuggguucaagcaauucuucugccugccuaguagcugggauuacaggugcgcaucaccacccccgauuaaguuuuuuguauuuuuaguagagacaggguuucacuguguuggccaggcuguucucgaacuccugaucucgugauccacccaccuuggccucccaaagugcugggauuacaggcgugagccacugcgcccggcuguaguuauauaacuuuuaguuauuagaagaucacauucauaugucuugaucaguuuaaugauuucuaagauaucauuaacaaaagccauuaugauguauugaaauaggauugaucuuaaaacguucgugcuaauguaacgugaguucccuuuaauuuuaaaccaguauuuuucucuucuuauuuaggcuauaguuuguuauaaagaguauagagaggaaaauggagugcuuuucuguucauagaguuuuucugaaauuaaagucaaaauuuucaguuucaaguagugaaagcaguguuaacagaaaguuucccagauacuaauccugggucuuuuaagaucuuuagauaauuaguugcuuuccaaaauagcuuuuaauucugaacucauuuuagacuuaaagaagaauugcaaaaccaguggaguucuucuagacccuccacagcauucuccgaugugaacaucucacauuuggaagccaggaagugcagugugggauaaaggccacuaacaggcuggucugcccgggaccccgcauggcaucuggugguccugugcccucagccuccucugcucugugagcuccucagucuuuaucuuucuugaucuuggggcacuuaaaaaauagguuuuauugagaugaauucacuugccauaaaauucaccccuuuaggguccacaguucagugguuuuuaguguauucucagacuugaggagaccucaccccagacagaagccaugugcaccaggucccgucacccgcuccaagccuggcacugccagccugcuuuccgccccuguggauuugacccugagaccuccagagacgacuggccagauguucuguaggacgccccucucucugaugcuuucucguguguuacuggaaagagugaugugaggugaccugcccuccuccgugugcuguugggcccauauagugccccacaacggguccugcguggucuggaccuugaucccuggucaagauggggccugccaggugccuccacuugaggagacuguguuuuccucuguaacuagcaguguucuugugggguacucgaagguuaugcaacauccugcuguuucuccuuugguuuucaccccauccgagcucuguccaaagaccuuguuguguggucugguggugguuccuguguccccaccccgacguucagugauugcagcuuguucuuaaggaaggcucguuccucucccagcuuuauuucaucauucgcuccugccaguguggacucaugggugcucauccuguuuggggguuaucaucuaacacuauuguuacuaguuuuguuugaguuauaaucuaacacuaacuauuguuauuaauguugcucaaauugcuccagcuuuggccacuucagguuggcuucuguguccuuucagcaagauccuguucuuuuuuuuuuuuuuuuuuuucuuuuuuccugagccuuuuuucuuuccuucuggcaccacaagaugcaccuggcuuaucuuuuugccccugccccagcccuagcauccaccacuucccaggagucucacauccucucgguggagaacaguauuuggaauccaggacgccgggcuuggccucagcugccucuagguccccucccucuguagcugagugugugccccucuucacaguccauguuugcacagacaccagcucuagcccagcuuccuccuggccucccuucgugugccgcuucugggccuacuguguagcacgcucugcugccgugcgucugccgucaugcaucugacgugauuuuggagcugccagcccacaccugugugagcaacagacucaccacucagggugggacgcucugugcauccuccucacccugggcauagcguugccaggccaucgcucgggugagcccuucuggugcugcuggucugggaugcagacaagucugccgguucccucugugcugguccgggaugcagacacgucugccgcuucccucugugcugggcuccccaggucugugauuguugcuucuucaaucugcaugugguuguguucuacaacucaagcaccaaacaggacaguccgucucccccaaaaacuccccagucugcuccccaacccugggccaacauuggucugauuuugguccugauaguuuaccauuucuggagugucuuauaaacggaaauaaucaguaggcuuuucauucuggcuucguugacuuggcacagugcccuuaagacucaucccagugaucuuuccuuuuuuuuuuuggagugguguauuguuggacggaccuggcggucacaggccuaccugucuccuugggugucuccaguccuuucuggaggcucaggggggcucaagggaagacucugcuucccugcuugaguugcccgcauuccuuugcucaugggcucuucaucuaccuucacagccagccacguccacgucucgcuucauccuucacguacccuaugccugugguccuuucuucugccuccugugucuguccuuccuucuuccuuccuguauguauuuaucuccuuaccugucuacuuaucagucugucuagauggggucucgcuguguugcccagacuguacucaaauuccugggcucaagggauccuccugccucugccucccacagacagauggagcacagguguagccagggccgcugguguguaccacuguguucggcacccgcugggcugcaggaguaauccagggcccucuccccaucuuagggucaacugauugccaaccuuaauuccccuuugucagguaaaggaacauguuugaagugggacacccuuaucuuugggaguggguauuauucugcugaagacaaggguggggacagauaugcugugaccaggguaguugggcuuaugacuuuguuguuguuuacguggaggaacugaaagaccugggugugcugcuggaugccccaaggaucuggcaggaggaggcauccaggcccucagggcagguagcgggugggccuccgugguguugggaggugcugggcccggagguaucagcaggaacugcagggucccuaccgcaggcuccccacacagugacaccugucuguccguccgucuguccacaggagcaggaggggcugggcggggaggacgcagggucugucggagcauagcaguggcccguacgugagggacuuuguuguugccgucuccccagggugcagagcguggugguuuguggccauccuugcagugugagugagcaaguggccgagggguagacuuuggauggcuccaggcggaacucggggaaggaggccguguacucccauagcucugggcucuguuuguggcuguggccacacagggcagggccucagggcagggaggccagugcuuuugggaagggccucccccagcccucagaagccucccacccuauuccccuugggcuccauccuucuguuuuuuuucuggcucugguuccuggcgucuguuugcaaggcuggcuggacacugcaaccaccugggcuugcugcuguggccuggacgcuggggucucucucggcccgguggugagcugagaagcggcccugugguagaagagggccuuuccacgcugagaccacagauugucccugcaauaagcaaacauuucucuaaaaugugagauaaacgcuuuauccacuggugauccgugguuguuaguaauuaaaccaaguaaacgguagcucauucggucaggccgcuugccgccgaugaggggugcagagcuucugcagcauccuggggaggucccggaacgugggucugggcugugcugaugcuggagcagccagcggggagagcugccaggccacuccugacagccccgcacccgcucuggauggaagcuucucgcucccagccgauacgggccugcugccugcugcuggggcuggaggggccccucugcuugagccuugggguaccccgugccuacgugcccuccuggcuuugcccaugguugguggccguguuuugggcugcguugaugucguuguggagcccgcucugggccucggcacgucugagcuugauugggguggaaaaugcaccuggugguuuguauuauguuguuucuguuuuauuuaauuucauuugccauucuuauuucaaaagaugcuuccuauguuuaugcuauauuguuaguuuaacuuccuacccuuuccaucuaugaauuucuguuuuuauugugguucucagugaccacacucuagggguccuuucucucucucucugucucuccccccucuccccuccucccuuccucccucccucccuccuaggcagagccugugagacuugcaggcauuuccccagaacccaggcccucuuggccaucuggcugcugccccacccaaccuuuggccucuccuggggcuccuggaugguugggcgucccaaauccccaucagcagagcacuuggucacaaggcccgagucacaugccccagcuucuccgaggaagugcagaguccagccgcagggaggacuuucucaaccggcccuggggccagcuguccugcuccuccuuguuugcugugggcucaccucugugggcugcucacucagacccacucgcacccaugggaccuucccaccuguuucuccugccuccuucagucugugcccagcaccccgcugucaagcccauucccccccagccccugacguuggacaugcuggaggagacuguggcccuguggcguguucugggccaucuccagggccuggagcgggcaccugugcccagcacuggaggcugggggacaagugcucucucugauaaaugcccccgaguuucaguucuguggcuguaguuuguaggucuccuagcucagcauccccgagcccaugcccuggggacucauggggccgaggagagaggagcgcagagaacaugaggauacgugagccccuugccugagaggugugcugugaaccuggagagcaaggccagugggucuggggugacagacagugcgagaugcaggaaaacaggcucgagaugcugugaaucuggagaacaagugggccugggucuggggcaacagacagcgugagacacaggagaacaggcgggaugcugugaaaccggagagcaaggccagugggucugggucugggucuggggcgacagacagugcgagacacaggagaacagacgggaugucaugugcauuguggcuggcagggccggcgccucacacacacgccccggaagucaggauguggugcugacgguguccgcgcugccaggcuggagcgggugacggugccugcgcugccaggcuggagcgggugacggugcccgcccuaccgggcuggagcggagcuugcucucucugcagugggaccugcucacuuuuccuuagcuggauguaucuuucacauuuagcuuaacagcagagcuggugagaggacgcacaccuggcgucaccauugucccccgugcauguccccggcguccuucauguugacgcgggccccgccccacggcucaggucugucaacuucccuggaacaaggcagagcacuuggccccuggaagaccuggaaaccaggaaccucggaggcgcuggcggccuuggaggccgcuuaucuccgcgugucugaaauucuguuuuccaccuuuucccuuuaggcugguaggaggcgcaaucucucaagccuuccuuagaaaggaugauuguccuccacccugccccaaacccccuguguucugugcaacgccugaugagagcguucuggguuauucacaguaacugagcugggugaucucacaagaggacauaaugaagcccaaggagccuggugggggccgggagaggccuugcucugaguguggcucgcaugggggcagcgccuuggcgucuguguguggugcggugguuuuccugccacucuguggaaggggccucugccagacgccuugucuucagggccucaggucccucugggcacgguggguguucauguguuucugcaggguuaggcucugugcauggcguggucugcaggaccuggacagccccugccccggggcauuugugucggccaccuugguuugccccccuguccaaacgcugccaguucucguccuccagggcacuccguuucugucuuuucauucacuggaccuccccaccuccugcgccgccccaccacagcaggccaggugcguucugcccccaggcccuguccucguggcucuuugauccugugcccucggugugcaccgucucguggcucucguuagaaccagggucggccacccccagcucccacauggcgucuggugucuugggggucacaugugucugucugcagucccugggugccucaagcuguguguugccuguggggcaugucugaaccucaagugggccugagucgugagagaaaggcuuucucaucgauacuguguggucuguacuguuuugcagaauuucuuuuuaauuaauccuuucucuuuuucacagugcacuggugauugcugcgguguuugaccgagacauaaacugcagaagagcagccucuguaaguuuucucauuuugauauuuccuuuccugaagguggggggugggccuggucucccugaugcuccucugugcacugcugccuggccagcucacccauccacagcaggagccgcgagggagcugcugagagugccagcugcgggcaggccacugguucuuacugucucugggcgucuucagcgugugaagggcggucaggguuaagcauccccagagcugcagccaucacugcuggggguugaugggugauggaggcgagugggaggugcccgaugacaggucuuggugcaggcagcugcacgcugaagacgcagaagagaguggguucugcgaggguggccagaauguggcggcgggacgggucacucaccggguggcuuugagccucgggaggggcuguugcgagcaguggucagcucugcuucacccgccacacucgccugggccuugcuggaugugggagcugccugcaggaccgggugcgucuugaacacagauggcugguuuccucuagagagagcccugugacguuuggggugaauucugggugugaggagcuguagcaacugcugcugcgcugagcagacuacuucauuuggcucagagcugggcuggagugaggccugugucucuugggaccacagagagcggacaguugagacgguggaccagucucaagauaagagucuuuauuucagauacagauaagacgcugaacacguuuuaagaggguaagaacagagaggcagcccuuugagaaagauggaggggugagguuggcuuuuggugauggggugggccccacaguuccucaugggcucgagcugcuggaacucugugugcaggcucagcauagcuggcuuagugggaaccuguugagggagccguucacacucccugauacugucagacuugggggccaguggaccagguggaaggggugcugggacuggugaggguuuccugucagcccugcaguguguggccccuggugagugggaccaggcggaaggggugcugggaccggugaugguuuccugucagcccugcaguguguggccccuggugaguggggccgugcaggugcaguguugguucucucucucucucaaaugcaggagcucagaugauacccugaagucuuucuagcucaaaaugucugucaucuucuauagcuucugguggucugccugcucucuguauccugaaguaguuagaagucuuucucugccucagguccuuuaaaacuagagagaauucaccaggagagcucagaagcucuucucugucccugaagcugcucuuauuuugucuucagcaucaguaaaaaccucauaauuuuuuggggaaaucaucacauuuuugcccugcuauuuacccaaaggcaguaaauguaagacuuugaaauauaauacaauuuuauguuaaaucuguacuuaaauuaagcuuuuagauuuucuuuacugcaaccuaagacauuucaugggaagcaguaauaaaauuaaaguacuuaggcuucuaugaacccugaauaugaagugaaauaauauaaaucauuuuucacauuaaaaucccuuuaaauuggcaauaaaucuuuucugauaaauaccaccgagugcaccuagcuuacccuguagcuugcaaaauuaaaacagccaaagguaaaagacaccuuuuugaagcuuaguuggaaaugugaggauugagggccucauaauugggaaucauuuuuuggagcugcugcuuucagauaacaaugucucggucuuucuggcucagcuuggcuuccuguuugacgcugugucacugggugaggucaccccugugaggcccugaggccucuucagcaccggccaggaggcagcagcaaaaggcguugaaguccugucccuccuuggggcuggacacggucccuugccccugaacucuagacgcccugcauugcccuggugcucccaugucaagacuggccgcggucguccaucccaugguuugugacccucccagcaacgcugugaggaaggugcugcagcugguucucagcauuggcaggagcauggcgacucaggcagucagugugugagugaguuugugaaaacaguuccagcuguguucguugcugaaugcugguuuuucugcauauuggaaggaaucuagcagacccccaaacgugcugacauugcaagaagacaugucucccggcggggaaggaaugggcaguagagaugggguguggucguggcuucuuguucaucaugaggaagggagauggggccccguucacucacaguuaaaguaaaggcacuuaaagccuacauuuaacugagaagauuuuaaaucuuuuucuuccagcauuucguuugauacauagugucugaccucuauuugugacuuuuuauuuugggauaauugagauuuauaugcaguuuucuccccuccccuccccuccccuccccuccccuccccuccccuccccuccccuccccuccccucccacucugucacccaggcuggagugcaguggugcgaucuuggcuuauugcaaccucggccucccggguucaagcaguucuccugccucagccucccgaguagcugggauuacaggcgugcaccaccaugcccggcuacuuuuuguauuuuuaguagagacgggguuucaccauguuggccaggauggucucgaacuccugaccugaagugaucugccugccucggcucccaaagugcugggauuacagacgugagccacugugccuggcggagauuuacauggaguuuuaaagacuaaugcagggagagcccaugcguguuucaccauugccuccaugaugaaaucuggcaaaaccgcaauggaacaucacagccuagaacauugagccaacccaccagucuuauuccuucuuccuugguuuuaccuguacucugugugugugugugugugugugugugugugugugugugcgcgcgcgcgcacgugcgcucacgcguuuacuucugugugauuguaucacauacaaauucacguauccaccaccacaaucaggauacacagcagcccugucuucccgagaggccugugcuacugcuuugcccacagucccugcuguuucccucuccugacccuuggcagccaccggucggcucuccguugccuauucuauucugucaucucgagaaugcuguguaaauggacucuguggccucuaaugcuguagcuuucuucucucggcacagcucucuggagacccaccccgagcgugguggguggugcugguuugcugcuucuguugcugaguggugccgugguuugugugaccauucauguauuacgacaucaggaugguuucuagucuuuaagcugcuguaaacauucgugcucagguuuucgugugaguguaacuuccauuucucuggguuaaaugccaggaguaguuucugggucgugguaguuggacauuuaaacugcuuucuagagcagcugcaccauucacguucgcaccaccaccugcccgcagcccugccuuucucuguccucgcuugugucugacauggccacuguuuucugugucggccuuuuugacaggcauguggugauacgucguuguggucuuuaccugcguuucugucaugccugaugguguggagcaucuuucacgggcuuacuugccgucuguaccuccucuuuggugaaaugucugcucaggucuuuuacucauuucuaaguggauuguuuuuuguaguucuugaguuuagggcacucuuuacauauguaggauucugguccucuguuggauuugcguuuggcuuucucccagucuguagcucaucuuuccguccucuucauagggcaagaguuuuuaauuuuuuaauuuugcuggggucucgaucaguuuuuuguuuuuguggcucauguuuuuagugcuuuuuaagacgugaagacuuucuuaaggucugggaacuccaccucgcccggucccggggaugcugucccguguuuucuguucugcugguuggucugcgugucuguucugccagcgcacacugugugacgggcugugcugcgaugcugcugugcauagucagccuucgcacugggcagggagaugccucccagcgucuucuuucucaggacuguuuucccuguuuuagggcuugugcuuuuccacauaaaucuugaauuuuuaaaacaucuuuuagauaccacuggaaugguacaugucuuccuaauaguguauguuaaauugauguuacaguauaucuuuguugcauugccuuuuggcggguuuuguuucuuacuuuccuaaugaauuuaucacaaaaguuacaaauuugcaaagcagcagucaggccuccucccagccugcugugaagcgccuguuuccuccaaucuccagcccagcccaggggucugccuuggagccacccgcacgucugguuucugugugauuggccagagguggugggcgcgucugcuccuuuucccuggggggugggggcacagacccuggguggcuguguucggcuccuuacuuggugcccgucugugugugcuccucccagcagccaucgcucaaccuugcucucaggaagcccccaggcgaguguuggcaggaauccugccaggcgggaggucgcuccuccagagcguggucccugaagccgccagccucccuggccucgccccuugcugguggugugugugguguggccgugggugcacuuugcugggucuuccugggacacugaagucuccugugucuccagcccugagaacucggagcccgggugcuuuugggaaggacggggcaccagcuggugacacaugggaagggaggugugguugucaccuugcccagguaaccugcucugccuggucggugcgccuaaggggggcaggguguuuggggaggacaugagaggccuccuggaagcacuucauccuguugaaguucacauuuugaccuuuucagcagcccuugcucugggccugugcccggcccugggacucggccuggagagccuauugacaccgugccaugggugcgggcagggcgcccucccuggagggcggcacguggugccaguuggugaccaugagcugccucacuccugaggaagaguguucgggcucugggcuuugauuuaaccugccugucugucucucugaguugacagccggggccuccgcgugggugcugcugggaggcucagugguaaaggccacuuuucaggaugugucugauuuuauaaacuugaauucuuaaauugugguuuuaaagagcaccaggacguaaaaacagagugacgcaccuugaggcucuguucagccaacaaugagggcuuuuauuuaaaaaauaaagccgugggucauucacguugugcuguuuguucugaacuugccucugguguuggcggaagcugaccucgcucaccugcuguguuuguucuuugcuccgcaggccgccuuccaggagaauguggggagacagguauggcugcuuucaaacaccuuuauuccaaaaacuuccugcggguuuauagguaggaaucuugagagcuauaacccuggugucuucucgcacugugagaugugguguggcuacaucaaugccagggucaugaguucacuauaggacgcacauguuaaacagcgaguccuguuucacagggaaccugcauguacaguaauuuacacacacaggccggaaagcugugcuuuacacguugccaagagccacauaauguggcucugcaggguggggcgggucccugggaccagccuggccuugcggggacgcagaccugaccccgccucaucccacacagagcaggagcuggcucuguugacgucagcuugugccucauccagaccauagacgggcccagaagucagcucccagaagcuacggaccccaugaccccacgaccccacaucaugcuggggcugcuuuugcugugcccucugacccugacaucuggucacuggucagcuucgccugugaauggggggccccagguuacucauguugugugugaugacgucacaucuugggcgugugguugggucuugcaggagagugggacagaggccggagaggggaccggggucugggcuggaccugggcggggagcaaaguucccacgagaagucagccgagaaggcucuggaguucccggacagcaaagcaaaugcagccggggucugggcuguggccaggugguguggggcggcaugggguggacgugggccugcggacccuucugaccuguggggagcccuccaggcaaggugucugaccuggaguggaagcauugaggccaaaugaguccacaggaaaagccggaugccagagucagcuggagaggcgggcggacgaggacuugcgccuguuauugaaaugguucuggaggagccuggcgugaguggugugggcggcuuucuguagacggagcccaggaaggggcgugacuacuucuugcuggcccgaggcagccgaggcccacccagcauccuuggggugccguggggccugcauguguucagagcccugagcccuggucggagccaguucacuaggaagagacaccagccuugcaaggggagccugggugugcagacagcaagagccgcccaggccaaggagaaugugaacgagguuuggucuuuugaguggagaguguggcugcugugaggaagaaggagcuuguuggaaaccacuuagcugagccuagggacuugccagcuuccuggaaagugagagcccaggagaagaagucucccugucccugggcuuccagccccuccagagcccccacuggagaggggcgugcugaggccagagcccggggugacgaccgugcugggugggcccuggggcgcacuccgccaucacucuguguuccggguucccagaugcugcuuccugggaggagcagcccagucgcauagggagccacggggcccugcagcugagcugaccagccucccuguguguguggcuggauuugagccacguuaccuuuaucggggcagcucagguuggggauugauugacagggaaaggaaaggccuuuacacuuggucuaaauuuaggcaagcagccagaaaaugggauauucccgugggugcgggagucuugcaccucaguccugagccugagcagugugagucucagagcauccugcacagugaccagcaugcggacggcagcgggagccucguggaagaagcggcacagauuuugaagagacacagacuuugaaagaaaugcaagacgcgcaggugcggagcgucucccagccccgcacggccauguccugcugagguuggauagaaacauuugagaagaaggucgagaacuuggcaaggcaaagcaaacgggaguggacgugucgcauagcacacagggaagcagccuaaaaacccucggauuuggaggaggcuguuucuaauacacagauuuggaaugaaguuguaagaaaugcguuacaguggaggccgcuggguaacagcagcagggauggggggugguuggggagcggccugggggacacagagggggcugggggcagagacgagggaccagcuucucuguccagguucgucuuggcuggaguuggagacucugguccugaguggucucugccuucucccuacugagcccaggggcucuugagcagguugugacuaacccaugggcagcuuccacguucagggccuguccgacauuccagcccuaugacccugcuccuaggcgagugcuguccaggcccccgacaccaucaggcccuugugguggccuguccacacccaggccccccacuuccccccugcacaggugaggaaguugaggcucagggcagcugagcccgcuuuugucugcucggagccuguuguuccagcccuagccuggccagacagagccuuggccccuguguuggucuugcuuuguucucaccguggggggaugcuggacacagaguccccuuguucuuguucucggugagaccugguccugggccaccccggauguuucccugggcuccugccugcugugauguggggcauggaguuguaccccagugggcgacaucccagguuguggcaccugcugucuuucugcagagugagccgcaacagcuccaccugggugcagguuucuccccuguucacgguucagugaaggaugcucaugcugucacugauugcagcagccucaggcagaaguuuaugguaucuccaucagcccaagcucccaguguaacccuugggagagauuugcuggaagaaagccgcaugguaccugcucauuccggccucuccuggugggaaggagggauguggccccggguguucucaggagugcuggcuguucaguuacguugacuugcgaagcuauuacaugaaggugugagguuuuaauggucaagugcaggguggugaugaauggguuaaagacgucaaggaaggaucugaaucccggccucggaggugggcaggcuugggagaccuuugaaaaacccugcugugguuuauagcuguaaggcuuucuaugugggguuuaaaguuugucauuuguauuuucuuaggaaauuauuuauguuguuuccagaauuucacauccuggaaccugagagugguaucaguaacaccauguaggcugcggggcuggagcuggggcuccacugggaggcugucguggcggggugggaggaggugccgccucucccaugucagagccucggcggcugcugguccucgaugcuucuggggucagcugucaccacccccaagaaccggcugggccagcugcccccagucaacgucuugccugcccgggacugcugagugaggccugggcucugguccaggcuuuguagaccgugcaggcggcugcauccccgaccugacccaggccugcucgcucuggugugcaccgaccugccagcuuuguggcacuuuguggcauggggcucaggccgauggaggucaguggcuguaacacuguugagaccugaagaccguuuacgguguauguuuucgggaaaggucucuuaccacguaccgaaguggaaauguuugaguuguuugaaaaagaugaaauacuugugagugguuucaaugauuuagcgugguguugccuggguagaccgucaggaagucagugugacguggaaguccucggcgagccaugucugugguguguggcuugcucaccaccugccucagggcucgggguucaugaguguaaaugucuguggaugugauuauugaacuuggugaaaugccuuuguucauucaaauucuucuuuuucccccauuuccacuuucuuauuagggcacuuucccucaugguauugauauuuugaccacagcugacuauuuugccgucgguaacagauccaacuguuuccugguuauaagguaagucuuuaauguauaucacaaaaauagaauacucuaaaaucagauuggaugucagaaaucagcuaccaccauuuucuuuuuucauccuguaauguccacucaauggaauguaguuuuugugugaaaaauuaaaaauggaauugggaacagugacugaaacuuguguuucauguugauuggacacaccucaugcuuuacuacgcuagauaggggacauuuacucacguguuaaagaggggcucagcuucaggagugcggccuugccgugagugcugucucugcuuaugauuuuucuccuggucgccccguuuuacccgugcugguucuguguggggcuuggaguuugagaggaagcagcugcaagcacggccacaccuccuccugaugcuucccuacuggauguccuaaaugcuuucccaccgugaaaucuuggauuagaagggacuguuucuuucuguuucgguaauaggaaguguuuugaaguugaaguuaucuguagauugucuaugaaaugaguaagagguauuuuagaaaucagguuagaaacaaauguuuagcaccucuaauugcaguuuacagaauuauaucaaacuguuuuaguuguguaauuagguacuggggagguuacuucaguuaucuuaguugauccauugcagcagaaaugugaaaaagggugugacuuuauuuauuuauuuuuggagacagaaucuagcucuguugcccaggcuggagugcaguggggugugacuuuaugaagugauuuauuugccuuaaauuaggaccagaagcaugcccgaugcauuuuuaacauuaaccauuaaauacccuaaagaucgauuccccaacagcccugcuguguagaccgugcagaaaggacguuucuccgucaccagccugggcagaauuuugaaaauguagcauuuggccucuuucccaggaaggaucuuugaacacacuuaucuguauuuuuauacccuuucagguuuccucaacauuuaauguccuuuuuugccuuaucaguucuuuccuauuaauacuuggccauauauuuuauguggaaaaucuacuggcccgaugcaguggcucaugccuguaaucccagcacucugggaggccaagacgggcagaucaccugaggucaggaguuggagaccagccuggugaaaccccgugaauacuaaaaauacaaaaauuagccaggcgugguggcgggugccuguaaucccagcuacucaggaggcugaggcaggagaaucacuugagcccgggaagcggaggcugcagugagccgagaucgugccacugcacuccagccugggugacagagugagacuccaucuaaagaaaaagacaaucuaccaccuuuucccgaguuuccugaguaacacaccugacagcuaugggaagcuucagcauauuucccuuguugcugagguuucuaagccagccuaaaacucgcauguaauuagcugugugcguuuuauaaaaacauuugccaacccaagaccuggguccaggcaugucuucccccaguguguuuggcuuccucacgaugccaggcccugcgugcagaccagaugccacuugugaggacgcaccggcaggcaggccccuccaauccugagggcggcaucacggggaccugcagucauggcugcacccuaguaccgcggggccccccugcacccgaggcaggguccugcugucagccuggaccuuggggugagggaggcagugguccuguucagcagagggcaugggacugagcacagcccaucagggaggagaguuagcagggcccugggcccuggcggggagcugcugggggccuuugagccauagugaagaguguggauuguccugaggucauggcacuuugauggucaggucuuuguuuugaacauaucccuguggcuguauuuggugacuggaaauaaggagagggcuugagggcucuugggagacgggagagggcugggggccuggaggugugcccgcuggaggaaggugggaguugccagggcauuacagagggucucagagcuguguuggcaucacuccgcagguggagggcacagcugagggcgacagugucguugagugcgaggagguuggggccucagcuugcacgugcuggccugcgaggaagcaucagccgugcugacauggagauguuuccucugcaaauuggaguuucggacacacagacuggaauugaacuaacgggcaccccaggaagacuguggggcgagacgaggaggauggggggaccagccgucgccccacucuccuguucaucaucacagccucguugggguguaaacgacccccaguaagcuggugcauguucaauagguacauuuuuguaaauguuaacaucuguaaauucguaccuaucaccacaaucaagacgagaaaaggcccagguuuccccuuucccauucggggucccuccccucccacacccccuucuucaggcaccccuggucuguugcucucacugcagcugugucugcauuucccaaagcucugugugaauggguucaggcagugggcacucuccucacucacacuggcuuccucugcuccaugcuuccugcagacuguccgccuguggggaccgucccccgagccuccagggccaggggugugguacguggcgucugucuccacucaccuggugaggggcuucugggcagugucuugucuggguugucacaggugcagcugcggugaacauguguguacacaucugucuuugggccugcacucuuguucucuggcauagaugcccagagcuggguggcugugcugucaguuuuuuuuuuuuuuuuuuuuuuuuccuuuugagacagagccuugcucugucacccaggcuggagugugguggcgcaaucgcggcucccugcagccucgaccucuugaguucaagcgauccucccaccucagccucccgaguagcugggacuacaggcacacgccaccacgcccggcuaauuuuuguauuuuucuguggagaugacaaaucauguugcccaggguggucuugaaccccuggucucaagugauccaccugccuuggccucccaaaaugcuggccuugcaggugugagccaccacacccugccuguagcuuuuucugaaauggccacauggcuuucggcgugauggugccacgcgcccccggugcuggaugagcucgggguccgggaucugggguccuugccggcgcuggggguguuggucuuucaagcucgggguccgggaucugggguccgugcuggugcugggguguuggucuuucaagcuuggccauugucaugggggugugggagcagcugacuaacucguguucuagugacugaugaugcaguuucagucaucauccauuucaggggcguguuuaacacaucuuucgcccauuuacuuauuagguuagucguuuucuuccuguugagaauuugagaauucuucaugaauucugcauacaauuccuuuuucagaugcuuccuugcuacauauuuccuccugcuccguggcuuucccuuucaguauccuguauauuccuaagucaaagccuuuuuaaaaaaaaaucagcuuugggccgggugcgguggcucacaccuguaaugccagcacuuugggagacccaggcaggcagaucacgaggucaagagaucgagaccauccuggccaacauggugaaaccccgucucuaccaaaaaugcaaaaauuagucgggcaugguggcgcaccccuguaaucccagcuacucgggaggcugaggcaggagaaucacuugaucccgggaggcggagguuacagugagccgaaaucgcgccacugcacuccagccugggcagcagaaugagacuccgucucaaaaaaaaaaaaaaaaaucagcuuuaucuuuguacaucuacuuuauuacauauaguuuacauauaguaaaauugccaguuuucaauauggguuuaaguguggcagcggguuuggcagaugugagcuguugaaugaccaccacuguggucaguguggugcacaugacccucccuccaggaggcgccauccugacugaccuccugucgcuggggcucccccguuuuagaauccgugcagguagcuuccuucaucugcugccugccucaucagcugccuguguuucaggguuccucagugguucucacuguguggacgccccacauuugaggggcuuugagcccccguggguuuugaugugagcacacggcacagcucuguucuccccggcugguuuucuguuggagugagcauugagcccccguggguuuuggugugagcacacgucacggcucuguucuccccgaugguuuucuguuuuucaugagcauugagccccuguggguuuuggugugagcacacggcauggcucuggguuuuggugugagcacauggcauggcucuggguuuuggugugagcacacggcauggcucuguucuccccggcugguuuucugguuuucgugagcauugagcccccguggguuuuggugggagcacacggcacggcucuggguuuuggugggagcacacggcacggcucuggguuuuggugggagcacacggcacggcucuggguuuuggugggagcacacggcacggcucuggguuuuggugggagcacacggcacggcucuggguuuuggugggagcacacggcacggcucuggguuuuggugggagcacacggcacggcucuggguuuuggugggagcacacggcugcuucccacagcucugcugcagacccuggggcuugggccguuggacagcugagcagaggcuucguuuucuuuuccuaugugcaggaggcugaacaccgcuucaagugguugaaguguguguguauuuucuguaaacuuuuugaugauauuucugcuacacuauuuuuuuuuuauugauucagaagaacugguuuauuuuagggaagccuccuguugguaagaucaguugcgguuguuuuuucagauuuguuguuugacuuuugacuuuguuuuugguguuuuccugguagacuuuguucggcauauguguugguagggaucgauuucuucuguggcucuggguuucgagucauaauuagaaaggcauauccuacuuagagauuauuguuuaaaagucuuccguguuguuuucacaagauguaacuuuuauuuuugagacauaauuuacacgcuuucagcugccccuguauggaguggacgguuguggaggggcugacaguguguccaccugcgucaccugcaucuuccuugggaguggagcucccaccacuuccacggccaacacuccuuccccccagccugugugcugcugcccugcccucgacgcggagcagggcugccccucggggaaggucguauccauggaaccagagggaacacacuccugugugucagguucuuugcucagcguagugcgccuggggaccguccgcagcgcguguguccucagugcauguguccuccgcuaguguccucagcguguccgcagugcgcgcguccucggcucguguccucagcgcguguccgcagugcguccucagcauguguccucagcgcauguccucagcgcacguguccucagcgugcguguccucagcgcguguguccucagugcguguguccuccgcucacguguccucagcgcgcgcguccucagcucguguccucagugcguguccgcagugcguccucagcgcacguguccucagcacgcguguccucagcugcuuuucguuggugagucuuugcucagcaucgugcgccuggggcccguccucagcguguguguccgcagcgcgugugucugcaccuccuuuugguuggugaguugugugcacuguucuguggcuauacaauuuuucugugaguuugccugacauuuagguuauuuugaauuuuuggcucugaugaauaaagcaguuguauauauuuauuuagaaaucaucuucauguggauguguauuuucauuucuuucagauaaagaguuagaauuuuuauauauuuaacuuuaugagaaacugccaaacuguuuugcaaaguggcuguauaaucuuguacuuucaccagaacguaugcagccucugguuuucccacaucugugccaacgcuugguauuuaccagucuuuuaaaauuuacccauucgaguggggguaacgauuuaacaauuagcauuccuggcugaauacugauguuggacaucuuuucauguguuuauuggccuuuuauuuauuuucuuuugugauguuuauguacaaauuuuguaucaauuuuuuguuugggguuuaucuuuauauauucuguuacaagucgguuugccuuuugauuuucuuaaaaguuuuuaacagcuuugccgagguauaaugggcauauguuagcuguauauggagugcagggcuuuacugaagugcagcuggcacacacuaaccagagcgcacagcuuccugugugugacggaggccugagcacagccaucacccuggagcccccccaugucugcuccuuguaauucccgccucgguccucccccacccugaggccccugaucugccucuguggguguagaugaguuuuuugcacguccuugaauuuugugugaaugaaacaaagcugugugcacucauuuugucagucuucuuuggcuuaggguaguugagauucagauuguguguguuguugcugaguauucgauuguguggaucaaccacgguuuguuuuccccguggaugaugucagggugguuuccagauuucgccguuacacaugaagcugugugcacguuuguguaaagcccgugugugcacagaugcucuuuucuuuuggguaacugcucaggagggaauggcuggaucacgugguagauuugaagaaaugggcaaacugguuuugaaaguaacugugcugaauucccacccacaggcagugaguucucguucuuccgcgucucaccaccucuccaugcugucuuuuccaguguguuuauugccggcuuuccugaguacacgcagccaaugauagaccaccugguuaccaugaagaucagccacugggauggguagguuuucuguuuuuguuuuucuaagagcuuuuuuuccccccaaaggagagauucaguugagcuuauaagccuugaguguauuuucucacuguggaugucguauuuuaaaauaacuucugagaaguaauaugaauuccagucuucaugccggauguguugagucauggucugucuccaguuccacuucuggagcgccugguccaguguguccgacguggcgguguacccgugcaaauguccacgcuggcguguuguggagugccgcugccguccgagggggcgcgggcguagcuuggaggcggacucugcguugucucccucagcagugcuucccgcugacucugcuccauguggcuccacaggugguuucugcgcugucuccugggagcccagcaguucuuaguggccguuuucaucauuacaguagcagcuucaggguuuccuugcauuucauaggcaguuaaaugugucucagaaaggaaaagugaagugcggucuggagcauaaacagcgcguuagugcugugaccgccgcccugaggaggucagaggguccccuccuaggacagugccgugcuguggcacuccucacggagccucgaggagcgguaggugccuguggguggagguggcuuugugagggugcgaguccagaaucucaguuucagaguuggugugauguggaggggguccuuucugauccaugggggaugcguuugcugcugccuggggagcggcccggcugccugccgugguccugcugccuggggagcggcccggcugccuacugugguccugcugccuacuauugguccugcuuccuggggagcggcccggcuaccugcggugguccugcugccuggggagcggcccagcugccuacugugguccugcuuccuggggagcggcccggcuaccugccgugguccugcugccuggggagcggcccggcugccuacugugguccaggcagggcccucaggacugggagccucugggaaaggaacuccuggguagcacucgggcugccgggggaagacccucccuucauucgcuuacagagaggggugugaauuccugagacucggggugucccugcaaauguuacaccaaaacucucuccauuagguacaagguccccuaaaccgaaccuagggaaaauuaauuaauuugucaguuguaucagccgauuagucaauaacgucuuuaaaaccaaaguuacagauauaugcccguagcgucggagcugugggacucuccagcugguacauaugcccguggcgucggagcugugggacucuccagcuguugcugucugucucugccucaguucugucggccuuuccuucacguguuuugggcggggucacuuauuggaggcagauacacuuucgcuuuuugucucuuccuaauguauugacccuuuaucuuugcggaacggcccucauugucucgugugagauuucuugccuuaaaguaacugaugacugguguaguaccugaguuggcaagccuuuucuuugaggggcuggauaaacgugguagaucucuguuccauacgcuuugcuuuaguuuauuuuauuuaguuuauguaacccuugaaaaaugugaaaaccauucuuagcugagggccguccuuacgcgaagaggccucgggcugggcuugcggcugcagacugcauugccuccgcuucucaggugcuuugucuuuucuguucccucagaguugcaggcgauggucuucuagacagcaugcaguugggugucgcucaggguguggaguccuggcacaugagacgccaccugccucgaagagcucuuuguuuaccguuagaaguggacccugagcagggcccucggccgacaccagaggggcuguggcaggugguccugccagcgcgggcgucugccauugugccugguuucacuguggugcuguggguuugguguuuuuaaauaauuagaggacagacacccgccuucugcauguuuucaccuucacauuuugcuucuuuguuguuacauggucgcccucaugaugauuuuaagucaggaccacuugcugcuccagcugggucuggaggggcuggggcaugagcucugcgggucgcucccagcuugaccaucugccucugcauggagcucuggaaggaggggugggcucaggaggggcuccagccucuugagccgguccugggucagccuuucgcgguccgcauguucaaccaugggugcuuucagugugugucugaugaggcaguuauuggauaugugccccagauuuggugggugagccucaggaaauuccuucuguucaccccuuguaaucguggaggggugguuucacguggcucuaucucacacucacaaccucagaguagcguggggguggggaggccggacacccaauugccaccuggcccugagaaggaaaggcagcugugucccaagaagaaccgugguuagccgugugaccucgcuguuguagacuguccuugucgucuguuggagucggagguucuuguacugguucgugugagugagugagugagccucugcuaaguggccgguugaggacucguguguugucucccucacuuucuuuuuaugaauugaauaaagcuagaaucauaaaaugaaggcacuuacgacauucucuccucacucucagggucauccgagaguuggcugcgagggcgcugcacaaccuggcccagcaggcacccgaguucagcgccacgcaaggugggugugugucccggccggccugcgggcaccaugcaugcacugcagaaaggccuggguugcugguuucaaaggcugggggcugaaaauaagguugugcuucugucuuggugagaagcaucugaggaaagagcuguggacuugaucaguggauaggcugugaggacggaugcggugaguguguccgccugcagggcagggagccgcugaacuguguuacguacaccggagcccgugauggucccgccggaugccugacaugcagugcugcuucccuggucucuagguggcucgcaccugccacacgacacucccuggucucuagguggcucgcaccugccacacgacacucccuggucucuagguggcucgcaccugccacacgacacucccuggucucuagguggcucgcaccugccacacgacacucccuggucucuagguggcucgcaccugccacacgacacucccuggucucuagguggcucgcaccugccacacgacacucccuggucucuagguggcucgcaccugccacacgacacucccuggucucuagguggcucgcaccugccacacgacacucccuggucucuagguggcucgcaccugccacacgacacucccuggucucugguuggcaugcaccugccacacgacacuccuuggucucuagguggcuuccaucugccacacgacacucccuggucucugguuggcaugcaccugccacacgacacuccuuggucucuagguggcuugcaccugccacaugacacuccuuggucucuagguggcuuccaucugccacacgacacucccuggucucuagguggcuugcaccugccacacgacacuccuuggucucuagguggcuuccaucugccacacgacgcucccuggucucuagguggcuugcaccugccacacgugaaugcacuuuggaauugggcagcguguauagaaagaaaaggccugaaugggagacucaaagucugcccaggacuaacaucaccuuggaauggcucagcuaagucugcacuucuuacacuucaucagugaagagagaaauccuguuuguucugucuuguuuuuuucuacuuggaauaaauaaucaucugacuuaaauguggggaagaauacacacauuucucaauguguguaccgucacucccccgacauuuauuacaggggcuacacuggaggcuggauuguggcucuucaguggaguuacugaugugacgccuguguugaacauccugugggggcucguucauuccuaagggaucuuucagcuucgugaucuguuaaugaggcauccacgucacggguuuaguguggcgcuccccuacuuuucagugauaauuaacccuugcugacacugagggggcucagcuuuguccuccacccgguugaagagcacggacacccagaacaggacugugaccuuuuguagauuucucugauucucgaaaauccgaucacccccagccgccacaucuuagccucucugauucucaaaccaucgcaagccuggcagcacuuggggaggcuuaggcucggggagcuugguuuccccacgcagguguggcagagccgccucccucugcguccgugaggguucugaggagucugugcuuucugagcaaacucagaguagaggcaccaccccugggggcagcccugccucuguccugcuccgcccccuccaccgcccaggcagccaggcagagcuccugccaggaccagaggccacccuacaccgacagggaaggccuggggagugugucguccuccuccaugcucccucuccugucugaguuacccaccccgucuggggcacuugggagcgggccauguccagcacaccgcagccuccguccuguugcccuuggugucucaggggccaucugcaucaccacgggugccguccugggcacuggggugaugacccugagggaugccagugugggcgggugcgugugggcgucccacaggucguccgugugugcacgccgucgccugcccucccggcccugugugggugcgugugggcuucccacaggucguccgugugugcacgccgucaccugcccucccggcccugugugggugcgugugggcuucccacaggucguccgugugugcacgccgucgccugcccucccggcccugugugggugcgugugggcuucccacaggucguccgugugugcacgccgucgccugcccucccggcccugugugggugcgugugggcuucccacaggucguccgugugugcacgccgucgccugcccucccggcccugugugggugcgugugggcuucccacaggccguccgugugugcacgccgucgccugcccucccggcccugugugggugcgugugggcuucccacaggccguccacauguacacacccucaccugcccucucggcccugucucuugcagucuucccgaggcugcuguccaugacacugaguccagaucuucacaugaggcaugggucgauucucgccugcgcagaaguugcuuacgccuuguacaaacuugcagcccaagagaacagguaggaagagugggucucgaggagacacagggcucugucccugauccccucaccauguaaucacagugcucuccaguucgagacucucucaucccuucucauuuuuguuuaucugcaccagugucacagucgauaggccccagguuguauugauggaguguguaaguggcccucucuccugacggucaugccguggguggaccacccaccucuucagcggggcgggugcagcacccggaugggccgggcaucuccccacggcuguccugccccugcugccuccuugugcaccuccuggucucagaggugacaagcgaggucauaacagcaaagguccuuuuuccaagacggcauugagcgacuugcauguucaguauccuuucuucaucacguuccauaguuuaaaaugccagagaauauacacguuucuuuugaauuuuucaguuggcuauguuuguacaaauaauaauaaagcaugaaaaacauggggucacugggaaguugugugcaggaggcuguaaggcaucgacugucgucuuacguuucuucccagucgagucuuccucaagaguaagaacucccggacuuaccauagugacggcaaccugcuucucggacuccaguuuaagaaacguuuuuaaguucaugcccugugcuggagacaguucccugggaacggguugagagcaggguaugggcccaccucccgcccaagccugaggaagcucuggucggccccgagcucagaugcagagugcagcuccuucagggacgcucgcucgugugggugcagcugaugcccgugcaagaccuggccuuuauggcgcugcucugugguuguggaagaaggcacaugggguggggucuggggagaaccaggcgggagcucccaggguccuccagucgggucccacagggccugugucauucccccagcagugagaugugaccacaccugugaggugucuaucagggaagcacauuugagccucagugcccaggcuagacuggggucuggccacgugggcaccuccgccuggcacgaaacaaaauuccagacccccagcaggaaagcaggugccagcguaaagcacacgguuugcgcagauugagccagugagggggccucaugaggcagggcuugguccaggcccccgcaugccagcccaggucugaucucgccagggaccuucccuuggaugucaguggacaugagcugucgucucagccucaccuggaccugucuguuuuccaagguggucacauuggcaggggucacagcuuuaaggggaugcccuaacauccucuuccuuugaccaggcacugcuucaucuaaaaucacaaaugggccaggcauaguggcucacgccuguaaucccagcuauuuaggaggcggagguggggggauuguuagggcccaggaguuugagaccagccugggcaacauagugagaccccaucucuaaaauaacaaaagaaugcaauguaaaacaauacaguagaauacaaaaauaaucggagguauguccugcagaggucucugggacccacugggaccugaacaagaaugagaccuugcugagccuaugcuccuccgaguguacuugggguuagggucuuggggaguguggccucagcuccuccgaguguacucgggguuagggucuuggggagugugacuucagcucuguguuugaacuucugcaggcccgucacggaccaucuggacgagcaggcagugcagggccugaagcagauucaccagcagguuugugugcagccucuggguguacccucaggaggcaucacaggaccugcccccuuagggccucccacccuccccaggcagggucugcaguccugguggccacugugcuccaucaguccugggcucagugggggaccugcggugugaucacucugggaacaggcucucugcuggcgucaugcuugugaacagccaccuuggaggguugcccugggaggggaagagacuccuaggaaaugagugcagacuuucugugcacguagccagcauguccuuggucucugaggaaggcuuaugaagcuagugcagucgguggagguuucggcugcagcuggagugugguuucccuccggggcgcgcggcugcggucccacgauggagcgugcagccaacucugggugggggcauugggccccgugcucuccugguggaguugggggcacacagaacgagcacagaagccucugguuuccagccgugcaucugcagcuggggucugaugucuccugaaaguaaagcagaauuuugugugugcgucugucggauuucucuggggagacaguguguucaucuuucugggcuuugagagauucucaaaggcuucugugacccagagguaaaguaugaacuauggaucuugguguuacaggagaauauaaaaauuguucacgagggauuacgugguuuacuugucuguuguccagauagcuuuauauucuuuaagauucagcucggauucuuauccuauuuuugccauuaacuuucauuaugauuuuggcaaagccauuuuguuugcuuacauuuuucacuuuuaauguggugucuggccucccccucugaccgagacaagcauggcugcagagugcagacggggagguggccccgggcagcagccaugaacguggccuccccacugacgcugagccauggcucccuuuuuucaguaaaauauaagcaguaauagagccgaucuccuugaguuuuugugagaauuaaagaauacauuuuaaagaauugaggagaauuuuugggacagugugagcauucaguaaauuuuaguuguaguggccaucacaacguggcuuuuaagcucucuuacaaaaaaagaaacaucagcauccuguuuggcacaguuacuuuucugcacaagaggcugccuggguggguucuacgucggucucuggggccagaaugcagguggcuccagcucccuacucuggcccucuccucccucucucugugccucaguuuccccuucaagggagcucugggccugucuggagguuaaacaaggccaucugcgucaguaggugggccuccguccucagcccccuaggcggcucuccuggcuggcauggcaucuucugccauuuucucuuuguucuuguuuuugacaguuguuaacguauacguauuauuuuaaaauuuaaaucauuaaauaacuuucaguuuuuuauuuucagcucuaugaucgucaguuauacaggugagcuuuacaaaaccaaaguucuuauaucuguguccuaaugaagaacugcgcugucaggagcaggcggggcggguguguucgcuucccucucugccuauguguguuuggguugagcgggugggugucacccggcccgcugugggaggcgcaugagggucugaccugguugugugauuggguugagugggugucaccuggcccacugugggaggugcaugagggucugaccugguuguguguuuggguugagcgggugggugucacccggcccgcugugggaggcgcaugagggucugaccugguugugugauuggguugagugggugucacccggcccgcugugggaggcgcgugagggucugaccugguugugugauuggguugagcgggugucacccggcccgcugugggaggcgcgugagguucugaccugguuagguuuucagcucugcaggugucaucgcguuuccucguucccaggacuugcuggucauaggcagggguguggccuccccaaccccgagaucuggccgggugccucccugaggguuucccucugugccuuugcagcccaggcagccugucugcucugacagauugcuuugcuuuuucuagaauuugcuaccgagggugucacacaguaggaagccuuugggugugguuucuuccccgacgugucuuugagauaccuguguugcuguguguuccguggugugcauguacggcgccguguuauccacucaccagcccaggcucaucuggguuuccagccuuuggcuauuguagggaagcugcugugcacaucuagacguacaagucuugguacguuucacguuuccuggcugacuaccaggagcagcaucgcaggguguggggcacaugugugacuucucagcagccgagccaacuucccagacccugcugcugcacguccccauccacaagugaccccuugguguggucggcucugaacgugggcccucugggugaguagaggccucucgcugcugcuggagucugccucuccccagggcuccuggugcugagccucuuucccugugcugacgaagcauuccugggucuuucgugaaguuuuuugcucauuaaaaaguucagacuuuuugcucauuaaaaauuuuaucgucugucuuauugagcuguuagaacucuucauauauuccagaugccagcucuuugucacacacaggaucugccagugcuuucuccagcucugugguucacuuuucuuuucucuuagugacuuuuuuuuuuuggagaagcagucucacucugucgcccaggcuggagugcaguggcagcaugucggcucacugcaagcucaccucccacguucaagcgacucuccugucucagccucccggguagcugggacuacaggugccccccaucaugcccaccuaauuuuuguauuuuuaggagagacgggguuucaccauguuggccaggcuggucuugcacuccugaccugaagcgauccgcccgccucggccuuccacagugcugggauuacaggcugagccaccgcgcccagccuccuaguggcuuuuuacugggacuugugugggguagugaaccucgugcuguucuccuuuaccuucgaggggugaagccucccuuucugccuccuaguccuuccaggcugcucccaagaggucccuuggcugcucccaccaguuucuggccaccuccucagucagcagggcggguggcccuguuugggcuccaccccacacacugggccuggagggcuccuucaggugcuccuugggguacuggaggaccccugccuugggccucaguccuguacucuucaccuccugguguuggagccagcauuucauauguugcauucuguccaguuuucuacuugcaggaggggacauccaacccugccacucugugugggccagaaaccagggucucaggagugaauauuuugcccuccccagggcagcgcgccugcccuugugcaccagggucccgcugucagcgccagggcuggggcaggugucccagaugggcagagcagcccggagcuccgccuagcuucgcucaugguagaaccgcagugcacugcuucucuaggcuggauagggggcucuuucuggcaucugagauuaguuucuauaaaguaagagcugagcgcugcuuggaauuaguucugugaugggauaccagucaggacuagaauguccaguaaaaauuaaaaaucagcaucaccccagcuaggaugggagaccucuggaagauggcuguaccacguuuuuuccuuucuuuucauaaaagguugcucaugcucaguaacacauucaacuaguucucauuuuaaugcuuuuuggagccugagguuacauuggcaagcauauuucaugguguuuuauacgucaagagguucuucuaauucugauguuuucauuccuuuucaggggucugggaggacagcucaugagacaagcagguaagucugaaggccuuugcagcccucugcagcccuuugccgcagccaucguugagggaggugugcucguggcgugcagggcggcccauuagcccccagggugaagggcuggguguguuucuucuguggaggcggcaucugugaugugcuugguuuguccagugguuccuacgagggagagauugagagauugagauugagagagagaaagaggaaguugugagcugggagggguugcacccaggagccacugguucuggaaauuucucaggaagcagaggcagcuggggcaguggggccagugcuugccuguggacccaguggacauugcagaucccuccgagcacggccccagcguggacagagcagcccuggucgugcccuguggacugagcagcgcagggaccaagagccguuuugggcgagcacaggaagcucaggcgggggcaagaggaaagcugagcagaggcgaagcuccuuacacacccgaguccaggcgaaccucugcgccugauucccaagccucugauaccccccggggguuaggacagucgggcauuuuuucuuugcugauucuuuuuuagcaugugaggaggagggaagcguagaacacauuuuagacuguuccacagaguauuaaaggaaaagccugauuucauagacauuccugauggcagcagccgaccccaagguccagggagcuggauuccccgacacagcuccuggggcccugcuguuguggacagcccaucccacgccacccucagccccucgcugugggacugugagugugaguguggaggcacagcuggugaggaagcuuggaaaaaucgcgguugugugcagacuuuugcugaggucugcguggucugagcagaggagagcaggcugggauucggggaacccacggccggaugucagggcuguaccagccucuugugcuuucuguccacaccucccagcccugaccugauagggaccugcccgaggccugcagccaucuaucuccagccaggcuggccgggcuucuguacugagagcagccagcuugcauuucugcugguguuagcucaguguucucaugagucugauggacgucacgggaaagucaauccuagaaacgugagccaguuucugucagcugacgucagaggcaugggacugccaguucugcagguggucccuguuggcuaagaccggugugucauguuuuggauguagacuuggucauugucccucagaugccuccagagcacacggugcaggggugucaccuuuccgacguacccaugggugcccggaguugccuccuuagugggaucaagaccaucccccacaugucauggacagcuggugaccuguaagccguuucuggaucuaggaguuuggcuugggauggaguggggugucgagugcucucagaaggguucaaugucccccacuucccacccacgacacgggucgugcccuggagauggcaguuggaggcaguccuacgaccuucacacgaccuucacgugcuccccgugugcugcggggucugcuuuuagggucgcucuugguguuugagcaguaagucugcacaggagccacugcccaccaugaaaggggggaguuaaaggcguuccgaaucccuuuggccaacgacggaguugaagguguuccgaguccccguggccggcggcgacagaguugaaggcguuuggaguccccguggcuggcggugauggaguugaaggcguuccgaauccccguggccgguggugacggaguugaaggcguuccgagucccuguagcuggcggcgauggaguugaaugcguuccgaguccccaggacgccauuuuggcugaauuuccuuuacccuccugcuccgugaagcggggcccauuggggaggugcugcucuguaaucugcucuucuucuugaaugugugguuagggcagccacauugaugucccccaggcuccagagugaccgccccuuagggguccugcugggcguuggccgcuguuggccgcagggcaccguuggccugugcauugcugccaccuacccaugaugggcagaauugucacgagcucaggaggaaaccauggaaaaaccgcagguccuggagccuccgugugguugucgugggcagcuuuccacgcgacgugcccucccugggcgugaggcugcauuugcacuuagcggggagagggggaauguuguggguucuaguugggcuuuuugaugaugauauuuggaaagacuugagacaaaguagccacccuguccugucccuuccucacccaccacacccacugcuccccgcuggcaggcacugcaggcugcacaaguaaccguggaaccuaaacacugaugugcuucguccggguuuuaaaaaggcgcccuuaccgcgguuucgguguuuggcgucuucacgccauccggguucucggugcucugcucugaaggaugguggagggcuguggucuguuguugggggugcugggugcagggugguuucugucugccucucucuacccccaacuccagcuuucccacccugcccucugcucuggggcacgugugcuguugggaugcaucccucaggguucacggcaggguguggauugcuggggggcaucguggagaagggcaucuuuaugggaggcaucccugcucugggcccccugccggccuccagcugugucugcaccaugaguguguuugcuggagugcgguguuugcacucccucacaccgcugagugcaaacgcggcacuccugcacaugucgccucgcaccguggcgggcgugucccguggaaagcugcccaugcugcccacgcccucccugggggccccuuggcugccugcacuccccagccgugaccucagcucccggcgccggcccuccuugugcagcuccuuccccuccauggccuuugcuggccccaggagacucuggccugcaggcucugaagccggcugugucccuggugauccugacugagccuuggugucaacucagguuuuuuucuccuccucguucauuuuuacacuucguaggaaauuauuuucccuuucagcuuucaaguaggaauaguucagaaggggaaauaguucugcauagcgucuguggucuuggccccgcaucucccagucccacauuuuuauuuuuccaaaggcaacccuuucaguuuuuuagcugucuguuuuccuugcuucuguauuucugaguucuguauguacgcagcuguuuccugauauccuuaguuuuagauguguucuuucaagugagacaagacuccaagcucuugucggggugagaaaucugcggguucacgggcuacaugugggagacggggaggggcugcuggucacuuucucacccaggccagaggauggcgcccuuacccccgaggacgccggcaugucggugacaugccgcccgcaggagcaucaggugcgcccuggccgcaggugccccggaggugucgaaccgcagauuucuucagacguuuuuugcacauuuugugggaaaaguggcucaacccuugggagucgucugcguccccauaucaaagaaaugucauacagguuggccuuugucgugaauauucacgagaggagaugaacauccuggauguccucagcguggccugaacugagcugcuucccccggugccaggaagaugagcguccccuugucuccgucuuagucucaguggcucuugcauuucaugcuuuagaaucaaaggaaagaaacaggaacucuguuuagugaagcagcgaugaaggagggguuugucagucaggguggacugcguuuugcucuugaaacaauccccaaguuucagugucuuaaaaccacagguguuuuuuuauccugcucacauguggaucaccgagggcaggggccgggaggaagggggucaucuggcucacagccuugcaccagaggcgucacgagaaucaggaaaaguucuccucucaugccgaagacgggagggaaaccagagggacuggugagccuugagucggccacagguguguggaggaucgugacuuagcaagccggggacacgcuguuaauggacuuccugcugugggggugagggcuccgugcuccaucucugaugcccuguacacaccugccaccuccccuguccccucagcagagacauggccggugcugucgugccuuucgcuuuuaccuguaucuuaaaucacacaggaguucauucggauuuaccuguacagauacccuguucucuuucuuguuccgugggaauucacugggauuuacccacacagccaccugcugcuucuccuucuuguucuguccugcauuucucaccuucuaagaggaccauuuucucuuugccuggagaacacucuaguguuuuccauagugugugucugcugguggcacccucucguuuguuuauaccaaaauggcuuuuuccacuuuuuuuuuuugagacggagucucauucacucuuguugcucaggcuggagucacaguggcgcgaucucggcucacugcagccuccaucucccagguucaaguguuucucccgccucagccucccgaguagcugggauuacaggcaugcgccaccguggcaggcuaauuuuuguauuuuuaguggagaugggguuccaccaugugggccaggcuggucuugaacuccugaccucaggugauccacccaccucggccucccaaaggugcuguuuuuuuuuuuuuccccacuuugauucuuaaagguuauuuuugcuaagaaugaaacuuuaguuugcauuuauucauucguuuguguuuuggcacuuuaaagauaauagucucuugucuucuggagagguuagcugccagucuacuuauuacuguauuggagacaaucuuuuaaguuucgcuggcuucuuuugagauuuuuaucuuuauuugguuuucagcacuuuuaccgugauauuccuagaacaaguucccuuuguguuuaucugacuuggggcucuaggguucauacuuguuccauaaucuguauuuucugucgauguuuuguucacuuuagaaaaauuccuagccaugaucucuuugaacauugcucacuggccucuccucuccuuuugggacucuuauuacccacgucuugucuggaucaccgcacuuaauucuuuacgccuccuuacacucccuccucugguuuugucuuauucaguuuggacuuuuuuuuuucuuuucuuuucuuuuuuuuuuuuuugaguuggagucuugcucugucaccaggcuggagugcgguggcacaaucucagcucacugcaaccuccgccucccgggauuaagcgauuuuccugcuucagccuccugaguagcugggacuacaggcaugcgccaccacacccagcuaauuuuuguauuuuuuguagagaugggguuucaccacguuggccaggcuggucucgaucucuugaccuugugaucugcucaccuuggccucccaaagugcugggauuacaggaacauuuucuuugauuuaaauuucauugucacaaauucuuucaggugugccuuaucugccguuaaacgcauccuugaauuuuuuuauuuuucagaacuuauuuuuuauaguuuucauuuuuuucacauccuggaacauauuaagcaugguuuaaaaucuuuguuuaaugucaucaucuggagccucuguggcuguuucugaaggacgguauaucauacaugaaaagcaucuccaccaagcugcaggaacaagacaugacagaaaugcuuugaggucugcaauguucuccucucccagagagacuugauguuggcucuugacgggaggcgggugcuugcugucggggucaccuccauuggguuuugggacguaggagggguccgugcugggcuggcccacguuuuacaccuauuucuaggugugguccucuggguucagagccuguggugagggcucuaccgcuucucccuuuggucauccuggacucccguucuccugcuagcuggagaugcuccuggaugcacuguuggggguuucugguucuuguggcgcccccuggagucagccgugagccggggagaguuggcccccgccgcucugucccucucaggucuucgugagcucucugguaacugcaggcacuuccuguguguuuucauuuugucuggcuuuuaaaaaugucuuaguggaggguuggucugcguuaucuagucuguuaguuuuuaaaaaauauucuucauuucgaaauaauuauagacuuacaggaaguuaugagauuaguaauagagccuggcugugcuucccaugcuuccuccgcggugacuccggguaugacaguguuggagccgggacugcggugucgaggcccugccucuaacuggacugcaggccugugcgguuucguggcuucauguguguguggaguggccaugugugucuaguuucgugcagauugaugcccuguguagauuucuguaacuaacuccacacucaaaucagaaaccugcauccuucccacagagacagccccugcccuuugcauucucacccugccccccugccaccagucugucccuucuagaauaugccaugaucgacucguauggucguggcauuucgaggugggcauuuucugugagcguggugccgagaccccauccagcuguccauguguucacaguuugugccuuccuagcccacgguuggguuuuaccagaguguguucgaccagcacucaguagaguacacuggggcuauuucuaucuguugcuguugugaacaagguugccaggaauauuccugugcgagauguggguacaagccuuuucaugucuaccacugagucccgugugccguuucgugagaggcugaggcaccgcuucauuccaccgcugagccccgcgugccguuucgugagaggcugaggcaccgcugagccgcgcgugccguuuuuaacuugauuauaaaauacauuuaaaguucacaugcaggugcaucuccaagaaaauuauuuuaaaaacuaguuaagacuuucauuucccaguccucaacacacaucagagcaguacucuguucagagcugaaaggauucgcgcugggacaaaggcgugucacuugagugagugauggugucacaggugcccacguggaagaagguaaagucguaucuaaaacuaaaugugagaguaacuaauaacuuacgcauaaaaacuaccaucauaaaaauccucgaagaaauuuuaggagacguuguaggacagugucagucucugaagaaaacuucuuaguuuagaaauuuucaaaucugcgcagaaguaaagagaaguaguuuacggggggggcccagagucucgcccggcgcuuccuuucuccuccccuccucugaguuuaaagaagacccugaaugucaggucccagcagccccucgcuggguuuuucuaacuugugguaagaacugguuuucugggguuuuuuguuucuuuuuguuuccccccucuuggcauguaauccccagcuaacagauuuuaucauaauaauuccacaagguagaaacaaaaggagauaauuauguugggccuuauauugaagaauagaccauguguagguugguagggaaaacggagauugagaauaaacgucuguucuacagucgaaaagguaaaaaguuaauuaguguacaaagacuaaauuguaaaacugccugugacgagguaaaggauccaguaugaaauggggcagagcagacgugugggcauuucaugcagaagaggagcagacucacguggccguggacggugagggugccggccucaccucggaggcauggaaguaccagguuacuucacaucgagaggaccguuuuccucuuuccagucggcugcgguuggcacugaagaaucuuggugcugacagacacagagcagggucucucguggaacaggaguugucuggucuguucaguuugaugaguggcaguaucugugacgaugggaaguguguguguggucccuguccugugugcagggacgccagguggaccgacggccuccgcaucuguagcacggucaggccuccuuguucacggugacaaaaaauggaaggagaguuuagucccucaggagaaauagcaaauaccaugaacaagugugcagcaggcgucugcgaguggguuccguuguuagguagagacggugggagcuagagcaguguguggccgugggagcugcugaugcuguccagucgucucugucucgugcguccuggcccccucguggcuggucagggccacguuucuggucauggagagugugagugacgagcuauguggggaagugacaggcaugaccuguggucuggagcauugcaggugauggcugucugucgcuuggguccugagugacaggucuaggagcagaagccgcuaugcuucccguacagccugucacagggacgucugcagcucccugacaggccggcccggcuucucugaagugcacgugggcucacacaugggccuucugccacguggcugggucugcagcacuuucuucaggcugcucagcggaggaggcgucuugggcuucucauggugguucugaaaugguucugggauguuuccagcccuggcagcaggguagguugggcgggugaggggcaggagcuggccgcacacaacucagaauguggcaaaggcaagccgcuguggcaggcgcuuuuagaaaaguaacauugcgucuauccuuuuuuuuuuuuuuuccaguguguguuuuaauagaaaaguugucacuuuccaaaaugcccuuuagaggugacaccguaauugguaagugcuuuuguuuuuaauaauagcauuuucuuacagaaugacuucagauuaaaagguaaaaaugaaccuguuaggaugggggcgauaaacgauuauagcuuaaagguucaagauauuaaucggauacguugccuugaaguuguuacaagaaccugcuuaaauaauggguacccaccgcccucuccccccaacacaggagggcccuuccccgccgucaccucaguacccccaccuccucgcuuccaugcccagggcccggcacucugggucaguucuucucccaggcagacagucgggagcugcagccacccaggcccucguggaccaggagcgugccggccgccgacaccacggacccugugggcagaggcggcuccaguuccucagcagccccccacacugggcugccagagcacagugaagggagcccccagggcuguggugucccggggcugucucagcagccucagaaguuaggacuuuuuuuuuguuaauugaauagccuucacauuuguugcuugugcaggaucuaauugaguuaaagauuuggguuuauauuggugggagccgggggagaccguuugaaggaaaagauuuagggguaacaaaagaauaaaaguuucccaaaaugugauguauaaaaauuuacagaaugcugguauuucccucaauaagagcuuacacaauuuaacagccaugagaggaaggggccuuagacuuaacacaacguggagaauguucacuuuggcuuuuccacagauuccucucaaagguuaccaucgacuuuaagauuaguauuaauagaagcuguuuuugcuguuguuuuugauuucaugguguuuuugauugccuggguacgcuaacuugauuuuuugacagaugguuggcaauggcugauaaaugacacuuugagacaucuccaucucaucucaagucacucccgccagcagaugaagguacagugagcaugggcguucccggccggcgcuguggcgguguuaguguguuagucacggaugguguuuguguuggcgacugugcaucaugaggcugucccugcaguagccugauaacugacaaaugggggcauaauucuauuuggaaucccggaugguagcgucuacacgguuuauaaccagaaaauccaauacagccauuggaauccgaauguuuaauuuuuuauugcuucuggcuguuuuaauuauaguuaccuuugaaauacuuuuucugcaucaauaguaacugugcucuguugaguuccguguccuguaggaucugagguuuggaaacucccuuuaugaugcuccugugcagaugagaaaacagcaccccaggaccucugcucgcacacauugaccuggucauguugugugggugccaguguguguguguguccccggccaccugcccuccccucccguccuggggguuacagguggacuuuggacucacagagcuguaacgcugaucucauugcauagauaagaaaccaugggcccggcgcaguggcggguggaucacuugaggucaggaguucgaggccagccuggccaacauggugaaaccccaucucuacuaaaaauacaaaaauuagcggggcgagguggcgcgugccuguaaucccagcuacucaagaggcugaggcaggagaauugcuugaacuugggaggcgaagguugcagugaaccgagaucacgccauugcacuccagccugggugacaagagcaagacccugccucaaaaacaaaaacaaaaacaaaaacaaaaaaaaccaugguuaccaacguugacuagguuuugauauugaggaugaagaauggaaguacauuuaggugucuuguaauucucugacuuccuccaugcuuagcauuucuuuuuccuuagcaucuucaauuuucuuauuuuuuuuuucuuaaggaacuugaacauucuguaggauccaaguaccguucuacuaauugaauuugaaugcaucaugaucagugccucaaaauuuuauuucaaaaguccaugauuaauucacacuggccaugaugcuggugcacuuugccccugggauuggcacagguggugacucguggaaugcagcacccuguagacgacgcaccuccucugcucauggcccccaccugccccgcccccagugccucuccaaggcugcucuguuggccucggcuccugggcuucgggggagcgguggaaagaacacguggguuugguguuugccacuugcuggcuguguggucacgagaggcuccuccguagguggcagagguggggguucgaggagacaguggcacugagccccgcacgcggcgggacuggugacucucugcccgcuccugcucugugcagcaauugccgucccucccaccacgguuccugguggccuugggauggguucccgggggucuccugcuguccggccccaacuccuguucccagugcgcccccggagcccugucucucuaaaugaggcugacguggcuuggccugaaggcccugccccguuacucugggugcauaguguaugccuuuuucuucauaacuauuucugggaaagaaaaauaugcuccauuuuauuauuguuccauauuagaagacagacauuguggaaggaauaaucagguuauccauucaguuucuuaguuguagugguaguaaagugaugcguguaucugacagaugauggugagcaggcgugcuggaaaggaguagcaugacuuagggguucuuuugguuugguucgaaagucauugcugugccgagaucucagggugacccgcugugucccuggucagguccuucucugaccucaagggugaccugcuguguccuuggccgggugcuucuccaaccucagggcgacccgcugggucccuggucaggcaggggcugcucugaccucagggugaccacggugucccuggucaggugcuucuccgacuucagagugaccugcucugucccuggccgggggcuucuccgagcagagcugcugugcgcucaccgugcugccuuuguuuuaggaugcagcagucucggcccuggcugcucuaugcagugaauauuacaugaaggagccgggggaggcagaucccgcaauucagggugaguggggagcccuuuucuugaagacuccaggggcuuccagcaggaagcugcuggggagugucugggcacggaggaggccucgguugugcaguggagcagagccaccacgaucauggcuggagugggacuguucgggucucagguucccagccgaggagcugugggcagguccugcagcugcccaggauguugcaucagcucugaacagguggcucagcagggacgcgucucuguugacggcacccucuugcuccaucacccaggcuggagugguguggcgugauucggcucacugcaaccucugccuccugaguucaagcaauucuugugccucagccuccugaguaggugggacuacaggugccugccaccauacccggcuaauuuuuguauuuuuaguagagacgggguuuuacugcauuggccaggcuggaaucgaacuccugaccucaggugauccaccugccucagccucccaaaguucugggauuacaggugugagccacugcacucggucaguguuuuuagaauuuuuguaugcaccgugacauuuuucugcuguguguuucacucguuaauacauuuugcuguuuuuuccuucuuuaugaaaguagcauuaggcuggcuuuacgccgugucccgugcguagcugcugugccgccucacuguacauccugcacccccgugcugaaguucaggcuugcuucucgcacaucauguucgagggaucugcuucaugaaucguacuuuuauuuuuaaagugucacaugcacauauguuggcccacaguguuccuuuaugucauaugauagaacaugcauuauuaaucacgucaaaagugugugaaucaccacuuaaaauuauuauaaguauauaaaaaucaugcauuagcuuggcaugguggcacacaccuguaaucccagcuacuugggaggcugagugugggguugaggcugcagcgagcuaagcuugcaccacggcacuccagccugggugacagaaugagacucucucaaaaaaaaaauucucuuucugauuccuauuuugagguaggccacuuuggaaacgugucugcuuugggaaccucaggcggcuccuccuuuguucacuguggcuuugcuccuguuuggggcacacgucggguguggcuguacacgaugggcagcagagggccucucuucacacucguugcuuccuuucagaggagcugaucacgcaguaccuggcugagcuucggaaccccgaggagaugacucgcuguggcuucucguuggccuugggcgcccuuccaggcuuccuucugaaaggccggcuccagcaggugaggcuggccacgcgcaguggacggggccuagggcgagggugugggagccucguguguuggggcaugagguaggcccagccguuaauaaacccaucagugcuuguagcugggaggggguuccuggaaaccggcaccuguggccaggaggaagggggcagagggcacccaaggucuguggccccuuagggcccuggcgaacccuuugcugucagaggacagacuugaaaaagcugaauucugggagggaggagaagguguuguuuguagaagcagcugccgagagugaggagaacacaguugccuuugugcguuguggagccggguccuguuuugguugcggccgugcauccugcauccaggucggggcagaggugguuccacguccucccagaggucagccccacgcuggccucagugaccugcucucucacgcuuuccuguggugcuggucccacugaccaaccugccgggaacuccugcuugucuccccuccggccaccuggcgucugaagcuggaauaggcccuggccacuggguuccccacgcccuucccuccccaugggauccagccuuggcacuucaggaucugcagcuccagacggacuccugccuguguggcgggugggccucgcagccgccaugccaucuaaaacucgcauguggggguuuauccaguugaaacacagauaaaugugaaacaggaucacuuggagauaugacagaugagguugucgggacccagcagcuuccuuugucaauaccccaggucucagcguaggacaaaagggggggaccucagguaggguguggccagacccccagugacacccuggggugggggcuggccguggagaggcuggaggugaccucuccccggguguccuuccuggguuguacugggggccguggagaggcuggaggugaccucuccccggguguccuuccuggguuguacugggggccguggagaggcuggaggugaccucuccccggguguccuuccuggguuguacugggggccguggagaggcuggaggugaccucuccccggguguccuuccuggguuguaccgggggccguggagaggcuggaggugacuccuccccggguguccuuccuggguuguacugggggccguggagaggcuggaggugaccucuccccggguguccuuccuggguuguaccaggggccauggauggccgugaggaagguggugccaggagcugccuaucucaugguguggggucuguggcuccgggccaacauugccaccucccuaaagagugcacuuuguuauagcuuaugguucuucugugauucuuuauugcuuuccagguucucacagguuuaagagcaguuacccacacuucccccgaggacguaaguuuugcugaguccaggagagacggcuugaaggccauugcgaggugagucccaacaguuccucccuaaagucguaagucucugaaaggccagcagaugaacgcuaagggggauguuuuugcucagaggcaggacuuaugauucuucacuuccuagguuuccucucuuccagaggaucgucagucccagcugcuggaggcucuuucauucucuugcugucauagucguagugaauguuaaacuucuuuagggacacugggccccuuggagaauuggagaauguguccuggcccaagguuggcaaagaggagcugacccugccagccaguguuuggaaugaucucugcacucguugacagacacgcaccuggggccacgccauaugcccucuccucccugcaggcacacaagaggagcagucccgcgggggccacgcacgcccccuucucuccuaugccagcauccguucccucuagucagggugggaagugggagggaccagccgcagggggcguccccauccaccuuucaaccggagagacggcagagcgugaccucggggaagcacgucccacguuccauacauguggaaggagcucuguguuucugaucuacccgaggguccuggacuguucugagcgugucuucucaggaucaggaacacacaucagcccucugcgauguggaagaugaggcucaccgauguuuguuuguuagcucacacauuuuaaauuucaggauuugccagacuguuggugugaaagcaggagccccagacgaagcugugugcggagagaauguuucccagauuuacugugcgcugcugggcugcauggacgacuacaccacggacagcagaggggacgugggcaccugguacguacguagcagugggugagcgcuucuucugagaagcccaucuauuccguggaaacucggaggccccgggcuuuucugcagggagaaaucuuuguagauuugugccguguuuugcguuuuaaaggcucuggggaagaugaccuguucucugcucccgggugagccugcguggcagggcuuugcaggugcuuguccagcccguccucagguguugggccugugucguccucguugacagggugugagggaggacgcgucuucaaugaaaggcugccggcugcuuacauuggguuuugccaacauuucuugcuguagugggauugauaaccccugaaacgccuguguguguaggaugccucggggccccgguguguguggcuguggguggcucccugcacacgucccuguagcgcacagggaaccucugcaggccccgugacucccuggcagcgugccugggcucugugugggguuagucacgggugucgaauucacacaggcugccggcguggugggcagaaccaggguuggaaccccccucucaagcugggugucucugccucuccuugucccaucaggguccgcaaggccgccaugaccagucugauggaucugacacuucugcuggcucggagccagccugagcugaucgaggcccauacgugagugucacgucgcagcucuucugcauccuagagggcagccccgagcuuggggaggcuggcggggcgggcgguccuggugcucaguggcauuugcacugcugggcacacacccuccucccagagagccucucuggucccugaccccagguuugugcaggccccuccuccugcccccauagccauggcgugagcuggggcccauccuccucugcccagugcccccaggacgaggcucugcuccccagccugggccuccaacggugcucuggccaguuugaugacagccagcuucccgggguagggccgggcaggagguggggacuucucagcuuaggacccugaaccugggggucugcuccugccaggaccagcugagccaucacucaguucccugcaccugaggcugccauuggggccugcccuugcugugugucucugucgggggcacgggguuguggguacccccaggcccugcccuuucugucggucucucugucgggggcacugagucauggagguccaggcccugcccuugcggaucucugucaggggcacucagucaggggguccaggcccugcccuugcgggucucugucgggggcacugagucauggggguccaggcccugcccuugcugucagucucucugucagggacacucggccguggggaucccagggccugauuuccuuaguucucaccucuuucucuuucccccuccccaucucuuccccagccccagcuucucucuccccauccccggccucucuguccccaucacucuucuccacccgcuccuguaauccuauuuguugucccugcuucaacccuaagaccucaucagcacgcauguaacacguagcacauguguaacaaguacguagcauguauuugcugcgcaccuguaggguugggcuccugggaugugaagguaacggagugugguucuuccgagccaguguccuggugucagcugccaacucagccaccaugucccgaggagcccgcauguccucguggugcuugggcuggagucacggcucggaccgccugugcucaguuuaccgcccgcucuuaauuuaccgcccgcccuugguuuaccuccugcucucgguuugcagcugugagcgcaucaugugcuguguggcccagcaggccagugagaagauugaccguuuccgugcucacgccgccagcguguuccugacgcuccugcacuuugacagcccucccaucccccacgugccccaccgaggagaacuggaaaagcuguuucccagguacugucgggguguaggccccccgugcuggccccgcagccauggcgagaucauuggcagcccggccuugucucacucacucucuugcagguccgauguggccuccgugaacuggagugcaccuucccaggccuucccacgcaucacccagcuccuugggcugcccaccuaccgcuaccacguccugcuggggcuagucgugucccugggcggcuugacggagucgacggugaggaggcgucgggcuggcuggggcaggagguggcuccaggagugccuggugcuucccugucucuugggagcauguauggagcugggccuuuucuuccauugcuuucuaucucucucgggcauauuugguuagggggucaggggcccagugucuuccucaugacccaggaggcuuagggccugugggaugguugagucugaugaaggugggacagggccagcgccacucucuuccugcggccgcagccuuggagcucccagcguccccucgggguucaauccuccaggaccugugucugaugccugcauguggguaccugggcuccaucagguucuagaucggccuccgcccuccacuuucagggcuccaggcccagcuucucaugucuguggggagggucuccagagccuuggucuguggcugagcuguggaacuugaaggccucucugcaucuugucacucguggccccugcaccuugggucaugaccugcuuuauguggcaacccugugacagcugcuaaguccuagaaaacacguaacaggacgugaggugcccucugcgccgugugggcgcgugcggggagacccgggccccaggacgugaggugcccucugcgccgugcgggcgcgugcggggagacccgggccacaugcgagcggggccccgagacauucugcacucgggaauugcggggauuaucaaaucccgcuucagugggaaacgugagcgaaacccaaggugaguggccgcagccuuucgucacgugcucucccgcauguccuaagugagggcucaggcugagcugccguugccgagagccuugugucugcuucgggugucugcacugugaguggcuccgugcuggcguccgcaccagccgcuuggggccagaccuucgcgucucugcagcucggagcaguucugcucuucagcagaugcuugaccggcuguagccaagccugagggguggcaggcucgggggucccacugccuucugaggugucuccguguugcagauccggcacuccacccagagccucuuugaguacaugaagggcauucagagcgacccgcaggcccugggcagcuucagcgggacccuucugcagaucuuugaggacaaccuucugaaugagaggugaguggugucucuuggggccucagaggcgugaguggugcuggugccucucaccacguucccacagauucccggggucucgcagggucugucuggggucugaagggagaagcgagacacacgcuguaccaguugguggcucagcgaggaagaugugccugcagcauaugguucuccgggcggccaggccucagccccugcgccuccucuucuagccuccacaugaggcagggaaaugaccguuguguguacaauggacguaaagguaguaugaguacaagguggucccuguguguaggaaggcguugugggagcuccuccagcuuggugcucccacggacgugcuugcggacgcucaucagccacccggcaagugagagcucuguguuccugaggauggaaugucaagugagaaacaucgcugcuuucuagaaguuucuggcuuuacauggaggcagaguauagacccugugggccuugaccucagaauugggaacauccucuggaaggguuguucccagcaugugcgaggacgaggacacgggccugguguccccucgggcggggccucggcagccucucccaugagagcacagaugccgcucucggcaaacaggaacucggcccagccauguuuucuuuucucguuacgacuauaaucagcugcacauaaaggggcaguucgaucgauuuugauagguguccacccuuaaaaucuuccccagucaggacggugggcuccagcccaagguuuccucccagcccuucgaguccgugccccugaccugcgucaccauagccucagcccauggucacuugaggcgcugggccgcgugccggucgcucauuccuccgugccggucgcucauuccgccuugccguucgcucauuccuccuugcugaccagucgugucuguugguggaggcaccacagugcaucugucugugggcauuuugguuguugccgcaucggggcuguugcugguagagcugcaggcagucugugugugcgagccuguggguaggugugcacagcugggccucccucucugugggcugcggagcccagcucuccuguguguuagucggccugugcuaaagcucuccugaugcuccugucgcccagaggggaccuccccagccuccuuuucugugggguaaauaccgaggcgccgcaggcuggcucacacagaggcgaaugucuagcuuuggaaagcugcuggaggguuuccagaacgcccacgugucaugucuuucugcugaugcugucugaggucacucucacuggcgcguugcuguuuuauauucucuuuggagaagugucuucauuuuuuucuguucuccuucccugacuguuguggucugauccucccuugucacacaugugacuugaggguguuuucucccugccuguccuuucacgcaccgagcgggggccucacacuuuccucacgucccagcaucuccccuuguucucugaggcacagauuuuucuggugugucuaagacagcuugccuaauccguggucacugagauuuucuguuuuguccuagaagauuuauaguuuuggguuguguauuuagaccugggacgcgucuugagugagguuucuuacaugguauagcgucggcacaggcaccuugacgcccagcggugcccaccccaauugcugggagggcuccccucuccgcugcauugccguugcagcuuuguaagaaacuguggguuuacuuuggacucuccugugcccgacguguuugcuucacuuugcaccagggccgugcuguuucuaucccuuccacuuuaccaucauuuucgaaguucagcgucagccuccagccuuguuucuucuuuccacaguuguuuugucuuuuccugaagcuuugcguuuccacguaaauuauaaagggggcuugucgcuuuccacugggauccugcugacucucagccauucagggaguugggcguccuuguugcugguguccagggucucacagcuccuucuccccucaggguguccgugccgcugcugaagacgcuggaccacgugcucacccacggcugcuucgacaucuucaccacggaggaggagugaggcucugcuuuucaugacuuccuuuccgauuaagccuaaguagcucauguauuaaagaaaaagucaucagacacagagaucagaauuccaggaaaugaucuuccagugcguucugggucaguuauggugacuguaaauaccgucaucacagcuggcccucaaaauaacgcaauaauaacauauuuacauaaugacauauuaugacuguaagugcagucagccccaucuggggcugaggcgggggcccugcugugcacucuccccccagcuaucccaccgggccaggggugggccucaggguugugcugggagccgcagggccugaaggggccucggcuguacggggaugagacucgcaggggagagggcagaggccggugaccuggcgaggacuugcccaggagauuggagcuccuugcuucugcgccacgcggaugccccaggcuggucucagcuggguuguuggcucugaguggucaucucguugcugccauauuuucuugcuucauugaauuucaccguguugggccagucuuuuuuuuuuuuuuuuuuugagacagggucuagcucuguuucccaggcuggagugcaguggcacaaucacagcucacugcagccucuaccucagccucccaaguaucugggacuacaggcaugcgcuguagucuaauguacggcuaauguuuguauuuuuaguagagacaggauuucacuauguuucccaggcuggucuugaacuccuggccccaagugccugccuuggccuccuaaagugcuaggauuacaggugugagccacugcgucuggccuggauauauuuguaucuggggcacguugggucauccggagacagcguggucuguuuuugggggcacugcuuuuuuuuuguuuguuuugagauggagucuugcucuguugcccaggguguagugcaguggcucgauuucagcucaccgcaaccccgucccggguucaagcaguucucucgcagacuucugaguagcugagauuacagcugugcaccaucacaccuggcugauuguuuguauuguuaguagauacaggguuucaccacauuggucaggcuggucucgaacuccugaccucaagugaccugcccaccucggccucccaaagugcugggauuacaggcgugagccacugagccuggcuugggcgcuacucuuaagcugucagguggacccagagcugugcuggucuccaggguuuucugccccuuuaaggucucugcucccuggcgcuucccuucccaccgcugcuggggcagugccggggcuucuggccaucuuuugggugguucguccccagccuuggacagcguccucguacucagguacuggcugacccaggcccagguuaguccucagcggcccccaggaagcccccucuggugcucagaaccugagcgagcucugcagacuuggaauuucccgcuucucaccacgggcuucccgcuggagucugccaccugcuggacuuggcucugccuuaaccuucgggcgggaggcagaucuggucucuguugcuccaucuuugcuggacgcugcacauguuuuuaaaucuaacagcauugaaggguuuccccuuuuaauuucuuaauggggcaucacugacugaccuucuuacaccugcuguuggaacagccuccauguucacaggugcacccagcucgguuguggcguauuauccuuuaauacaaugcuaaauacuccauuuaaauuuuuuuuuugagauggaguuuugcuguuguugcccagacuggagugaauuggugcgaucucagcucacugcaaccucugccuccuggguucaagugauucuccugccucagccucccuaguagcugggauuacaggcaugugcuaccaugcccagguaauuuuguauuuuuaguagagaugggguuucaccauguuggucaggcuggucucgaacucccgaccugaggugaucugcccacuucugccucccaaagugcugggauuauaggcgugagccaccguaccuggccuaaaauauugacauauauuuuucuggcuuaaaaauuucaaaauaagccugggcgccauggcucacgccuguaaucccagcacuuugggaggccaaggcgaguggaucacuugagcuccggaguuugagaccagccuggccaacuuggugaaaccccaucucuacaaaaaauacaaaaacauuagccgggugugguggugccuguacggcuugggccugggaggcgaagguugccgugagcugagauugagccacugugcuccagccugggcaacacagccagacucuguuucaaaaaaaaaauuuuuuuuccaagauaggaugguagagaaaauaccuccugccauguccugcuaugaauacagcuuuguauuucucucuacaguuuugucaguuuuggcuuuucagauuuugaagcguguuugugggcugaaucuugcccuuaucacccauuucuaggaugcuuuuugcuccacucauucuuugucuugcuucacuugacuuugaacuguauacuuuuuuccaucguuuuacuuucaguaucuucauacauguauguuuuuguacgccucucuuagaacaguguaugguuuuguaaaaauucagccuguagcuuuuaccugccuccuucaugaccuuuauaauccccuugguucucagccugccacucacaggacuuuucccugugcugcguucccagugcccccuccccgcccccaccugugcuuuuuguuggauuaguagaauugcuuuugucauuccauuguuuucauauauuuguuugggacauuuuacuuuuuucuguuaacgcuuacccuagaaauuagaaaugacaccacguauucuuagcgaaguccaguuuucagcauuuuguccuuauuggacaauagcaaggauauuagaacguguugguuccgcgugcuuccgucuugaguuaugugcugcuauugucggauauuuugucuuagauguacguacuuuccuguucauugugguauguguaauuugcguuacuuugaauuuuccacguuuuuacuuucuuugucucucaucacuuacugcuuuugggaccccccccaucgggguucacauucccucucccuagagcacacucccuuggauuuccucgaguggggucugcugcggugaagcuuucccauuuuaugugcagauuauuuucagaggguauauagaauucaggcagcuguuucguuguagcacauuaaaaauauuuucccacuuccuccuugcuucuguuguugcuuuugaguguuaccucugagucugccugugcucccuggaaacggcccggguuucccacccccugcccagguuugcuccuucccugguuuuucugucauuaucacgcucacguguuucccucggucacccccucugcaauuuucacacgucuuuucccucucucuuugcuucauuaccuuuggcccgccugccagcugcugauucucucugaagaugucucuaaaugacuuuuaacugugauuuguggaauucuuauuguggaguuuugcgucuuuucagguguagguuuuuugucucgcguguuuccacgucugcuuguagcgcuuuccgcuucgccguucccugcggcccuuccuuccgugcccgguguucauccucuugaaugcucuuuuccugccuguuuggcugggugugucugaguugcaaccugagcggguuucuuugucuucuuacuugucugguauuguguucucucgggacguugcguuugaggggucgcaccucagagcaagccgaggucugggcuaagccugugcuuuggcaggcaggaccuuaguuugccuuuucugggcaccugaggagaggguagcagcagccuggggucuccuugacucacggucagcagugaggguuuccuggccuguuggguggcuggagcuuggcugcauuccccacugagagagggaggugcgcaccuucuccucccuggaguggccuuccaggugcccucucagagcugcucaucagggcugugccuuugucagcaccaagccucagcccuugucccugcugccacugaaggcucaaaacaacacugcacagccuuguguguccucugugugucggcaguuucccccggcucugcagcagcccaggccagguagccucuggagggagugguggaggagcacgggcauccuggccgccgcuguguuggggacagacccuggggccuggaaagggagguggggccccgugggggcugcugcaccacaggcaagagagcaagagacagcagaggccggccaggugguggcacagccgcuagggaccaggccggccuguggagguauugggauggggaccagcggacuugcuggcagaggggccucagggcugcaggcuucuuggacugagccacugggaggacggaguugaccuucuuugagacagaaaaagugugcaucccggggcugccugugaaagcucaucucuaaaguguguguuguucuuccagccaccccuuugcugugaaguugcuugcgcucuguaagaaagaaaucaagaauucaaaagauauccagaagcuccugucaggcaucgcagugugaguuucaagugcugcuggccuuagacggaauggcagggcgcagccucccuuggcugagggcaggaguccacggcuccaggcgggagaggagcaguuaguguuacuccucaagcuaaccuaagaucgugcauuccaauguucaaagcagucgcaaugggaggugaggcagcccaggugcugguggagggaguucccgcgggaacaggcgagcucugccucugcugcccucgcgcucugcccuggcgggaggggaggcuccggaaaggagcugcguggucaggggcugccuccccgauucuccugugugcccugggggucgcuguugagugccuugcucugcggcgcucagguggacacugggcaggugcgccagccagcgauaggcaccuuggcugcucuguggcuccuugagguggggguccucauggcagggcgagcggcccugcaggagauccucugugaggcguccucacuucccacagugacuuuccaagugcgacacucguguguguaggcacagugcagauguacgcacacacacaccuccggcuuggggccccaggcccgcacugugcucacggaucugcucugcccaggucucugcaugggccuuuggguccgggguuugcugggguuggccugcgcgggguggggcucaccuggagccaugugcugcucccggcagguucugcgagauggugcaguuccccggcgacgugaggaggcaggcccuccugcagcugugucugcuccucugccaccguuucccgcuggugagugccugccccugcucacguguguuugccguguggacacaagccccucagugacaagaaggccuucgcuggcacuguuguguuggugugcuuuccagccgagccccucucguuaacgcgccugggugacgacgcgucacaggcacgcggcugccaaggggcucuggacgccacuguucuggcuuuaaggacgggcuguccggcuggcguuucuauggacauacauugaggggugaccuggcggugggaucuggcucaggagcuuccagaaggacccaggcugaagugguucagccacaccuaggggcagugcccuucauccccagcacuccccggcuauuagauuucuaggauuucuuuucuccuggcugcaaaaaaaaccucagaugauacaaaggugacauuuuccuaaaaggcaaaaguaacuucauguuguauggugguucucgaaguggggugccggacccucaggcuuggcaccucuggggcuucagcagugcagcucuugggcccugugcugccgacucagcaccuccagggugggcccggggcucagaccaccagcgcagugagacaugaugaccagggcaccacucaaaaagagagcaggcgagauugcuucccugaugaaaagagagcaggcgagauugcuucccugaugaaaagagagcaggcgagauugcuucccuggugaaaagagagcaggugagauugcuucucuggugagggagcagguugguuaauagauagcgggcgagauugcuucucuggugagguagcagguugguuaauagagagcaggugagagugcuucucugaugaaaagagagcaggcgagauugcuucucuggugagggagcagguugguuaauagcaggcgagauugcuucucuggugagggagcagguuaguuaauagagagcaggcgagauugcuucucuggugagggagcagguugguuaauaaagcauuuaaacaagaaugaugucaucuucacugcugggauccugcagcuagcugugugucuguggagggaggaggugguuaaugggccuggaaggcaccuccucuugguugcagcccugcuguggcugggaugggaugcagggucagcguccuccuccugacgccuuccacugacggggcucccuggccuggguccugucgucucuccgggguggggcgguggcgcuucccuccggcaaaugcacugcaucccugucccagauccggaagaccacggccagccagguguacgagacauugcucaccuacagugacgucgugggcgcggaugugcuggacgagguggugacugugcucagugacacugcguggugagugaaggcccuuccugcacggccaccugggccuggcaccgccccucuuccuguccccaccgugucuacucgucucucccaaaacccucugauaggaggaggaaagaggguucccaggucuccacauccucugcuuagguuuuacaaggcagccgugcugcuguagccgaaaccucuucucaaccgcccuguccccaaacagugucaggugucaggaacacagcaaagccauccaucccaccaggggagcgggcaccuguaccacaaggcugugucugguggccuguggagcagagggcacugaaggccuggcaggugcugcugccccagaccucucuaaaguucucuuggaauaggccgugugagcaccuguuggaaaucaagaggcacaggcggaaauaagaaaagcucuccccacgccucugcucugauguccacccccuuccucagggccaugaggcccucaggaggccauagugccacucuccacguuuacuuuggcaggcacaguuucugcaacaugggcuggcuucuuuaccauggguggaguagaauggcgguuuugaaagauguguguauugaguugggggugggagggucugaaugagagcagaguggggaaagugcaggcucagguguccugggccaaccgguauguuccugggaacagcagugauggugucuuacacauaugggcaugggcacccaugcuggcucacacacaugcucacuugcacgcgcgcacacacacacacacacacacacacuucuaaaaggggagcagucucgucaccccguguuggagaucaggacugaagcaaccagaggcuguguggguguccacauggcauacccggggugguggagucccagguguccugccuguggaugcugcucuguuuugagugccgacugugagggccuccgugcugaucccggugcguugcuacaggucugugggguccacgccccuuguugaauccagcaaggacguaggugacguucccuaggugucuccucggaacagugaccuuccaacagggcuggguucccauagagcucacgcaccaggcagccgcuguggccucggaggacagagguggccucuccagggcuuccgcgagguuuucugguuuggggaggagugugugucugcuccuaaacaaacacguggucccaggagaggaaccgggagcagcugggcugucuucucaacaugcguugagagaauggccaucuuaacuacugcucuggagacccguuuuuacaaugauuuuuuuaaaaaaaaacaccaaggugcauucuggaccagauucuaaaauaauuggcuuuaggacugaagaagccaggugucccgagcggggcgaggccuccuccagcgaggcugggucgggguggccuccuuuccucacaucagggagggaggaacuagcagggugggccugggggcuucuccuaucguuuaauccccuuucuguuaaaaaaaaaaauccuuagaauuuaaagagaauauuuuaaauuagaaacgaaaaacaugccccagauaucuccacagcauugcuagaauuuuuauuucgcaucaacagcuaaauuaaaaccuggaaaacccuugucagccccuccuuggccucgcuuggucuguccucccgcagucccugcgcugggcgugguccuucccgaggggcaccccuuguugggaaggaaccguccuccugcgauuccggaaagggcucaggcucgaggcucugcuggagaacgugcuccugugacgucuuuucugcccucagccuggcuauggaugucgggggugaggucuccuuucccugacugcggccauggaagcuugacgcgggaccuccgcacaccugagguucuccggugggcacucgagagacucacggcucucccucuccucacagggacgcggagcuugcaguggugagagagcagcgcaaccgucugugugaccuucugggcguacccaggccccagcuggugccccagguaacccugucaccuucacagcaugaggugccugugcuucccugagcucuggaauguucuggggccagcggcugugcuuagcuucugccagcacguccacacggcccguucccucgucucaugucaggaccccugggauuacgggaccagcagagcugccuucucuggccacugcccacaccugugggccccuguggcauccaggccacuugcucuggggcguuuggggggccggggaguggguggagcuggcaccagcuugauccaggcuccucaugccuggcccuggggucuguuugugcuccaagugccaagagugccacccuaccccuccucaucugcuucccaugaguggggccggggcugggugagaggcccccagaagcugccccugugcaccucaccagcccgucacucuucuaaaguaacaaaaacaaguaccucaguucucucgggggcuggggcccaggguugcugugcugucucucuaguuaccaggguuggcuccuuccucucagccuccuuccggcaggagguuauaucugagagggaggaggagaaccaugucuagauacaugggggcaguggggaugggcugagcaucaggacacagccucccccauuucuguguguguaaaggcugaacucaacagcagacuuuggaauuaaaugugcuuuuuacauuuuuauuaggaaaaauuucaaacgugugaaugcagguuaagagcagugcagugaaccucccuucccgcuccccagauggggugcccuuccgaggacacguuagucaugagcaccugucagccacauagcucaggcugccgggugugugggaaacggcacaaaugguuuccugcaggaaccgugucaguccccacacagggcccagaggggugaggguccccuggcugggaaugguguguguuggagcugaccagccugagcuugucuugucucuucuucagccuggugccugcugaagccaguccuggagcccauaccucaccccugccuggugaggaugucuuguuccugagggaggccgguguggaaagccucgcacaguggugccuccagcuguugaaggguagcgcuggcccuuggaggcuggcacuagcugacagcuuuuccucucugcaccugcgcucuggugacuugggguggacgccucugccuucacuugaacacaaaugugcuuccuauaaaaucauguaccaagaaguuccugccuuuugucucugagccugauguguguaggggugauggaaaggcucacugcccaggggucagccagaggggaggugggcugcacuccuccugccuggagaccaggcccccuucuugccuggugcugucccugcugugggagacgucuggccacaggcagugccccacccagucuuggagagagaugaauguuaaaucagagguucaaaugcuagagaacugagaagcccugguggcaggcauggucuggagugcugggcagaugcuguuucugggcccgucugccuggugggggugcuguccuccccccugugcacacgugagcaucgugcauguggccccucugcagugcaggagucacugauugaugggugugccgaccagcagcuucacaaaugucugcugcaaggggaaucgucagaguccaaugugugccucuacaguaaugucggaaauaaauaccauucuugaaauaa

SEQ ID NO: 192337 - RNA, 108020 nt, Homo sapiens
gccgaagcggcgggaugagcggagccggcgugggcggggcguccgaggagagccaggccaugcaggcccacgugguaggugccagcggggagggugccccgccgugcaggcuggguccucgcguccccucaccccgcccuccaguccucucucgcuccgggguucgcagccccgcaccgccucucgggcucaccuacggggucuccgcccugagcagcccuuaggccccgcgggcgagcgcggcugcgcgugcgggggacgcucgggauuggagcccgcggggcgcggccgagaucugcagcuccggcugcgcuuccugcccccgucccgcgagcguggccuccucaccgaccuuccucguucugauuuugaagcuuccgggcucggagcucaggcaguuccccguucgcccucaccuggucgugggguggaggaacggcgcaccugccucauccccgcccgccugccccgcgcuccuuccccgcgcccgcacaccugccucgcucccgccucgcuccugcgcaccugccccgcccccgcgcaccugcccccgcaccucacacaccugguccgcgcaccugcgcaucugccucgcucuuacgcaccugccuugccccugcacgccugcccugcacaccugccccgcccccgcacaccugccccacaccccacacacgugccccgcgcuccugacucgcccccgcgcaccugccgcgcgcaccugccucgcucccgcaccccacacaccuggucugcacaccuccccgugccccacaccugccugcacaccuguccgugugcccccacacaaccucgcaccccacacgucugccgucacacauucccggcacacuugcccaugccccacacacacgucuugugccugcacaccugcuucacacaccugcucugcguccugcauacaugcccgugccccauaccugcccgugcaccugccgugcacaccugccugcgcaucccacacaccuaccugcacaccuccuccgugcccacacaccugccugugugcccagcacacuuaccccaaacacgugcccuaaaaaccugcccuuaagccccgaacaccuuccccgugcuccggcagaggcuggagcaaaggcccucaggguucagacccagccaauaggccgaugcagggaacaaccacagggauguaggauuagcagucgcccaaaggcucagcauguuuucuguuuuuuguuuuuuuguuuguuuuuuuuccagccuuuuuucuuuuuuauuccagucuuacuaaaauugguaacaggugaaucaaggucuaucuuugauagaaacauuauauuuuguagaucuugagaaaaauuauuuccuucuuuuccucuaaguaaauccaaacuaagguaaauuuguaaauaaauuagggaacucguuuuauuuuuuuuuuaauuuuuauuuuuugaaauggaguuucacacucguugcccaggcuggaguacaauggcgcgagcucggcucaccgcaaccucugccucccggguucaagcguuucuccugccucagccucccgaguagcugggauuacaggcaugcaccaccacaccaggguaauuuuguauuuuuaguagggacgggguuucuccauguuggucaggcuggucuugaacucccgacaucagaugaucugcccgccucggccucccaaacugcugugauuacaggcgugagcuaccgcgcccggccagaacucguuuuauucuuauuaaccuaaguccaggaagagacagagugagguuucauuuguaaagaacuugacuaaauuguguuuucaacacaauuucaacuuuucuuuuuuggauauaaauuaagggugaggacagacuaaucucuuaaguaucgcuccguaucacuuaauauuauaauguaugaaauuaagacuuaacuccuguaaucaguuguuuuguuggcauugaauuuccugguuuuacuccaucccacuuuauaaauuuuuguuuugggcuucaugagaaaaggacaaugagaaaaggacacuagcuacacuagcccgaaacgaaguguaggacaaaggaaucgagagauggacgucaggccucccauuugcucagcuggguucuuugaacaccuccugcccgauacuuuguuaaaacauuguuuuuugugggcugagggguuacuuaaagggguuacuuuguugcagguuuucuaacaugguuugccgaaaugcuuauuccaccuagaacaugaccagccagcaccuguaaucccagcuacucgggaggcugaggcaggagaauggcgugaacccgggaggcagagcuugcagugagccgagaucgagccacugcacuccagccugggugacagagcgagacuccaucucagaaaaaaaaaaaaaaaaccaaccaguuauuuucaugagugaguuggaagauacccagauacuuguuucaaccaaaaugauguuucugaucagugauuggaaaacucaugauuuaccauugaguugggaacaauuugaugccuuucaguuuuuuuguuuuguuuuguuuuguuuuuuugagacagagucuugcucugucacccaggcuggagugcaguggugcaaucucagcucacugcaagcuccgccucccggguucacgccauucucccgccucagcuucccgaguagcugggacuacaggagccugccaccacgccuggcuaauuuuuuguauuuuuaguagagaugggguuucaccauguuagccaggauggucucaaucuccugaccuuguaauccacccaccucggccucccaaaguccuuucaguuuuuuuuucacuuucaaaaacauguagaaggcaguucagggaaagcuaagacguaaagaaucuuacaagcauguuaagagccuggagaaaaggaguggacaccuuuuguuugucacggcauaugugcggguggugaaggggagguaaauuagagccauggaaagggaacuaaguuuucacacuucuguuaauccauuucuuuugaauuccagucuauuauccucccaguccacaacgcugaaccguggcuggacgaauguuugaggucuguuuugcaacaggacuuugaagguaccauggagcugucuguuuucaaugaugccaguaagguuuguaggaacuuccugucgggugacucagccccaguguaagcaacgguugacuguucggagggaaguuuccugaccugccaguguucugcuuucaggacaagucuggggcuaucauugaaaaauggagagugaagcuggaagauucugguguccacgugaucauuggggggcacgauucucccucuccuagaggcgguaaguaaacaugcuuaguuuauuaaacuauaauucgugguuucuuaucaacuuacguaccgaaacaguuucauguuguucaaauacugacaaaaaguauccuggugguaauuggauauaccacuuauuaagaaccuaguagaggccaggugugguggcucacaccuguaaucccagcacuaugggaggccaaggcaggcggauccuuugaggucaagaguucaagaccagcguggccaacauggugaaaccccaucuuuaccaaaaaauacaaaaauuagccgggcguaguggcacacgccuguaaucccaacuacuugggaggcugaagcaugauaauugcuugaacccgggaggcagagguugcagugaaccgagaucgugccacugcacuccagcuggggugacagagcaagacuccaucucaaaaaagagaaagagagagagaaagagaggaaggaaggaaggaaagaaggaagaaaggagagggagagaaaaugaaagaaagagaaaaagaaagaaaagaaagaaccuuaguagaccuaaaauuuuuuauuguuugguaggauuuauuauagaccuaaauuucuuauucuuugguaaggauuuauuauagaccuaaauuucuuauucuuugguaggauuuauuauagaccuaaguuucuuauucuuugguagggauuuauuguagaccuaaauuucuuauucuuugguagggauuuauuauagaccuaaguuucuuauucuuugguagggauuuauuauagaccuaaauuucuuguucuuugauaaggauugauuauagaccuaaguuucuuauucuuugguagggauuuauuauagacuuaaauuucuuguucuuugauaaggauugauuauagaccuaaguuucuuauucuuugguagggauuuauuauagaccuaaauuucuuauucuuugguagggauuuauuauagaccuaaguuucuuauucuuugguagggauuuauuauagaccuaaauuucuuuuucuuugauaaggauugauuauagaccuaaguuucuuauucuuugguagggauuuauuacuaugaucugaaugucugugcccaccccgagauucauauuuggaacccccagggugauaguauuaggaugacauuagguggggacuuugggaggugauuaggacaugaggguggggccucaccaaugagauuagugcccuuauaaaagaggccgcucagagcucccucaccccuccugcucuguaagaacacagggagaaggcaccucugugagccaggaaggggcccucacuagacacugaaucugcuggagcguuacucuuggauuucccaggcuccagaacugugagaagccccuucugccacccagucugggguauucugcgguggcacgcaggcucuuccaacccuggcaaccacucgccugcuuucugucucuguagauuugccuguucuggacauuucaugugaauggagucagguuccacgugcucuuuuguaaccggcuucauuuagcauaacguuuuaacguuccucugugcuguggcauguaucgugcuccguuccuuuuucugggaggaugauaugcaguuguacauaaguaccauguuuugugugucuguuugucaggcaguggacauuugaguuguucuacccuuugauacugugaaugaugacagucugaacauuuguguacaguuguuguuugaacacugguuuucagauccuuuggguauauuccuugguguagaauuucuggcucauauuguaauucuguguuuaacauacugaggagcugccaaacuuuuccacaguggaugcauuuuacauuccuaccagcaauguaugaacguuccaauuucuacauauccucaucaacacuuguuauuuucuguuuuuuaaauuauagccaugcuagugggugugaaguggugucucacugugguuuccauuugaauguccuuguugacuaaagauguugugccucuuuucgugugcuuguuggccauuuauauaucuuccuugggccaggcauggugacucacgccucuaaucccggcacuucgggaggccgagacggguggaccaccugaggucaggaguuugagaccagccuggccaacauggugaaaccccaucucuacuaaaaauaccacaaaaaaaaauuagccaggugugguggcaugcaccuguaaucucagccacuugggaggcugaggcaggagaaucgcuugaacccgggaggcagagguugcagugagccgagauggugccacuguacuucagccugggugacagagugagacuccaucucaaaauaaauaauaaaaaauaaaugggccggguuuggugggucaugccuguuaucccagcacuuugggaggccaaggcggguggaucaccagaggucaggaguucaagaccaagcugcccaacauggugaaaccccgucucuacuaaaaauacaaaaauuagcuuggaguaguggcagcggccuuuaaucccagcuacucaggaggcugagacagaagaauugcuugaacccgggaggcagagaucgcgaucucugcugugagccgagaucguaccauuggacuccagccuggcaacaagagcaaaacuccgucucaaaaaauaauaaauaaauaaauaaauguauaucuuccuugaagaaauguuuauucaaguauuuuggccauuuuaaaaauugagcuguauguguuuucauuguugaauuguaagagcuccuuauauguucuggacacuagagcuuuauuauauauaauuugcaauuuuuuucccguucuuuggguuaucuuuucacccucucgagagugucccuugaugcacaaaaggcuuaugauuuugaugaagacaaaaaucuaauuuaucuauuauuucuuuuguggcgugugcuuuuggugucauuucuaagaagccacggcuaaaucaaggucacgaagauuuuaucuguauguuuucuucagaauuauacuuguagcucuuauauuuaggccuuugaucuauuuugacuuaauuuuuauguauggugugaagcaaagguccagcuucauucuuuuguaaguagauacucaguuuuuccaacaccauuuaaaagacuauucuuucuccacugaauugucuugguauucuugucaaaaauccauuaaccauaaacguauggauucauuccuggacuccagauucuauuccguuggucuauaugucuguccuuacgccaguaccucauuguuuugauuacuugagcuuugugauaaguuuugugaauuguuuucuuaauuuucuuugagagugcucauuucuaggggauaaacaacagauuucucuuaguguugaccuuguauccuacaauuauuagcucuaauaguuuauuagcuuuaauaguuuguucuuuguggguuuuuaggauuuccuguauuuaagaucauauuaucuaugaguagagauaguuuugcuucuccuuuuacaauuuagauucuuucuuuuuuuuuuuuugagacagagucucacugugucauccaggcuggagugcaguggcacgaucucagcucacugcaagcuccgccaccuggguucaagcaauucucaugucucagccucccgagcagcugggucuacaggcgugcgccaccacaaccagcuaauuuuuuuguauuucuaguagagacgggguuucgccauguuggccaggcuggucucaaacuccugaccucaggugauccgccugccuuggccucccaaaaugcugggaugacaggcgugagccgccgcgccuggcuuuuaucuuucuucaucgcucugguuggugcuuccaggacggugccgaauagaaguggugaaagugggcauccucgcuucgguucucccaagcaauuguaggggaaaagcuuucagucuuucaccuuugaauaugacguuagcuguagguuuuuauaaaugccauuucuuacgcuaaggagguuuccuuuuaauucuagucuguugaauuuuuaaaucaugaaagggugccggauuuugucaaaugccuuuuugacaccaauuugagaugaucauauaguuuuuuccccuuuaucuguuaagaugguauguuacguugauugauauccuauguugaacugcccucacauuauugggauaaaucccacuuguuccugguguaaaaucuuucuaguauacugcuggauucaguuugcuaguauguuguugaagauuuuugcauauauauauuuguaagggcuauuggccuguagguuccuauucauaugauaucuuuguguggcuucgguaucagaguaauacuggccucauagaauaaguguuucuuccucuuguuuuuuggaagaguuugggaaggauugguguuaguaauucucugaguuugguggaauucaucagugaggucaccugacucugggcuuuuuuguugggaguuuuuguuuuuuuuauuacugagucaaucucuuuauuuguuauagguguguugagauuuuuuuuauuucuucuugagucaauuuugguaguuuguuucuaggaauuuguccauuucaucuagguuaucuaacuuuuuuggcauauguuguuuuucacacugucauaauccuuuuaguuucuguuaaguuugggagucauguaccacuuuuuauuucagcauuuugagcugucuuuccuucuuucucagucuagcuggguuugucaauuuuguugacccucuucaaagaaucaacucuuuuuguugauuugcuauuguuuugucauuguuuguuuauuuucacucuaaucuucacuguuuccuuccuucugcuagcuguguguuuaguuuauuuuucuuuuucuagcuucuuaagguguacuuuuagguucuugauuuuagaccucuuuuauguaggcauuuauagcuauaaauuccuuucuaugcacugauuuuucuacauccugaaaguuuugguuuguuguguuuuuguuuucguuugucucugaguauauucuaauuagccuuaugauuucuucuuugacauauugguugcugaagaguauaugguuuagcuuucauuuauuuaugaauuuuucaguuuuacuucuguuacuuauuucuaguuucauuucacuguggucagagaagauacuucauauaauugcaaucuuuaaacaaauguuuaagguacauuuuauggccggacgugucaccuguccuggagaaugcgcugugcacaccugagaauguguguucugcugcugucaaguggaguauucuguauauuucugcuaagucuaguugguuuauaguauuguucaaguucucuguuuauuaucuucucucuagauguucucuccauuauugaagguagaauguugaaucuccgacuguuacgguagaacuguuucucccuccaauucagucaaucuuugccuuacuuaauuuugugacccucuuguuagauguguacaguuuuaugcuuguuauaucuucuugaucaauugacucuuucuuugucuuuucuaauaauuuuugaguugaagucuauuuuuucugauauuaguacagccacgccagcacucuuugauuacuaguugcguggaauaucucuuucccuuguuccacuuucagccuacuugugccuuuggaucugaagugaauuccucauauagacagcauuuagauggaucauaauuuucaagauccguucugccagauuuugccuuuuaauuggagaauuuaguccauuuacauuuaaagugauuacugacaaggaaggacuuuugccacuuugcuaucugcuuucuauaugucuuaugucuuuuuuauuccucaauccuguauuacuaccuucuuuucuguuuaauugcuuauuuccgaugugccauuuugauucccuucucguuuccuuuucuguguauuucuaaaugaucgucuuagugguuacugugaggauuacggugaacaucuuaaauuuauaacaauguaguuugaauuaacacuuagcuucaaucauguaacauuaacauaaauucauaaauuauuuucaugaauguagauuuagauuuauaauuguuuccugguguguguguggcaguagggggcaggggcucacuccaucacccaggcuggagcgcaguggcgugaucuugguucacugcaaccuccacccaguagguucaagugauucuugugccucagccucccagguagcugggaauacaggugccugccagcacgccugcguaaguuuuguauuuuugguagagaggggguuuuguccuguugcccaggcuggucucgaauuccuggacucaagugauccacccaccuuggccucccaaaguguggggauuauaggcaugagccacagcaccuggcuuguuuucuguauuuguuuuaaaagcauauaggaaaaauacaaaccaaaauaguacuaucuuuuauauuuaccugaauaguaaacuuuaucccuguucuucauuuguucuuucucuaugaguuccuguuuagugcccuuucauuucagcccuacaaugaacugccucaguuuuuguuuaucuuagaaucucuuacuugcuucuucauuuuugaaagaugacuuugcuggauauaggauucauaauugacaguguuuuucuuugagcacuaugaauacagauggcccccagccugugauaguucaacuuaccauguuucaacuuuaugauggucaaaggcaacacaaauucaguagaaaccaugguucugucaggauaccaggcaguggccaugagucacagcucccaggcccccaagcauuuuugacuuaugauguuuuaaacuuacagcagguuuaccuagacauaggcucacccucaguugaggagcaucugugugugaccccauugccuguggccuucauuguuucugaugagaaguaagcgguuaaucuuacugagggucucuuguaagugacaagugauuuucucuugucgcuuucaauauuuuguccuuaucuuugguuucagcauuuuuacuaugauguguuuagcugcgaaucuucuguguuuauccuacauggaguuuguugagcuuccuggauguguagaugaauguuuuucaauaauaugagaauuuuucagccauuauuuuuucaaacuuuuuuucugcuuauuucucuugccuuuccgugugguacuugcauugugcauauguugguauaguuauugguauuccagcuuucucugagaugcuuuucacuuucuucauucuucuuugucuccauuuucagauucagacuuacccaucuaucucuguguuugcuaauuuuucuucugcauauuuaaauauacucuugagcuccuccaguaaaauuuuaguaauuugagaauuuuucagccauuuuuuuuuuuuuuuuuugagauggagucucgcucugucacccagccuggagugcaguggcaugaucuuggcucacugcaagcucugccucccaaguucacgccauucuccugccucagccucccaaguagcugggacuacaggcacccuccaccacacccagcuaauuuuuuguauuuuuuaguagagaugggguuucaccguguuggccaggauguucucgaucuccugaccuugugauccgccugccucggccucccaaagugcugggauuacaggcaugagccacugugcccagccucagccauuauuuuuucaaacuuuuuuucugcuuauuucucuugcucaagaauauuuuuaugcucaguugacagauuggcuggguauagaauucuaggugcaaaauaauuuuucuuagaauuuuaaagggauugccucauuauauucuaguguccauguuucuaauaagaaaucuuacaccagucugacucuuguuauuuuaaagguauuguuucucaaaguauuuaagauuuuucuuuuuguacuuuugaauuuugaaauuucaugaugcugggucaagcuguguucagguuucuucauucacccucuguuuuuauguugaaugauuagcuuguguucuuagcuuugauuguaauagaucaggguccuuuuaguuugacuuuaaaguuuccauauaagacuugaaaaaaauaugccugccuauauugcauggggcugaaaaagucaagguuggcagaugauacguuuuuaguugguggacggguuccuacagauuuuaggagucacagcuucucuaagauaauggucgucaacuuugugcacguuagaaucaucagugaguuuuagaaaaccagugccugagucucacccuaagauauucucauguaauuggucuggggugcagcgugggcauugggauuuuaaaagcuuuccagaagauucugagacacauccaggaucaggagccacugcuuuagaaugugcucaggaauggguggcaucaccccacuuucuaguggacuugguccugagggagucuuacagcuaugacguauuucaagggcaagcggcugaggguuuacggucccucuggaauguccccaugugagagccuggggaguuaaguccucuguuggguccuguucagaucugugagacucacaaaaucacaggcucaccugcggggugucucaguggacaggagcagcuccuggccccagcucuucuccugcagugcccuggggcucagaagacgcaggaguaaaguagacuuggguguggggccaggcugguggggucggcuccacggccaccucgcucugccuccguuuccuuauuugugaacaggucgugguagucagcacccaucuuggagugcugugaggugugaaaugagcuaaucugcagugugucuagaacaggggcgggcagcgggcgcccagcagugugucuagaacaggggcgggcggugggcgcccagcagugugucuagaacagguucgggcggcgggcgcccagcagugugucuagaacaggggcgggcggcgggcgcccagcagugugucuagaacaggggcgggcggcgggcgcccagcagugugucuagaagaggggcgggcggcgggcgcccagcagugugucuagaagaggggcgggcggcgggcgcccagcagugugucuagaacaggggcgggcggcgggcgcccagcagugucuagaagaggggcgggcggcgggcgcccagcagugugucuagaagaggggcgggcggcgggcgcccagcagugugucuagaacaggggcgggcggcgggcgcccagcagugugucuagaacaggggcgggcggcgggcgcucagcagugugucaaaaagccaggggcauaaacaggugcagagaggaaaugcacccagggaggugagugccuguucugcccugggauggacggugggcagcgggcacucaggagguguuggcagcugucugucaucaucauugcugucaucaucaucgucuuguguauuuggaagauguuuuuucccaaguuauaucuuguuuucauuaucuuucguugguuugaaauagaaaacucuuuauaaauugauuauuguagaacaucuguuucaacuugcuucuguaauguguguaaacaaauugguuuuugaaacuacuauaaacaucuuuuaauauuuuuuuguuguuguugagauggagucucacucugucgcccaggcuggagugcgguggcgcgaucucggcucacugcaagcuccaccucccagguucucgccauucuccugccucagccucccaaguagcugggacuacaggagcccgccaccacgcccggcuaauuuuuuuguaguuuuaguagagaugggguuucaccguguuagccaggauggucucgaucuccugaccuccugauccgccugccuuggccucccacagugcugggauuacaggugugaaacacugcgcccggccuaauauucuuuuaaguuaaagaauauuagagagaguuuugcaucuuuuauaguuggaugaaaacaaauuuaaaguauuuuggugacuguugugacacuccuugucuaaaaacauucaucuauuuugaaaacauuuugcuuuucauaaaguacuuuuuauagauuagcucuaacuugaggcauaucccauuuguaugaauucugccaauaauaaaaacaauccguuguaaaguucugaaggaccgaggugaagggcugaaaugagccguccugcugccugucugaaguguggguaaggagaccucguggggacccuauucuacacuuuaauaaaauaugguugguuugguuauagcugaaagggacguauuuuccuguaaugauauuuuuucuugaauagggagaguuauauugacuauuagauaacauagauccaaagugucucuuuucagaagugcuggguauuugaaaugggcugauucacuuauuacgauucaugcacuaacggagccccacuuuccuaauaacgucgccgcuugcuaaaaccaaaaugaaguacaauccccacucuucucuccaggaggaaggaauguuaauaucucgccgccgugugaguuuuuccugcugagaccauggcaaccagauccccucacaaagggacuggccuccccaagcaggagccccacgcaaacauuugacuuucuucaaggcaauaauauuaaagcaaauuccuugucucugccaaacacaggauucauugugagaaacuuccagcuuccuuagugagauaagucuuccuucguuacccaggcucacggauacccuucucuccugaaaccugacgcuaacaagccgcauugugagcagagccccuguugaacagugugccucguggaaggccccuuccggcccuucguccucacaggugccuccgccuguguuucucgugaggagcuucagggcacucaccuggcccugcagcgaugauggaggcuuggcugcagcggcccuggagacacggcccaccauccaucccagggcagaacaggcgcucgccuccccgggugcauuuccucccugcgccuguuuaugccccuggcuuuuugacaucugggauccucuggcuaacuggguugagcuggcuaaacuuuagggauuaaugcuagaaauuaaacugcuaccugguaugaagaggggcacugcuccggguuggagaacgcagagagggugggagacucugugcgucucgcuucugugcggcugugcggucccaguggugccgugagcuugcucgaugcccccccggaacagggcagcccccguggggugggagcccugccuuccccuccuuguaguggagacgggagagugccacggguguggccgaaaugcacacuuggccacugucccuccaacagacaacuuucugcagcuugucuugauuuggauaccagagagaucuauugcuuaauucugcacacgucuguuuugcuuuguaugacuuuccugggugccaugaugucuguaacuguccgguguugccagccucuuuucuagggaaaguggguauccugccccuuggagccuccucagcacccucauuuugggcuaaaugccaccucugauccacccgccauuggcaucgaagcugagcuugccacgcaugaauuucugcuuguuacuccuuguucagaagccuuccuuggcuaccccugcuggcagggggaaguugagccuucuuagcccaacaugcaguucccacaaagcugcccagugccugcuuucccaaacauaggcugccccagauaaugagggcugcccagacugcccaccgcccacagggcagcacccaggacgguggucugcccugggcugccuugcuucugcugguucacguucuuaacagccucaggcucuugccacagcucccuaacagggacccuuuaggccucccuauccccguuuucagucccguuccuuuggcguuuaaccacaggucaucguucagccuuuuccagcucaguugugaugucuuugaagacagagauuuuuugaaacuccucuuaaaauaugauauccauacagaaaagugcacaucacagucuuacugcuggaugaagguucauaagcugcacacaccauguaaccggcacccugaggaagaacagaagaucgcagcccccagaagcccccucaggccccucuggucacccccuuccccaagggcagcugcuuuccuaguuucucacagcacagaagaauuucggcugcccucgugcuccgggccagggcccccacccagcagcugcucccuucucugcuuagcagccugggagaggcacccacgcuguguguacagcccuggagggugccuucuugucauguauguuuccagcuuuuccauucugcacuuggguaguucccaguuuugagcucugaugacagugcugcucuugguggccaugcagauuaaguucugcuggguuuacgccgcacaguaucuguuaggaucagagcugggucaugggaugugcacccacucugguguuguagaugcuggcagcacauucagcucaucacagagaugcacgccaagaggaucacccaccacgcguccagcccagugaccuccaccagcccaucacacacgugcaaaccgcccuccgagggucuaccucagugaccuccaccagcucaucacacacgugcaaaccgcccuccgagggucuaccucagugaccuccaccagcccgucacacaugugccagcccccaacuucccucuugugaccggauccugacuuucaucaggguagacuuuacagacuuccuuccagggauauuuuaauuuuguuuaaaaaaauauucccaggacuuagcuuagugcuguacucaguaaagguccaucucauuuuuuuuuccuucagugagugucagacuuuaaugaaguacccaguggacucuguguuuuauccuuguucucauuaugccaccuaccaaagguggaauauugucucucucugacuuuccuuucauuccuuugaaagcugacccacauuuuugguggcagugcaaaauguuccuagcuuucuuauagaacaucguauauugggcgggugcgguggcucacaucuguaaucccagcacuuugggaggccgaggugggcagaucaccugagguugggaguucgagaccagccugaccaacauggagaaacccccaaauacaaaauucgccaggcgugguggcaggugccuguaaucccagcuacucaggaggcugaggcaggagaaucgcuuggacccaggaggcggagguugcagugagccaaaaucacgccacugcacuccagccugggcaacaagagggaaacuccaucucgaaaaaaaaaaaaagaauaucauauacuaagcucuaugaaagagaaugcugcuggaaacugaauuauaaaagaguuuugcucuucuuuuuuccacagucggauacgcuaaaaaucaagcaguugcccagagcucagggucuuaccuuugcuuuuuggauucgguaaguaacuuucuuuuguuuauaauguauaaauguguacauguugguugaauaauuaaaugaucuuacauuuuagugcgguucuugaaaaucauuuuucuaaugguuauuagacuaauaauguguuaguccguuuucaugcugcugaugaggacauagccgagacuggguaauuuauaaagaaaaagaaguuuaauagacucacaguuccauguguccgggcaggucucacagucgcgcaugucugacguggcggccgaugagagaggcagcuugugcagggaaacuccucccuugaaguccaucagcucuccugagacucacccacuaucacuagaacagaaaugcccgcccccgugauucaguggccucccaccggggcccucccacgacacgugggaauugugggagcuacaguucaagaugagauuugggcggggacacagcccaaccuuaucaaauaguuauuaauucaagaugagauuuggguggggacacagcccaaccuuaucaguuauuaauucaagaugagauuuggguggggacacagcccaaccuuaucaaauaguuauuagacaaccuuaaaaauuaaggucaauagguuguugcuguuuaauugcuguagcacuuaaugaguuaaucaugguaaguaagauauauaaaaauguaaaauugcacagcagagagcgaugugagcaaaaugaagauaaacugggaugaaaucggaaaauaugguacuuaaaagaugaauaaccuuacugauuucuaaagguugauaagaaaacacuaagaaaaggcugggcgcgguggcucacgccuguaaucccagcacuuugggaggccgaggcagauggaucaccugaggucaggaguuugaaaccagcccggccaacauggcaaaacccugucucuacuaaaaauacgaaauuagccaggcgugguggugugcgccuguaaucccagcuacuugggagacugaggcaggagaaucgcuugaacccaggaggcggagguugcagugagccaagauugcgccauugcacuccagccugggagacagagugagacucugucucaaaaaacaaacaaacaaaacacuaagaaaaauagauaaguaggcagaggacagaagcagacucucagaguggauguacaaacaacuaauaaacuuucuaagaauuuaagucauuuguauucaaacacagauuagugagauucuuuuaaaaacugaacuaauaacacuuuuaaaaauguagauaacuuaggccgggcgcgguggcucacgccuguaaucccagcacuuugggaggccgaggcggguggaucacgaggucaggagauugagaccauccuggcuaacacggugaaaccccgucucuacuaaaaauacaaaaaauuagcugggcgugguggugggcgccuguagucccagcuacucgggaggcugaggcaggggaauggcgugaacccgggaggcggagcuugcagugagccgagaucacgccacugcacuccagccugggcgacagagcgggacucugucucaaaaaaaaaaaaaagcauauaacuuaguauuuuggacagucuaaguugaugccaucuugacaguguaacuuugcauuuucuaucaagagccugaagaguguccuucacuccucagcuuccuucuuggcaucucugagaacgauuuggauacaaagaagcuucagguuguugacugugauggaaaacagaaacguuaacaugggacgggagggucacgguggagaaguuuccggcaggucuccaugggggagucacugugauguuuauaaagacuuuucaauagcaggacaaaugacugaauaacagguagucgcuuguauagucuacacucaacuauagauauuuaaaaauuacuuuaaaauaaacuucaggaacauuuaucuguaucugucccuccucuguggccagguuccggggcuucugugcauuccuggggugccgcucagcgucuccaggccgcucuggcccagagcuccugccuacgcggggauuuacgcgggagccgcccguuccucuccuccugacccagcucuuuuccuugaucaccagaagccucugcacaugcuccugguacauguggaaguuugggagaggcgugcccgugugcagacgggguaaaacugcauauuuaucggcccagcucgggaaggcggaacccccagggcggcaccagcugcuaugacuccuguccuggugccugggucucuuucuucucuuuucuucuuagaccaaaacaccucagauuucucccguuuucuuacacagaaccuucagcccucucuccugacccuuccuugggcucauguuuucaugcucagaugguccauccaauguuuuccucacuaagacagcauccaccaaggacagcucaacccaccacauggaaaauggugcuuuuuauugucuuugggugacaggauuagggugugcugggccccugagcucagucugggucggaggccuggccuggucugaccugguuguucagcucccgaguucggucugcgucggaggccuggccuggucugaccugguuguucagcucccgaguucggucugcgucggaggccuggccuggucugaccugguuguucagcucccgagcucggucugggucggaggccuggccuggucugacccguuguucagcucccgaguucggucugcgucagaggccuggccuggucugacccguuguucagcucccgagcucggucugggucggaggccuggccuggucugacccguuguucagcucccaagcucggucugggucggaggccuggccuggucugacccguuguucagcucccgaguucggucugcgucggaggccuggccuggucugacccguuguucagcucccgagcucggucugggucggaggccuggccuggucugaccugguuguucagcucccgaguucggucugcgucggaggccuggccuggucugacccgguuguucagcuucugugccuggcuuaggagcaggucugcagauguugugaggcugggccugugggcaccuucccgggugcuggcugcucuguggaguugaugaggacgagagugaacauccucgaaggacguugggguuuugcccagcugaccagugugaacgucaccugaaacucacucuggauccaguaugugcagagggcguuacagucgaacagauucgguuccugaccucuagcguuggcaacugaggacgguuuaaacagaucuucaccuuuugcucaugaagcaucuccauccucccugggacccaccccacaccugcugcagucagaguggagccucccugcacaccguucucgucacgugacaccugccuagacggcuuguccucgagccuauuagguggccucagguguccuuggaaaggcuguggaaggccucccccgugacugucccauggccagguuccuaaggggcagaggggugaguccucgcagagcccugucuaaacguggcgccaguccugcgagggacccgugggugcucgggcagccgucgcugaguuuacacccuuccccgcuggaaaacgugacucugguccugcgagggacccgugggugcucuggcggccgucgcugaguuuacacccuuccccgcuggaaaacgugacucugguccugcgagggacccgugggugcucuggcggccguugcugaguuuacacccuuccccgcuggaaaacgugacucugguccugcgagggacccgugggugcucuggcggccgucgcugaguuuacacccuucccugccggccucugauggaucagugccugacgcggcguuuccuccuggcacacacugcuguguucucgucucgguugucuguguucuuggaaacuuuaguagaauaaaacaaaguaaacaagaagccuggcuuuuaaagaaaauagccucuaaauagcucauucauuauaaugauuuggguuccaguccucuuagagauguucaaacauaaugucuaugaaaacaucugcagagcggcuucacccaggaggucuggugguugugagagcgcugcuuacuucugagccgaccagguuuucuuuucccuucgcccuucaggguucccaggguggagagccucugccacccuccugucccccgacucccgucuucacuggggaaccggccgcauggcuguccacgugcacaggaagccacauggccuucccggaaccgccccgaggccucugaacuggggccucaggugagaggagaggggcccauguggcugggaugagaagggccaaggcggggcgggcgcugcagacggggacggcccaaaggcucugcauccauucggccggcucuacagcauugucgagucaucgccggggcuguggggaggguuacagacaagccuggccguucucauccucacugccgauccuugaaccgaggggacagggauguggcuguagccgugccccagaccccgagcagcagugccgucuagaacccucacaagccggcaggugcucugagcacagccugcaacgcccaaggccugucccgugucagaggcuguucuccuuuccaccucuacagcugcccuuugccuccuucuccgcuaaucccuuuauuucuuuacuuucccaccugugguuuugcuucugcuuuauucgcgcucauucugcaguuguguuccuaacccuugagcugggcccuccucuccaggcuuuuguuucuaacauaagauuuuccucucauggagaacuuaguacuguagggguguccguaagguuugaauauaaaacccuaguuauuauucaguuguguuuccuaacuuccacuaugauuucuuuuucuucuuuuuaaauuuagaucuuaggaucucaggagcccagaaucaaauuaaucacgacccuugguucaggacacauucuccucauuuguucacgcguggcccguuuuacuugucucugugauuauaacuguaccuguuuucguggguagcgacuaacugaggccaguggugcaggugguaaaggaauuuaccaagacaguuguaggucaagaaaggcagauuuauucgagaaagcaggaagauagguugcaagaaagcaacgggcgcgucagcaagagagaagcugacuggcaggagacagagccuugccggggguuuuaaagguggugcuugcgcuggagagggccacgagcggugcugguaacgccaggguugcagggagcuaaguugcauuuuccucucagccgaggaucuggugauacguuggguggaggaggauugugaguuaggugaguuauucgugcagacgcgcuguguccugaaccaugaggaaaggcagacauagccaaucugcgaauucuuuuugcuuccccggcuccccccagccugacuucucuucccuaauuaggacuccacaccuguauuuuuuguuuucaucgugugacaaacacccauggaccugccaccugacacaagagccagcucggucuucucacgucucacaggugaccacgaugcuuauccccugccuccuuccgccuggguaaccgucagcccaaauuccgcgcucaucaucccuugcuguccuuuuaaaauaacuaucugguaucuauacaaaucugaaaaaaaaaauuuaacuucaguucuuuuuaacuuuauaaaguggguaccacuguaguauucuggaacuuuuaaaccuuauaauuguuaagguccauccgcguuguugcaucucauuauaguuuauucagguuuggagaauugagguagaauuuacaugcagugaagugcaggauuuccgugugaaauuuguguacaacauggauaauguguguuuugacagcucacacgccuguguaacucacaccccagucaaggugcagagacuucugucccucggaacggccugcaugcucccggcuccgguccccacggcagccacugcccugacuuggagccccagggcuucuguugccagcucuugaauuucaugcguacgugaaaccgcacgccgugcccucguguuucucuuuccacucagccggauggucaugcguuacagcuuguguauugguggcuguguauugguggcuccuuacuguuugcucauccuucugugacugcaccgagauuguuucgaugcuguaguuuccaguucggguuacuagaauaaagacgccauuaacauucuugucugucuuucuguggauguaccuugggaaguaccuagggguggaauuggcacaucagagggaaagguguuuuuaccuuaaaggaaccugcugaacaguuuuccggcguucguacuguucugccuucccgucagcagagugugggcucugcggcguugaugcugucggccuuaauuuucaugauucuaguagcucugaugugugucucacugugguuugacauuuuccugauggcuggugauggugagcaccuuuucuuuuuuuuucuuuuuuuuuuuuuuuugagauggagucucgcugucgcccaggcuggagugcaguggcgcaaucucggcucacugcaggcuccgcccccugggguucacgccauucuccugccucagccucccgaguagcugggacuacaggcgcccgccaccucgcccggcuaauuuuuuguauuuuuaguagagacgggguuucaccguguuagccaggauggucucgaucuccugaccucgugauccgcccgccucggccucccaaagugcugggauuacaggugugagccaccgcgcccggccuggugagcaccuuuucguggguuuauuggccauucauaaaucuucuuucaugaaaugcccauaucucaccucuuaccuuuuauccccggcugccaugggaccagagccgggagcgugcaggucguucugagggagaugaaguuuuacucugucgcucaggcuggagugcaguggugcgaucuuggcucacugcaaccaccgccucccagguucaagcaauccugccucagccuccugaguagcugggacuacaggugcauaccaccacaccuggcuaauuuuuuguauuuuaguagagaugggguuuccccauguugccaaggcuggucuugaacuccugagcucagguggucugcucgccucgaccucccagagugcuaggauuacaggcgugagccaccacaccuggccuguuuaucuuacuauuaaugaguuacagaguuuugugacauauucuagauacaaguccuuugucagguauauagauuguggauauuuuuucccuguaaguggcuugcuuuuuuuuuuuuuuuuuuuuuuuuugagagcgucucacuuugucacccaggcuggagugugguggcccaaucucgacucacuguagccucagccucccaggcacaagcaauccuccugucucagccucucaaagcauggagauuacaggcaugauccaccgugcccggccccucuucauauuuuaauggugucuugagcagaagauguuaacaucagugaaguccaacuuauuuacuguuuucuaguuaaauuuuuuccuaauaaacuuuugcucaccccgaaggagaaguuguguuuuucugguagcuucuaguuuugacuguccuaucgacgucucuuguccaucucuaguuaauuuccguauguggcaugaaguaaauaucaagguuaguuuuuuucaugugaauauucagucccagcaccauuuauugaagagcuuucuuuucuccauggaauugugcugaugccuuuguugaaaaucacuuggcggugugaggguagcuuugucugcaggcucccugcccugcucugugucugucaaggguggguuugucugcaggcucccugccccccuccgugugucuguccaggguggguuugccugcaggcuccccgcccugcucugugugucugucgaggguggguuugccugcaggcuccccgcccugcucugcgugucugucgaggguggguuugucugcaggcucccugccccgcucugugugucugucgaggguggguuugucugcaggcucccugccccgcucugugugucugucgaggguggguuugucugcaggcucccugcccuccucugugugucugucgaggguggguuugucugcaggcuuccugccccgcucugugugucugucgaggguggguuugucugcaggcuccccgcccugcucugugugucugucgaggguggguuugucugcaggcuccccgcccuccucugugugucugucgaggguggguuugucugcaggcuuccugcccuccucugcgugucugucgaggguggguuugucugcaggcuccccgcccugcucugugugucugucgaggguggguuugucugcaggcuuccugcccuccucuguguaucggucgaugguggguuugucugcaggcucccugcccugcucuguguaucugugaaggguggguuugucugugggcuccccacuccgcucugugugucuguugaggguggguuugucugcaggcucccugccccgcucuguguaucuguccucugcgguuuguuugguuucucugcuguacagcauucugcugagcaaaccugccguguacauccgucuuuccuccuguggacaggcuuuugggcugccaccagguuuuugcuuugaggaauggugcugcuguggccuguccacacaccucuggcugugcauguggguuccucuuagcuuuguaccuggaaguggaauugccagcucccagggcacggaagagugaugccugcgaacacccacgcucucgcugguucuccagcacuuagaauuccgggggguucacuuuugcuggcugagcaggagcaaagggggccucucugugccuggauuugcacuuccuggucacggguuauggugagcgucgucuucuguucuuggccauguggguuuucuuuucugugaaaaguguuuacaucuuuuugcucauuucucuuuccccuuugaaaccaucagaacucacagaaaguuucaaggauacugcaaagaacuuuuuguucucccugagccauuggcuuaggccaccagcaucgugcaugucaccccgaguacguguguguacguccugcaaagaacauucuccugcagcccacggccucccgucacgacagggauguacucacccggacacgacuggcacccggugccgggccaggcugucccaguggugccgucggagaaaccccugcucagaaucgcgcugcauuuaguuacugugucucugugaucuccuccaccuggaauacccucagccccgccuugacucugcucuucuuacguguguguggacucuccgcgguguccguguguggacucuccgcgguguccguguguggacucuccgcgguguccguguguguguggacuucacaguuucuauguguguguggacucuccgcgguguccguguguggacuccgcgguguccguguguguguggacuucacaguuucuauguguguguggacucuccgcgguguccguguguggacuccgcgguguccguguguguguggacuucacaguuucuauguguguguggacucuccgcgguguccguguguggacuccgcgguguccguguguguguggacuucacaguuucuauguguguguggacucuccgcgguguccguguguggacuccgcgguguccguguguguguggacuucacaguuucuauguguguguggacucuccgcgguguccguguguggacuccgcgguguccguguguguguggacuucacaguuucuauguguguguggacucuccgcgguguccguguguggacuccgcggugucuguguguguguggacuucacaguuucuauguguguguggacuccaugguuucuguuuuauuugaguuaucauuaguuacugucacuuacugugauguucacacugucugugauuuggccagcgagggaccuuucagacuggcuuccaugcccuuugacuaggucccacgaccuugggggacgucuugcuccugaaacgaggacugcggucuugcagcugccggcugcuuugauccuggccagcaguagccguuugcugcccucugugccggccgaugugucuggcaggaguuggagcgcuuugcaccccugagcagcacggcccaggccccguggccacagcguucuggucacuccucagcaucacagcgucugccuguccggcugcagaaggugaccagggcaugccgauguugcgggcaucaugacccucaggccccuuacccaggccugacccacaccaggaacccgcagcuuccgcagucucagccccgggggcguguuaacacgcguggauucaccccugggccagaguccucuucuccuggugggguuggggcccugcacaguugccagcuuuucccuccgcacagagagcccggucucuacacaggacacagauguuuaucccucaacagcugaggccccacacgcaacccaccucacuuggagacuggaggcggaugagcgagggcucugcuggccacguccgcgccugucuugugcguggucucgcgaacuccgucugaaccgccguguggucuuggaggugacuugauuuccgguucaagaaacuauucaggaaaccguggagcagcaccucuaggagggagucgaugcugaauucagaagcagggccugcccgccuggaggaccccgggcggaggcugccgcugagcuggccaggagcuguggccgggaccaccugaggccugcgcugggggcucuucugcagacgaccaggagggcugcucugcugccugaguacaucagggacucugccuccaggaguggacgccuggaaccucuugugcguucaccccuguuuagccuuuagguccaacaggaaauguggggacacaggaccucguaucaggcgaguccuccccacacuguacccucuggcaucuccgguguuagagacacacgguccgguguuugcucuggcgagguagaaggaaccagcgcagaauccacaggggaggaagcacuuuuaaauugcuaauuugcagaaaaucgagaaaggcaacuucaaccuccuuugugaugacacauuuugucccaccgugucccacugcuagugaguguuacagaagcaucggcccaucuaacccaugaagguuggguuuccacuuucccuuccagcucuucccugcagcugcuggaggucgggagacguggggguggaaggaaggagaucuggcgccuccccagcaugcguuuaacagaaaggggacacgaggccacgugcuuugucuugggugguuuugagaccaaagcguuucaccacagagcaugguggugaccaagagauuccugaaucaugcuauuuucccuuuauuuagaaugguacacuggucaguaacugauuaaaugcagguguugcuagcugagugaggaaguguguuuuuccucaucucuuuaucacgugccaccugacuucuauauuugacuugucggcuuuagccuggaauuauuuagaaaagaauguugguaucagcuguauagaaucugcugcaacuuuagaaaacagcggagagcagccaaugugaguucaugcuggugcaggugggccggggacagugcuaagcucaugugaguucacgcuggugcagguggggcggggacagugcuaagcucaugugaguucacgcuggugcagguggggcggggacagugcuaagcuaacgugaguucacgcuggugcaggugggccggggacagugcuaagcucaugugaguucacgcuggugcagguggggcggggacagugcuaagcucaugugaguucacgcuggugcaggugggccggggacagugcuaagcuaacgugaguucacgcuggugcaggugggccggggacagugcuaagcuaaugugaguucacgcuggugcaggugggccggggacagugcuaagcucaugugaguucacgcuggugcaggugggccggggacagugcuaagcuaacgugaguucacgcuggugcaggugggccggggacagugcuaagcucaugugaguucacgcuggugcagguggggcggggacagugcuaagcuaacgugaguucacgcuggugcaggugggccggggacagugcuaagcucaugugaguucacgcuggugcaggugggccggggacaguccuaagcucaugugaguucacgcuggugcaggugggccggggacaguccuaagcucaugugaguucacgcuggugcaggugggccggggacagugcuaagcuaacgugaguucacgcuggugcaggugggccggggacagugcuaagcucaugugaguucacgcuggugcaggugggccggggacagugcuaagcucaugugaguucacgcuggugcaggugggccggggacagugcuaagcucaugugaguucacgcuggugcaggugggccggggacagugcuaagcucaugugaguucacgcuggugcaggugggccggggacagugcuaagcuaaugugaguucacgcuggugcagguggggcggggacagugcuaagcucaugugaguucacgcuggugcaggugggccggggacagugcuaagcuaacgugaguucacgcuggugcaggugggccggggacagugcuaagcucaugugaguucacgcuggugcagguggggcggggacagugcuaagcucaugugaguucacacugguguacguggggccaugucuuuugaugaacagaaguuuuaaauuuugauaaugaccauuuuaucacuuaaagaaaaauaagauuugugcuuuuugugucccgucuaagaaccuaagaaaccuuugucugccccaaaguuuucuucauuuucuuuuggaugucuucuauuuuuaucuuuuacauugagaccucugguucauuucagguucauuuuugaagaugguguauaugggggcugaggauucuuuuuccuggaugauguccgguuuuuccagcauuccuguucuuucucuguggaauuaucuuggcaccuuuguugaaaaucaguggauccaaaaaagcguggaucuauuugaucuauuucugugcucuguucuguuccacugaucuuuauauuucucuuuauaccaguuccacucugucuugauuacuauuacaugauuauucuagcagcugcaguaauaaagcuacaguguagcuuuauaguaagucucaaaaucugggauuguaagucuuccagcuuuguucuuaccgcucucaaaaugguuguguugguuuuuuucguuuuuucuuuuagguccuuugaauucugcaaaauuuuagaaugaacuggucaagccugcugauuuuuauugggauuacauugaaucuauaaauccacuugaggaucuuaguauugagucuucuaauccguaaacauaguauaucucuccauguguuuaugccuucuuaaauuucucucuggaauauuuuguaguuuuuaggguaugggucuucaacauuuaauaaaauauaucucuuaaguauuuuuggguuucagugcuauugaaaagugguauuaacaauucauuuccaaguuuuauugcugcaaauaugcuacauuagcuuauucuaguagaguuuuuuuuuugcauauucuuuacaauuuacuaugaaaugauuaugucaccugugaauaaggagccuuuuaccccucuccaaugucuauuccaaucuuacuuauuccgcguucuugguucaguucauuauacugacuaggaccuccaguacaguguugaacagaagugcuucuagcaacaaccucguguucaaaauucuuguuuguuucaucauuuucauuaugaagaaaaacacauacagagaagagcacaaaacacagauguccauaaaguaucauuaaaguaucauaaagcaaauauucauguagggcacaaauguacguacagcuucauaaggcaaauacucguguggaacacaauguaugacucuauaaaguaucauaaagcaaauauuccuguggccaccauagaaaauguaaccaccucggaagccccuuucaugccccuucgcaaugaucucucucucugucuuccccaaauuaaaugcaguugguucucgugggucccagcagaaaacucgggguguucuccaguccccguccucacagaucccugaaccccguguuuccuuccagcccugggaguggcaggagugccaugcggccguggccucuccccaacugcgcucagaaucaguaacucuuugagacgcugguuuuagaaaugaccggauggucgggauggccaucaccuccccuggggcugacuuugucucccgaugggcaggugggcugguggccuggugagcugggccccaaggccccaucguguccccaggggcguccugcucaccucucugggcuucuccgcuccagaccucggucuuugguccuuguggccuuugugggucuccaguggcuuucaacaggcauuuuguuuuguuuuaguauuuuucuagcuuuuccagcuauucuauggaaaauauuguucugaagcaacuuauucguccguuccuggaaguggacucggcuccuggguuuucugggacuugccuggccugggcuuuguaauugugugugcaggcauccuuaucggucucagaaauuucuuagccgucauuucuucaaagcuugcuuguuuccaguaagcuuuucucucucucuuucugggacccucuuacacuuuauaucgcuuugguuuuucuucuuuuuuucucucuguuuuccaucuucuggucuuuucaugcugaauucugaauaauuuauuuugauauauguucaaauucacuaucucuuuagaaaaucuguuuugcuauuaaauuugucuguguuaugcuuaauugggauuugucuuuuaguucuaauaguucuauucuuggccgggugcaguggcucacaccuauaaucccagcacuuugggaggccaaggcggguggaucaccuaaggucaggaguuugagaccagccuggccaacguggugaaacgcugucucuacuaaaaaugugaaaauuagccaggugugguggugggcgccuguaauuccagcuacucgggagguugaggcaggagaaucgcuugaaccugggagaaggagguugcagugagccaagauugcgccacugcacuccagccugggcaagaagagcaaaacuccaacucaaaaaaaaagagagaaaguucuauuguucaaguuugucuuuuaguuuuugugugugguaaaauguauauaacauaaaauuuaccauuuuagccauuuuuaauucaguggcgugaaguacagucacauugcugugcagcccccgccgccuccgccuccagaucuuucccgucuucccgaacugaagcucuguccccgugaaacagcccauugcccgccccagccucuggcugccacccgucuccguccaguccccaugacuuuggcucugcuaagggaccuccugugacaauauuuguccuuucaugacuugcucaugucuuauaucuuuuaguuuuuuaaauacaacuugcauagauuuuaaaaauauuuugugcgugauaauuugaauauaucaagucuuuuguuuucugauauuuugucuguuuuuacuuauaagccuggcugucuuugcgcacuggccauuuuauuugaaccguucucuguggaguaauuugacgccccaggguucuccugcaucauagacucuguccugccuccauuguggccacauaggccaauucccccuggguggucaggaucaauccccgggccagcacagacaaucccuuucuggacguggacucagaggcaugaggagcccaaggggccggguggggucuuaacuuccauuccggcggcgucaucgugcgucuccugguggcaguguuccuccccugggacccagaccucucggccuguagaccacaacgucagggggcaggaagcaggagcuccccuaguacaucaccaggagugacagugagugccacucccauguccgccccucgauuccuggccccgugagcccuggcuggggagaaacagcuccaugucccagaggcucauuuggagucagugcggccucuggagagccucgccccagcccugccagcgucgccgcugaaugggugccguaacuggaccuccaaaggccaucccaccucuguccgacccauggcuucgagaugguagggacaugagagggaaguuaauuccaggagcccggcccauugcgaccuuucuuuggcuguuaagugaguuccuuggucagaagcaauguccuguggaaaaccaugguguuggaugaggcguucuauccaauuuuaacccugacauguaauugcuacgagacuuuggguauuaagaauuacauacccuuuccaaaccuccguuuucuuggcuacaaaauagagauaauauuagcuauucucucuccagccauagaagagugugauaaauauaaaaaaaaaguguauguguguguuuuauaaauggugaagugaauuaaagaucuauucauuuguuuuacaaauauauuuuugaaguuuuuagggaucguuguacauguucacggagcacgugugguacaugauacagccacaccauguucgcggagcaugugugguaccugaugcaggcgcaccguguuuguggagcacgugugguaucugauacaggcacaccguguuuguggagcacgugugguaccugauacaggcacgccguguuuguggagcaugugugguaccugauacagccacaccauguucgcggagcaugugugguaccugaugcaggugcaccguguuuguggagcacgugugguaccugauacaggcgcacgguguucacggagcacgugugguaccugauacaggcgcacgguguucacggagcacgugugguaccugauacaggcgcacgguguucacggagcacgugugguaccugauacaggcgcacgguguucacggagcacgugugguaccugauacaggcgcaccguguuuguggagcacgugugguaccugaugcaggcacgucguguuuguggagcacgugugguacccgauacaggcacaccguguuuguggagcacaugugguaccugauacaggcgcacgguguucauggagcacgugcgguaccugauacaggcgcaccauguucacggagcacaugugguacucgaugcaggcacaccgugugucaugaucaagccaggguaacuggaccauccaucacaucaaacauuuaucauuuguguugggaacauuccagaucuucuagcuauuucauuuuguuuuuugagauggagucucucucugucgcccaggcuggagugcaguggcgugaucucagcucacugcagccuccaccuccagguucaagugauucucguaccucggcuuccugaguagcugggacuacaggcgugcagcaccauacucggugaauuuuuuuuuuuuuaguagagccagaguuucaccaucuuggccagucuaguuucgaacuccugaccucaaguuauccgccugccuuggccucccaaagugcugggauuacaggcaugagcuacugcgccuggccauaaaagucuucuagcuauuuugaaauauacaauaacuuauuguuaacuauagucacccuauugugcuaucgaacacuagaacuacuccuuuuaccugacuguaguuuugugcccuuuaaccaaccccccuuccuccucccgccacugcccuuccuggccucugcugagcgccauccuucuaccuccacgagaucaucuccucagcucccacacauggguggcaacaccagcguuugucuuucugugucuggauauuucacuuaaugaccuccaugucuuacaaauauuuuugagggccaacuccauagaagaacuggccuggcccugguucuagaaggugcaagagacuuucccacaggacauuuagccugggcuuggggcaucggggauuaggugucuagaccaggggucggaagguuugagggucccguguuugaagguuagugacgugccccuuagguggugccugugguuccuuugagccuccucagcucuucuuuuugaaauaccugucagggucauaugcagguuuuuagcccuccuccuccuccuuccucccuccucccuccuuccaucucccuucuccaccuucauccuccuucuucccuccucccuucuccucucuccuccacccucccuccucuauucucucuccccaacccccacuucccuccacccuccaccugccuccucccuccuucuucugucccuccucccuccuccccccuccucuucaguccucuccccuucucccuccuccacucuccaaccuccuguucucuucccuacucccuccucccuucuccacccuccucuucugcccucuucccuccucccuccaucccuucucacuccuccauucuccacccuccuuuauucucuucucucugcccuccucccacuuccccucuguccccagccuccucucuucagccccacuagguuccucucggcuucccucagcaugguucguuggaugaucugaauguccuaaggccguuuugcgggaauaagagacauaaauauggguauuuuaguucaucuuagcguucaacuuaaaaacagauauccuuccaaugacauuauucuuauuucugcuauugaguacauuuguaccuuuuacucauguacuuaaaccuuugcuguucuuccacuuaauuuuuuuaucaugagauagaauacacccacagaaaaaugcacaaaacauaaauauccauuaauuuacaaguuaauuaugaagcaaauauuuguguagcuaccacucgaucaauaaaugcuuauggccggcaccuuaaagggacugucccacccaugcccccaccucgacuuccccccaaaaagugaccacucuucugaucuucaagguuauaauguuguugcuuuucuuuaugguuuauauccgugguccccagccuuuuuggcaccagggacagguuuuguggaagacaauguuuucacagaccgauggugggggggcgugguuuugggaugaaacaguuccaccucaggccgucagcauuaguuagaugcucauaaggagucugugaccuggauuccucgcgugugcaguucacaguaggguuugcgcuccugugagggucuaaugcagccgcugcucugacaggaggggcagcucaggccgugacgcucgcccggccgccgcucacuccugcuguguggccugguccauggcgcggcaccagcccgcuuccccgggaauugggacccugguacacacugugugugcauuucuuaaauaauaugguuuauuuggcuugguuuugaauuuaaauaaggggaaaauaccauguauauucuugugucuugcuucuuucacugaacauuaggcuugugaaauuucuguuguguucagcugcugaauggcauuugaaaauaacaugcacaauucauguaucugcuauucucacucacuggguucuuuccacauuugaaugagcugccgugagcaugucugugugugugaguagggcuuuuccuacccaaguagucagacgucagggucuuagggaagugcaucuucagcuuugcuggaagaugccagacgguccccuccacagugguggcagguccucaccgcagacgguccccuccacagugguggcagguccucaccgcagauggucccccuccacagugguggcagguccucaccgcagacgguccccuccacagugguggcagguccucaccgcagacggucccccuccacagugguggcagguccucaccgcagacgguccccuccacagugguggcagguccucaccgcagacgguccccucaacagugguggcaggucuucacugcagacggucccccuccacagugguaacagguccucaucgcagccagcagugcaugggagcucuuguucugccuaauuaaguacacuuggaauugucagcauuuuuuauuuuuccuucuccgcugcauaacuaauugcauuucucugauggcugacgagguuguugguccacuggaaauccucuugucugaauggccuguucaaggcccuugccuguuuugcuguuggauugucuaucguuuucuuacuuauuuguaggaauugcuuuaugugaguuuaaaauauguucuuggggcugagcaugguggcucaagccuguaaucccaacucuuugggaggcugaggcgagaggaucaguugaagccgggaguuugaggcugcagugagcuaugauugugccguugcacuccagccugggcaauaaagcgggacuguauuagucuaugcaucaaucaaugcaaacaaacaaacggaaaguguguucuuuacugcaggaugacgucaugaugccccagcgggugaggcugcaacacgaggcugccguucagcacccgucgagcguaaguacuggccuccuuagugucguuacuaccuuuagugaaauuaccacugugguuuuuuaaauaaagaguuuuccuagggguggaaagaaucaggcuauggugagacugucaagucacggagagggaucuguggcuggcaugucucugagcccuggaggguguuuuccuuuggagaaaaacaugccccugauuuuucuccuguuauuuucguagggugcaaaggugguuguguuguuuguuuuuaaucagcguuuuagaagcugagcgccuuagacaugaaaacacaggcugagagcuauaccguguucacaguuaaacguuuuucuuauuuagacgaucuuaaauuacgguuuuuaucuuuagaacggcuucucaguugccccuccaaagccaggcuuccuggggccccuccucagcccagcagugccccgugggcuccuccgcccaguggggaggaagcacagcagugccccgugggcuccuccaucccccaccgcagaugguggggacacauggcccagggaucccuggagcuggugucucagccaccgcgaggcuccugcuggcuucagggaaggugacuguguccucagagaucucgcucaaguuuuagaagacuuugaaucacagcggugaucacuuggguuuuaacacugagggauccauaacuguccagcgcccacaguguccgucccccgggcaguuuggcgcucacccuggacaggccccucugcccuccccccgcggggcugugcgucgugggcacgugugcgguugggucaccacacgguucagucacggccggcucuggucacauccuggucaggucacagacgggccuggucacggcagggucuggcccacacggcgcugggagcccagcuccccacagagugggugcucgugacaguucacccuguggggggucgggcaggggggcaagggcaggacgggugugcugggggcgucugaaggggagggccuggguguuggaaccagaggggguugggaggggggaaaggguguggggguuugggggggcagcauugagggggagggggguugggaugggggcagggcuggugcgcugggggugggcggugcugggggugcagccggcugcacggagguuugcgucucacgugaggcaggagacagacugagacacaggccaccuucucgggugcagagggccccacacgguugccuccuuugggggugugucagguccuggggcucaguggccccagcguggcugcagggccuucugugggggcacauuuucugugagggcaggagagagcucuguggcuuguagcagauucuuaaaagggucacguguuugcaaaguuuaggaaccgcaaauaugucugaauguuucuccguagcaaccacaaauacgugugagagugugacagcauauccauggcaaucggggccacaggcuccggaagucaguuucuggaaguuuacaggcauggacugccugggagagacguccgagagugucugcuugucgggugggacggggggcccggggaucuagggauuaggggugauuucuaccccagccacaggugcugugggguuucagucauguggaaacagagagugaucacagacgguuuuuccaguccaguuccuuuguggggaauagggggaaaaugggggaaaauguccuucgggauggacuucuguggacaguuuaugugaggaaagugcagagucugggguuuccaggagggccuuuugcagaggugugagauaucgcacauggaggcuggagaggaaaggggcgucccugccacguuagcugcccaacggcucccuuugcgucccugcagcugugugguccuguggacuggaagguggagcagacccugugccggcccgugagcuggaaaccguggcuggacugagccguccguaugugaggugccacagcgauuuuuacacagcuagaaaugacaguugccagcuauuuagaaucaaucauacagacgucuaaggaauuuuguuaggaguguugacauuuuaguggaggagauacuuucagauguuuucauuuccauacugaaaaacaagcccagauuggcuucauuaauggaguugccuuuggcaguucuucguggcauguguucaaacgagcugggagacuuauggauacgaggaguucguggcguguguucaaacgagcugggagacuuauggauacgaggaguucguggcguguguucaaacgagcugggagacuuauggauacgaggaguucguggcguguguucaaacgagcugggagacuuauggauacgaggaguucguggcguguguucaaacgagcugggagacuuauggauacgaggaguucguggcguguguucaaacgagcugggagacuuauggauacgaggaguucguggcguguguucaaacgagcugggagacuuauggauacgaggaguucguggcguguguucaaacgagcugggauacuuauggauacgaggaguucguggcguguguucaaacgagcugggauacuuacggauaccaggaguucguggcguguguucaaacgagcugggauuccccacaggaauguggggaaaaugcacauggucaguuugucuuaauuguaauaagacaagcuuaauuuccauuuucaucgaugauuuuaaaccuuuuucuugcuacucuucucacugccuucgcugaugcucuguugugcacuugggagagaagcuucugcuccaggugccuccucuuuucccaauggcgcgguuagguggagcguccaccccguuucuccacgucgaagcucuucuggaggaagcuuagggaugucaucacaguuuuguuucacuaaaacaaagucagcuuuagaaaggcuguuauugcguggcuggauuuuuuagaaaucaugaccuacaaaaaucuuaauuugcaguugcugguucgugguuacgugaauuacauuguguaguuuguccugagagaaugaaauaaacgcugagauacuuguacuuggucguuguuuucuuaagaucuuuuacaagaaaccagcuaauuaggaaggaccuuugauggcggcuuucauaaaucgugcauuugcauguagauaaaucacugcagaacuuuaggaauccugcauguagagcaucguuauccaagguuagcaagaacagggaacccgcauugcgcccuguaacuugcccccguuccugagggccagccaacccccguccuuccuccuccucucgccccggcugacccuuggauuccugacacugugcacccugugguuucccaccucugugccugggcucaggagacaucggagaggaaagccugcauucuuggucaccucuagaccaccccagaccaaacacgaaggcugcccuggcuccacccagcuccuuuccagagcugaucucuguucccaacguucaagaccaguccucgggguacagccccgugagggcaggugcuccaccuuaggguacagccucacccacccucgugcacugggauggagcaugcagggagguguagggaagcgacgcggaggaacaaagacgggaggguuccugugaagcagccugggccacagcuugccugucgggggaauggguggagccgccgugcccugcauccugggcgccguuccccgcuccuugccugugccaagccauaaucauccagacggcacggcagccgacucucccugcuuccacuucugcccccacaagaagcugcguguuaacuuaaauaaacaggacuuccagguguucuguuuaaaugaaguccgcggugcacucugcagccuuugucugaggaagucccagagcacagggcuggggcgucagccccucugcacaugcagccugggagggccacggcccccagcccugugagcccaugcccagaccggugugugacuucccaagcuggaaggggcagaacaugccagacugggccuuggagaggcagaagcuguugcagugacugacucagcucuugaaguuggagugcuugugggcucuccucugaccgugcucuucgcuccgggggcagggagugacagggucacacuggacggcugccuccgggcucugcugggcuguaguucgggcugucaggccugggugcuccuccuucaccuucgccuucaacaucgcugcucaggaguggcggccgaagcccccggugcuggugacucuggacccuggggcguggcucagcagcagcagugcuggagaagagccgccugccuggugguugaacgagcuccccaggcaccccuggcugcccacagcaccccacaccaggggcccccgcagccccccccacaccaggguccccugcagcuccacacaccaggggcccccacagcccccccagccccccgccgggcagcccccccacaccaggggcccccacagccccccaacaccaggggccuccacagcucccuucccccacagcuccccucccccacagccccccucccccacagcaguggacggcaagucguucacuccaaggcaguggccccagggagcugauguuagugucaaaaaugcaacugguuucuuuucuuuccuucaguguaauucagaagcugacuucuugagucugugccagaaacgugucuuucugggaaggggcccuucugagcucucugcguucauuugccucccgccucagcccggccccuccuuccucccucgcacccagcaccaugcaccgagggcaccucaccuggguucacccagacacgcuugacccuccugcgcugcccaucgaaggucucgccccuuugccgucuucaggacucggccucuguggcgaauccacggggagucugagcugcagccccagcagcccugaccuucuugccaccgucuuuagagccaagggcccugcaaacugugccaggccgugcaguggggggacucaccucgugggucucaguuccuuucuguguggggggcuuaccucaugaaucugaguuacuuuuuuuuuuugagauggagucuugcuccguugcccaggcuggagugcagggguacggucucggcucacugcaaccuccgccucccagguucaagugauucuccugccucagccuccugaguagcugggauuacaggugugcgccaccacgcccggcuaauuuuuuuguauuuuuaguagagauaggguuucaccauguuggucaggcuggucucgaacuccugaccucgugauccacccgccucugccuuccaaagugcugggauuacaggugugagccacugcgcccagcccugaguuacguuccagcccugaguuacguuuuaugaugggggacucaccucgagggugugaguuuccuucugugugauggguucacuugggagugugaguuuccuucugugugauggguucaccugggggugugaguuuccuucugugugauggguucaccuugcaagucugaguuuccgucuuugugggucaggaagggccgcuugucuccauucgcaggcauccucaccucuggacugccgggcugggaucaucucgagcccgcacacucguucggcggcagggauccgggcugggaucaucuggagccugcgcacucgcucggcggcagggauccuggcugggaucaucuggagcccgcgcacucgcucaauggcagggauccgggcugggcgcuuucucuccacgaagcugcucaggcuuccucgcagcaugguggcugcaagaacaaguguccaggagagccugccagaagcugcguugccuuugacaauguagccccagagcaccgugucacguggugucaugcugaccccagauuugaggggagggagcgcagaccucaccucucagugcuugagggucgauggccaugugaggagggcaggcagggagggacuguggcaggcaacuuagggagcacagccccccguguccccucacaccucccuucugucaguauccuauuccuuucaacguucugacucuuuuuuucgguggaauugccagauccuggugguccccguauaaauucagaaagaguuccaagauugcuuguugggaucaacuccagcggccugcgcuuucugcuccgccuguuggcacagaggcuuucaaaugaauuagcucacaacacuucucgaaagccuugaaaguggcuucuucuaggaaccuggagaaaguuagccagccucucaggccagcgcacaggccucucauucacaucugcucacuggguccaggcccugugcuaggugcggugcccacaaaagcuccugcccugagaaucugacgucucggugcaggauuaagcgcauagcgcaccucuucccugcgccuccuccuccucuugagagcgugccucuucccugcgccuccucuugagagcgcgaggucuccugcagaggaaggugccggcagcaucgcggcugggcgcuguuggucugucuggaauccacgccuuccuacugcuguuuagaugcaguugcacgggagagagcuugcugccuucuuccaagguuaaaaaauguugaggccaaaaaagauccucucaccuccuccguuuauagaccaaugcucguggcucgugguuaauuaaagccacaggaauugccagccucgggccucuaguuucacaggauucccccaccccguccucacucuuggugagagacccgguguggcuuuaccuuuccagggaagcaugaagcugggggagucauggggaggggucgggcaugcgcaguggaagcaggcgucaaucagcccccguccgagaggcgccucucaugccccagcgggauccaggcucucaggagugggcuggcguguacucaccugucgcccacagcugccucccaggacccggcagugcuggccucagggucucgguguuuguguguagaugcugagccucucugucuucacguuuuggaacaaaggacuucuaccuccagcuuuugaucagcuucccucaaaaucuuuucuguucagcagucaaacgugagacaguauagacaagaccaggaaacagaugcaauuguacguagguagaugcuaugcaggaugcacagaaacagacacaccaaacaguuuagaaaugcaucucggucagauuggguguggggaaaacucgcugggcagggcggcggcuccagagcuguccuaauucacaacuauuuuuagcaugugcuuuaggagagagacaugaaagguucacagauagaauucagcagcauaugaaaagaauuacacagccauggccgagcacguuuguuccaauuagaaaaugagcaaaauacaugaaaagacauuucacuaaggaggguguacagacggcaaagaaccaggcgaaaagaugcuccucgccagccuucagggagccuguguuaaagcacggugccaucagaacggaaugaaaaccgagacacccagugcuggcgagaggcagagaagcuggauccucaugcaucacugagggugagagacggcgcaaccacucuggagacuguuuggaaguuccuguaaaaacuaaacauguaacuguucugugacccggcaguugcucuccugggcauuuaucccaguggauugaagacgcuguucacagacaaaccugaacuugaauguucgggaucgccagcacaggaccugacuacuguuacaugcagugacuggaagccuguccugggagccgaggagcagugcgaaagccgggcacagaaggccgccuccugcacguucccggaucaugcucuggagagcacagccacggcgucgggauagcacagccacggcgucgggauagcacagcggcugccguugaggggcugccaguggcuguaaggggcgccucgggugcucgugcccugggacaucuggaucuggacuccaucaugucccucuccuggugcggcguugaccuuggguccucgugauguuaccaccagaggaaguggugaagggcacagagggucucucuacaguuguuucuuacagcugcaaugugaauucacaauuuucucaaaguaaguuuaauuaaaaaacaacaacaacaacaaaugcaaacagaagccucccccaagcacgucauuaacugcauugguagaaaagaaucacucacuacgcguaaacgcuacacaaguuggagacagauccaggggccucagaugccucggugugacuucaucgcuucagaguuaggagacuggcucacugauaccacucuuuggaccacaguuacauuuucacuauugucuccuuguuggucuugggugagacggaaucagcugcguccgcugggacuugugaccuggggccugugcugugagaacgucuacucgggaggcucugcuggcccugggcccucacuuggggugggugcuguuuccuacggacgcgcccaggugcccucucuccagccagcuccucccacugcaaggugagugugagcccugaaggaccugcccuccuaccucuggaucucaggagcagaacagagccagggcugagugcugggagcccacuccggggcagaggucaggcuggagggggccgggcagggcggagggcgggggaaggguugagaaaggcugaggcaggugaugcucugaggcucugcagggcccgggagggggucaaggcuacugacaggaugucaccugaggcaggggugcuggccuggaugcccggggagaggguugucggcccuggaggaagccagcugguagcaaggcucuucuccacuuagggacgcugcuuuccugagcugaauggagcagguucagacgggcggccugcggacaggcagcgguuuccucacauccacuuugcaugugauucaagaagugaguucuuagaaauaacucaccuugcauaugggccauuugauuugaguucauuaaggggaaaugucaucugugacauauucucaauccagcccagggcagcucugugguucaccgccgagaugcgcguccagggccgucuucugucgugcccaucguugcuaugcuguccccaagcaaaagcaggcaucccuccuccuccucgcccucgacucccgguguuugccugacccagauuugcagcauuucaguuuccugucuggacaucucugccuaaaacaugugagaugaauacacacaggugugcacaugcaccugcguaccugacuuuguuuugagcucugucugccguuguuuuucacagaucauugguugcagagugaggagagaucccccuaacuccaccgaacgauacacacguuggaucaaccagcugacgccggagcagcuccuaacccagguaccucgccuggcgccuugucuggggcaggugcacaggucgccucugggcgccaucucaugcauuaugcuguggccucuugugucugcgucgucgugggccgugguccuucuguccucgccuucacucacaugccaucaaucgcacagaguggaagaugagaguggccccagcggacacaugugcuaggcuggucucaggccggcaguucaggcugguucaaguucugagcugggaaacccgaccgcacagguccacuuacacgcggagggcgggagggugagcucaguaaucccacacgcagaccgcagagggcaggaaggcgagcucaggaaucccacacgcggacugcggagggugggagggcgggcucaggaaucccacacgcggacugcagagagugggagggcgggcucaggaaucccacacgcggacugcggagggugggagggcgagcucaggaaucccacacgcggagugcggagggugggagggcgagcucaggaaucccacaugcggacugcagagagugggagggcgagcucaggaaucccacacgcggacugcagagagugggagggcgagcucaggaaucccacacgcggagggcgggagggcgagcucaggaaucccacacgcggacugcagagagugggagggcgagcucaggaaucccacacgcggagggcgggagggcgggcucaggaaucccacacgcggacugcagagagugggagggcgagcucaggaaucccacacgcggagggcgggagggcgagcucaggaaucccacacgcggacugcagagagugggagggcgggcucaggaaucccacacgcggagggcgggagggcgggcucaggaaucccacacgcggacugcggagagugggagggcgggcucaggaaucccacacgcggagggcgggagggcgggcucaggaaucccacacgcggacugcggagagugggagggcgagcucaggaaucccacacgcggagggcgggagggcgggcucaggaaucccacacgcggacugcagagagugggagggcgggcucaggaaucccacacgcggagggcgggagggcgggcucaggaaucccacaugcggagggcgggagggcgggcucaggaaucccacacgcggacugcggagagugggagggcgagcucaggaaucccacacgcggagggcgggagggcgagcucaggaaucccacacgcggacugcagagagugggagggcgagcucaggaaucccacacgcggacugcagagagugggagggugggcucaggaaucccacacgcggacugcagagagugggagggcgggcucaggaaucccacacgcggagggcgggagggcgggcucaggaaucccacaugcggagggcgggagggcgggcucaggaaucccacacgcggacugcagagagugggagggcgagcucaggaaucccacacgcggacugcagagagugggagggugggcucaggaaucccacacgcggacugcagagagugggagggcgggcucaggaaucccacacgcggacugcagagagugggagggcgggcucaggaaucccacacgcggacugcagagagugggagggcgagcucaggaaucccacacgcggagggcgggagggcgggcucaggaaucccacacgcggacugcggagagugggagggcgggcucaggaaucccacacgcggacugcagagagugggagggcgagcucaggaaucccacacgcggagggcgggagggcgggcucaggaaucccacacgcggacugcggagggcgggagggcgggcucaggaaucccacacgcggagggcgggagggcgggcucaggaaucccacacgcggacugcagagagugggagggcgggcucaggaaucccacacgcggagggcgggcucaggaaucccacacgcggacugcagagagugggagggcgagcucaggaaucccacacgcggagggcgggagggcgggcucaggaaucccacacgcggacugcggagagugggagggcgggcucaggaaucccacacgcggagggcgggagggcgggcucaggaaucccacacgcggagggcgggagggcgggcucaggaaucccacacgcggacugcggagagugggagggcgggcucaggaaucccacacgcggagggcgggagggcgggcucaggaaucccacacgcggagggcgggcucaggaaucccacacgcggacugcagagagugggagggcgggcucaggaaucccacagcuaguguuucagcgucuccgugucccgugugcccccagcacguuccaagagccaggcugcugcaugcgauguggacaacaggguguccucggcaguggacugugcuucugugagacuggacacggggccgcccgcggugccgccucggguaugacuggcugccgucugagggaggggacguggccguugccacauggguggcuugucccugccauccucuguggggcccuuggcugccccugggggaggcagagaccaucuuguggucaugucaugacagcccuucccuguacgagcuagcggccgagggcgcguguccuggugacuaggcugcacacugugagugaguugcugugcuuuucagugaaguugugaaaauacuuaaaacgggaacucaggcagacuguggcuacuuuucuaaguaacgugcaccucgugcaaaccggaaugcgguucggcguugccaagcugguucugaacugcagcagucuggacacauguugaguuucagcccagcuccagaccgcggucagagcgcugucaccgagagcggguuccccggaggccauggcugagcugccccgugggggcaggcuuucuccugaguguuagcuuugaugcccauagaagaguuuuuuauuuucauguuuuuuaauuaaaaugaaucaauguucuuuuaucaguuacauacuguauucacuuaaaacaauuuuaaaauagaccuucaugccaguauagugugggaaauuuaaaaaaaaaaaaaaggcgcaguggcucacgccuauaaucccagcacuuugagaggcugaagcaggaggaucacuugagccuggggauuuaagaccagucugcgcaauauagugagacccugucucuacgaaacauuaucuggguguggugguucacaccuuuagucccaguuucucgggaggcugaggugggaggaucaccugagcccaggaggucaaggccaccaugagccaugauuguaccacugcccuccagccugggcaacagacccugucucaaaaaaagaaaaagaaaaacuuuauugcauuugucaaaaguuaugcuucacuguuucauaaagucaagcaauauaaaaaauuacagagaaaaaacgauguuacugcaaacccaccacuuguuccucucagaugucucugugugcaggucacacacccagcaccuagaggggcucccgucccccaccccgcccgccccucugcuuucugugaccauagacugguuuacguuugcuggaauuuuacguaaauggaguccuacacccuguguugacuugaaggaugccgaaguguuccuuccugggacuuucuguuucauaaaguucuguuuuucuccuccuuguccacuuucucaucuucuuccuuuuuucuucacaguuucugguuugaauugagaucuaaagaaggugcauacauugcaguuguugauaaaucccuuuaaauauccagauuccuccgucuuccuuuuccuugacuauguuguggacgauguugaaugauuugccaucggugcuuucaguaguccgacuucugcugauugcaucucccuggucucauuuaacagauuccucugucccuggaguuccugcaaaguaguacuuagagcuagaggcuuuaugggauuuacagugauuuguccauuugucuuguugauguauaccuuuguugauguauagcuuuguugauguauaacugacauacagcaaauggccccuauuucaaauguacaguuugaucgguuuugacaugugucuguaccccagugacccaccacagucaacacagugaacacauauauccaacaccccaaguuuccuccuguccaucccggagcccuccccacaccaugcaaccaugacccacuuucugccugcacagcaguuuuacauuugcuggaggcucagguaaaugcagucaugugcugugugcuucacuggucuggccaccuucacucagcauaauuacuguggguccagaugcguggcucgcucacagcaguggugacccucgaacaguguguuggaacugcacagccuacguacacuuggguuuuucucagcaaguguauuggagagguuuuuggagauguguaacaauuuggaaaagcuuucagacaaacagcauggccuaggaauacugaaaacacuaacaaaaagaugugucaugaguacauaaaauauauagugaugcuaguguuuuuaaaucauguaauaccaaaaauuauacacaaaucuauuauaaaaaguuaaaauuuaucaaaacuuaacaugcauacaaacacuuauagaccacauauggggucuuucacaguuuagagaaauuaaacaaauguagggaugcagaaaugaaucacaacugcacaaaacucacugcagugcgugcugcacgacugauguuuuacaaaccccuccugccggcacagccgcgagcucaggugcugugagugcuuaaaacgcugggugaggcugaucaucuccgcaagcacagcuccucccuccaguaaaucacaaaucacaguaaaaaagugaucucucggccaggcgcaguggcucaugccuguaaucccagcgcuuucggaggccaaggcagguggaucaugaggucaggaguucgagaccagccuggccaagauggugaaaccccgucccuacuaaaaauacaaaaauuagccaggcacagugacaggugccuguaaucccagcuacaugggaggcugaggcaggagaaucgcuugaacccagguggcagagguugcagugagcugagaucgcgccacugcacucuagccugggcgacagagcgagacuccaucucaaaaaaacaaaacaaaacaaaaaacaacaacaaaaaaaaccagugaccucucacaguuuucacacaguuuuaaucauguuuaaggcgauccuauaaaccuugagugacacccuaggacccauacacagugccacugguaaugcuggaggugcucccaaaaagcagagaaaagucaugacauuacaagaaaaagcugaauuccuugcuauguacuguagacugagggcugcagcuguggucauuucagacagaugauucuuguaaacagacuacgugaacuuaggguaucaauaaauacaguacaguaccauaaauguauuuucucuuccuuaugauuuucuuaauaagcuuuucuuuccucuagcuuacuuuauuguaaaaauacagcauauaguacauauaacauacaaaauauguguuaaccgaccguugauguuaucgguaaggcuucccaucaacaggaaggcauuagugguuaaauuuucggggaguuaaaacuuauacauggauuuucaacugugcagggggucagcaccccuaacccccacauuguucaggggucagcuguguucugugguguggauguacaauuuguuuacccacuuagcuguagauggacauuugaguuguuccaguuccuugcacauuuguguacaagccuuugugcaugacagugaacauauguacaagccuuugugugugcaugacagugaacauauguacaagccuuugugugugcaugacagugaacauauguacaagccuuugugcaugacagugaacauauguacaagccuuugugugugcaugacagugaauauauguccagccuuuucucuugggaaaauacuuagaaguggaagggcugguucauaugguagggauguguuucacuuuuaaagaaacugccaaagugcuuuccaaauugguugcaccauuuuacauucucaagccauguaugagaauucaguucuuccauguccuugccaacucuugauaugaucuuuuuuuuuuuuuaauuuuagcuaaucuaguagguauguagugguaucucguggugauuuuaguuugcauuucucaaauggguaauaaugugaaacaucuuuucguagauguauuugccauccguguaucuucuuugguaaagugucuguucacauccuuugcccauuuuuguguugaauuguuugcauucuuauuguugaauuuuaagaguuguuuauauauuccagacacaaguccuuugucagacuuuguaaauauguuuucugagucaguggcuugucuuuucauucuuuuaacaaugucuuucaaagaguagaaguuguaauuuuugggccaggcaugguggcucacgccuguaaucccagcacuuugggaggccaagguggguggaucaugaggucaggcaguugagaccauccuggcugacacagugacaccccaucucuacuaaaaauacaaaaaauuagccaggcaugguggugggcgccuguagucccagcuacucaggaggcugaggcaggagaauggcaugaacccgggaggcagagcuugcagugagccgagauugugccacugcacuccagccugggagacagagugaaacuccgucucaaaacaaaacaaaacaaacaaaguuguaauuuuugaugaaauucaauuuaucuauuuuccuuuuauggacaugcuuuuuuagauuuaaaauuuuuuuaaauuauuguggguacauaguaaguacguauauuuauggauuaugugagauauuugcauauaggcaugcagugcaugauaaucacaucaggguaaaugggguauccgucacuucaccucaagcauuuauccuuuguguuacaaacaauacaacuauauucuuuuaguuauuuuuaaguguagaguuaaacuaauuuugacuauagucacccuguugugccagcaaauucuaggucuuauucauucuuuguaacuauauauaucuagauauauaucuauauauagauauagauagauagauagaucuagauagauauagauauauauauauauauauuuuuuuuuuuaaacccauuaaccuucccuacuucccucccaccacccacuacucuucccagccucugguaaccauccuuuuauucucuaucuccaugaggucaauuguuugaauguuuagcucccacaaauaagcgagaacaugugaaguuugucuuucugugucuggcuuauuucacuuaacauaaugaccccccagugccgucuauguuguugcaaaugccaggaucucauucauacacuucauuguguguauguaccacauuucuuuauucauucaugugaugauagacauuuagauuguuuccaaaucuuggcuauugugaauagugcugcagugaauacgugagugcaggcaacucuuugauauacugauuuccuuucuuuugagcauauacccaggagagggauugcuggaucauacaguggcucuauuuuuaguuuuuugaggaaccuccaaacuguucuccauagugguuguacuaauuuacauucccaccgacauuguacagggguucccuuuucuucacaucuucaccagcauuuguuauggacugauuuuuuggauaaaagccauuuuaacuggaaugagaaaaauuguauguuuuauuugcauuucucugaugaucagugauguugagcaccuuuucaugugccuguuugcuauuugucuucuuuugagaagugucuguucagaucuuuugcccacauuuaaucggauuauucuauuuuuccuagaguuguuugagcucuguauauguucugguuauuaaucccuugucagauggguaauuuacaaauauuuucucccauucuguggguugucucuucacuuuguugauaguuuccuuugcuguacagaagcuuuuuaacuugaugugaucccgucugcccauuuuugcuuugguugccugugcuuguggggucuuacucaagaaaucguugcccaguccaauguccuagagaauuuccccaauguuuucuuucaguaguuucauaguuugaagucuuaaauguaagucuuuaauccauuuugauuugauuuuugcauauggugaaagauaggggucuaauuucauucuuuugcauauggauauccaguuuucccaacaccauuuauugaagagaccaucucuuccccaauguaaguucuuggcauguuugucaaaaaugaguucacuguagauauauugauuuaucuauggguucucuauucuguuccacggaucuaugugucuguuuuuaugcaaguaccaugcuguuuugauugcuauagcucuguagucuaagucagguaaugugauuccuccaauuuuguuccucuugcuuaggauagcuggggcuauucugguucuucugugguuucauauaaauuuuaggguuguguuuucuauuuuuuuuuuuuuuuuugaggcagagucucgcucugucauccaggcuggagugcagucgcgcguucucggcucacugcaaccucugccuccaggguucgagugauucuccugccucagcuugcugagcagcugggacuacaggugcgcaccaccauacccagcuaauuuuguauuuuuaauggagaggggguuucaccauauuggccagggcuggucucaaacuccugaccucaugauccaccugccuuggccucccaaagugcugggauuacaggcaugagccacugcacccagccuguguuuucuguuuuugugaagaaugccauugguauuuugauagggauugcauuaaaucuauagauugcuuuggguaguauagauauuuuaacaauagucguucuucgaauccgugaaccuggaauaucuuuccauuuuuuuggugccuucuuuaauuucuugcaucaguguuuuauaguuuucaucauagagaucuuucacuccuuugguugaguuaauuccuugguaauuuuauuuuaguuaucacuguuguaaaugagauuacucuucuuuaauuucuugcaucaguguuuuauaguuuucaucguagagaucuuucacuccuuugguugaguuaauuccuaggcauuuuauuuuaguuaucacuauuguaaaugagauuacucuucuuuaauuucuugcaucaguguuuuauaguuuucauuguagagaucuuucacucuuuuauuuuaguuaauuccuagauauuuuauuuuauuuguagcuauuguaaaugagauuacuuucuugauuucuuuuucaaauuguucacuguuggcauauagaaaugcuacugauggccggacauaguggcucacaucuauaaucccagcacuuugggagggcgagguggguggaucaugaggucaggagaucgagacccauccugguuaacauagcgaaaccccgucucuacuuaaaauauacaaaauuagccaggcgugguggcacaugccuguaaucccagcuacuugggaggcugaggcaggagaauugcuugaacccgggaagcagagguugcagugagccaagaucaugccacugcacuccagccugggugacagggugagacuccaucucaaaaaaaaaaaaaaagaaaaagaaaugcuacugacuuuuguauguugauuuuguauccugaaacuuugcugaguuuguuuaucaggucuaauaguuguuugguggagucuuuagguuuuuuuaaaauauaagauuauaucaucugcaaacauggagaauuugacuucuuccuuuccaauuuggaugcccuuuauuucucuugccugauugcuuuagcuaggacuuucaguacaauguugaauaacaguggugacaguaggcaugcuugucauguucccaaucucagaggaaaggcuuucaguuuuucuucauucaauaugauacuaauuguggaucuuuuguauauggcuuuuauuauguuaagggauguuccuucuauaccuugcuuuuuaggauuuuuaaucaugaagagauguugaauguuaucaaaugcuuuuucagcaugaauugaauugaucauaugguuuuugugucuauucuguugacaugauguaucacauuaauugauuugcauauguugaacuauccuugcaucccuggaauaaaucccacuuggucgugaugaaugaucuuuuuaauguguuguugaauucgguuugcuaguacuuuguugaggauuucagugguuacagugauauuggccuauaguuuuaauuuuuuuaugugucuuugucugguuuugguaucaggguaaaauuggucuuguagagugaguuuggaaguauuccuuccuccucuauuuuuuggaauaauuuggguaggauugguauuaguucuuuaaauguuugguagauuucagcagugaagccauugggucccaggcuuuucuuugcuaggagacuuuguauuaugacuuugacccuguuacuuguuauugaucuauuuagguuuuggauuuuuucaugguucagucuugguaggcuguaugugucuaggaauuuugauuuuuuuuccuagauuuucuagaucucuuccccuagauuuauuucuaauuuuucuaaauuuuucccuuagauuuuccaauuuauugguguauacuugcucauacuagccacuaauuucuuugaauuucuccaguaucaguuguaaugucucucuuuucaucccugauuuuauuuggguguucucucuuuuuuuguuagucuggcuaaaaguuuaucaauuuuguuuaucuuuucaaagaaccaacuuuuuguuucauugaucuuuuguauuuucuuuauguugaauucauuuauuucugcucugauuuuuguuauuuauuuucuucuacuaauuuuggguuuguugcuuuucuaguugcuuaagaugcauuguuagguuguuuauuugaagguuuucuucuuuuuugauguagacacuuauaacuauuuaaaacuuccuucuuaguacuguuuuugcuauauccuauagguuuugguauguuguguuuccauuaucauuuguuucaagaaauguuuuaaguuccuucuuacuuucuucauugacccacuugucauucaggagcauauuguuaaauuaccauuguuuguauaguuuccaaaauuccucuuauugauuucuaguuuuaguccauuaaauaaaacuagauauuuuaguagucagaggagaugcuugauauuauuucagguguuuuuuuuuuuaauguuguaagacuuguuuugugaccuaacaaaugaucuguccuugaggaugauccaugugcugcggaaaagaauguguacuccgcagccaauggaggaaauauuuuguaaauaucuauuagguccauuuggucuguagcacagauuaaguccaauguuucuuguugauuuucugucuggaaaaucuguucagugcugaaaauugaagguguugaagaggguguugaagucuccagauguuauuauauugagggucuaucucuuuagcuuuaauaauauuuugcuuuauauaucugggugcuacaauauugggugcauauauauuuaugacuguuauauucucuugaguugaccuuuuuaucaucauauggugaccuucuuugucucauaauuuuuuucuuuaaaucuauuucaucugagauagacccucaauauaaguauagcuacuccugcucuuuucugguuccauuggcauggaguauguuuuuccacugcuuuauuuuaagccuguuucuuuagaagccagguguguuucuuguaggcaacagaucauugggucuuguuuuuuaauccauucagccacucuaugucuuuugauuggagaauuuaauccacuuacauuuaauguuacuauugauaaauaaggacuuacuccugccauuuuguuauuuguuuucugguuguauuuugguauucuccucuuccuuuccuuccuucaugucuuccuuuuagugaaggugauuuucucuggcaauaugauuugauuucuugcuuuuuaugguuuguguauucauuguauauuuuuuauuugagguuaccaccaggcuuacaaauauuaucuuauuacccauuauuuuaagcuaauaacaacuuaauacuauuugcauaaacaaacaugcaagcaaaaagaaaacuaauaaaaacucuauaccuuaacuuugucccccacuuuuuaacuuuuuguuguuucuauuuauaucuuauuguacuaucuguugaaaaguuauuauaguuauucuuuuugauugguucauuguucagucuuucacuuaagaguaguuuacacaccacaguuacagcauuauaauacuuuguguuuuucuguguacucauauuagcagugaguuuuguaccuucaggugauuucuuuuugcucauuaauaucccuuucuuucugauuaaaguacucucuuuagcauuucuuguaggacaggucugguguugauaauaucccucagcuuuuguuugucugggaaagucuuuaucucuccuucauguuugaaggauauuuucauuggauauacuauucuaguguaaaaguuuuuuccuucagcacguuacauaugucaugccauccucuccuaggcaugaaagacugaccuguaaaguuucuaccgaaaagucugcugccagacauauugcagcuccauuguguuauuuguuucuuuucucuugcugcuuguaggguccuuucuuuauccuugaccuucaggaguuugauuauuaaaugccuugagguagucuucuuuggguuaaaucugcuugguguucuauaaccucuuuauucuuggauauugauagcuuucucuagguuugggaaguuauuaucccuuugaauaaauuuucuaccccuaucucucuaccuccuuuuuagggccaauaacucuuagauuugcccuuuugaggugauuuucuagauauuguaggcaugcuucauuauuguuuauucuuuuuuauuuugucuucucugacuauguauuuucaaauagccuuucuucaagcucacuaauucuucugcuugaucaauucugcuauuaaaaaguucugauucauucuuuaguaugucaacugcauuuuucagcuccagaauuucugcuucuuuuuaauuauuuuaaucucuuuguuaauuuuuuuaaauagaauuccgaauaccuucuguguuaucuugaauuucucugaguuuccucagaacaacuacuuugaauucucugacugaaaggucacauaucucuguuucuccaggauuggucccuggugccucauuuaguucauuugguaaggucauguuuuccaggauggucuugaugcuuauggauguucaucugugucugggcauugcagagauagguauuugucauauagucuuugcagucuauguuuguucguaccuguccuucuuggaaaggcuuuccagguagucaguaggacuugaguguugcgaucuaagcugcaucugcauuccacuuggcuggggaggccucacaaucauggcagaaggcaaggaggaccaagcuuacguggauggcgacaggcaaagagagaaugagagagaagcgaaaucggaaaccccauguaaaaccaucagaucuugugagacuuauucacuaccaugagaacaguaugggggaaacugcccucaugauucaguuaucucccacuggguccuucccacaacacgugggaauuaugggaguacaauucaagaugagauuuggguagggacacagccaaaccauaucagccaccuugcuccccacuccccgcccauggaugugguuuugauguuguaucuaagaaaucuuuggcuaacccaguucacaaaaguuuuccuccuguuuucuucuaaaaaguguauaguuuuggguuuuacauacagaucuacaauccauuuuuuaguuaauuuucaucuacgaucuggauuauuaucuuaaucagcucaggcugccauaacaaaaugccagaggcuagguggcuuaaacaacagaauuuauuuucucacaauucuggaagcuggaaagucuuagaucaagaccuggcagggcuugcuuucugauguggcucuuccuggcuugcagacacccaccuuuucucugaacccugauauggcagagacagagggagagagagcaggcucuguggugucucuuauuauaaagacacugaucccaguagagccccacccucacgugaaaucuaaucaucucccagaggccccauuuccacaauaccucaaauaggggguuagggcuucaaccagugccugucacaguccuggaagacagaaucuccagugcuguaauucugaaauuugaaaucccuaaagaucaaaauccccaaaucuaaaauuccuagcaucuaacugaauccccaaacuauaaugauggauuuggaauuaggugccaucaagucuucuguaagugaauuucaaguuguuaccaauaaaguuuguuuuuuccauucaguccaaugcauuuggugcaaaauccagaugaguggcuuggccacgugauauggcagugacagaaacuuccguuuaaaaaugaguugagucucuugccuacgauggcgagucucuugccuguguuggcguuccugcugaugacacugccugcguuggcguuccucccagcugaucacacacugagagcuuuuagggaaucauggccacauuugcccaaagaaaccagcaaagugacugacugcuucaaaauaauuguguguauaguaggauaagaagacacuuacacaacaguguucuguuccaucaccaguaugguuuguauuaaaccuggggucuguacaagagggcaugcagaaugcauauccacguacccagaacaacacagaagcacagcauggaagacgggaaaauguaaggagaaggcuuauccuggugugugucaaaucacagaggaguuucaaaaagagcagugccgcagagaagaugaaugugagcucauucuccaaggaagccaugucuuaaaagaaagcgguuauccauugugaugcaaaccuucaaaauacacuuaaugauugugaaagucagccagcucuuagggacuguuucugugcaauugcccguaauauacuccugugguauacuuuuucauaaaucagauuuucuguuuaguuuuuuauuguuuguaauuuuuucuauuuuuguuuguuuuuucuauuuuaaauugucagcauuauguuuuacaaucacuaugcuuguguuucaccuuugcaucauuucuuuuacagagcuguaauucauuuaugcaucuuuuugcaaauucgacuccacaaaggugcacuaucaacaauguugacuuuguaagcauugugcauguccguaaaaacguugaaacuuccuuaguaaaugaaaagauguccuuuuuguacaucugcauuuaugaaagaugaaauuucuugagaucuuggcuuuuggggugaauguguauguggugguaaccaucuuuuuuuuuuuuuuuuuuuuuaguuccagaauacaugugcagaaugggggguacauuuguuacauaggcaaaccugugccauggugguuugcugcacccaucaacccaccaccuagguauuaagcccugcaugcauuagcuauuuuuccugaugcccucccuucccccaccuccacaacaggccguaguguguguuguuccccccguguccauauguucucauuguucagcucccacuuaugagugagaacaugcaguguuuggguuucuguuccuguuuugguuugcugaggauaauggcuuccaccuccaucuaugucccugcaaaguacaugaucucauucauuuuuaugacuacauaauauuccaugguauaccacauuuucuuuauccagucuaucauugaugggcauuuggguugauuacaugucuuugcuauugugaauggugcugcagugaacauacgcgugcauguaccuuuauaauagaaugaucuguauuccuuuggguauguaccaguaguaggauugcugggucaaauggcauuucugguuguagauccuugaggaaucaccacacugucuuacacaaugguuggacuaauuuacauucccaccaacaguguaaaagcaucccuacuucuccacagccuugccagcaucuguuguuucuugauuuuuaaaaaaucgccauucugacuggcuugaggugguaucucauugugguuuugguuuucaauucucugaugaucagugauguugagcuuuuuaucauauguuuguugcugccuaaaugucuucuuuugagaagugucuguucauguccuuugcccacuuuuugauggguuguuuguuuuuucuuguaaaguuaaguuccuuguagauuccagauauuagaccuuugucagauggacagauugcaaaaauuuucccccauuccauagcuugucuguucacucugaugguguaguuucuuuugcugugcagaagcucuuuaguuuaauuaggucccauuugucaauuuugcuuuuguuguaauugcuuuugauguuuuugucauguaauauuuucccaugccuaugucccgaaugguauugccuagaguuucuuguaggguuuuuguaguuuuggguuuuacguuuaagucuuuaauccaucuugaguuaauuuuuguauaagguguaaagaagggcuccaguuucaguuuucugcauauggcuagccaguuuucccugcaccauuuauuaaacagggaauccuuuccccauuacuuguuuuugucagguuugucgaagcucuguuugcagacaacaugauccuauauuuagaaaacuucaucaucuuagcccaaaagcuccuuaagcugauaagcaacuucagcaaagucucaggauacaaaaucaaugugcaaaaaucacaagcauuccuauacaccaacaguagacaagcagagagcuaaaucaugaaugaacuuccauucacaauugcuacaaagagaauaaaauaccuaggaauacagcuaacaagggaggugaaggaccucuucaaggagaacuacaaaccacugcucaaggaaauaagagaggacacaaacaaauggaaaaauauuccaugcucauggauaggaagaaucaauaucgugaaaauggccauacugcccaaaguaacuuauagauucaaugcuauucccauuaaauuaccauugacauuccucacagaauuagaaaaaacuacuuuaaaauucauguagaacugaaaaagagccuguauaaccaagacaguccuaagcaaaaagaacaaagcuggagacaucacacucccugacuucaaacuauacuacaagucuacaguaaccaaaacagcaugguacugguacaaaaacagacacauaggccaacagaacagaauagagaucucagaaauaaaaccacacauauacaaccaucaugguuuuugauggaucuuguccaaagacuuagguuguccaacagaauauuucagaugacaggagcuauuucuuuaugaauacgguucaucugcucauuaaccguuauacccaugugacugucauuaguguacuugaguguuuaugcuuguaaaaauguguguguuaguauugucuguuuuauuguguaaaguggccuaugaagcaugcugucauguuuuuguacauuucucaaauaagucuucuuuuuaaaauuguaagcaaaugucuuucaaaucauuauuuauuuuuuccuuuuucucgcuaacauuugagauaaagaauuuuuuaaauuuuuauggacacauaguagguguauauaauuauggagcacaugagauauuuugauaaaggcaugcaaaguguaauaacuauauuaggguaaaugggguaaagaauuuuuaaaauuauuuuuucaagaacuacauuuuucaggauugugauuugggggauuuuagacuuuagggauuuugaucuuucaggauuucaacauccuggauuaugguguucgagacugugucagccccacuccagggcaggagaaaggcacucugccucguggggguauggucagguuagugggacagggaggagcgggggcagccagcugcacaccucaguccaagaggagaaaggugcucugcaccccaugaggggugccaggacguccaccucuaauagcgagguugugggaguaauacgccccaacauuacggauuucuugugaucgcaccauguaaugaaaugcuuucugaauuuugaaaauguaauuuugaucugcaguaaaacugaaaccuuaguauaaggaucacuggcuucuaacguuggugcuguuuaugaugacggcaucaacuauuccauuaagugaguucacagugaucaggguuccuugaugagcuuugcuuuccgcaucaaaucugcuucaccagcuuucaaguucuauuccauaacauccugugucacgcggaaaagcgggggaagaaaaagaccuucuuccauuuagauuuacuuuuuacauuuggagaagaugaauauuccauugauggccucuuacagguaccagugguuaaagcguggggaagcgaauuuguuuuccugcuuuuaaagcgauuuccuuacuuccagcccagcuuguggguauagccuguccucucccaacacaccuggcauugcacgggagccuccagccagcagcguauggugggggcggaggggcguggaggugccugccagauguugacgauuaccaaggaacagaggcugcucuguggccacggggucgggcugccgcagagcagcuauuuccugucugcaccggcggcagcaagcccaaacugugggcugcagccgaguucacgggcacaaagucaccuuugugagugucuggugcagcuuccuggcugggaagcggagagggucccccacguugaaagggugugcagagucccucgcccugagcuccuggcccggugucagguuucugagcagggcuccugaagacagcaugagggcuuugaucccaggcacucagcacuuggagugcacagagaacaggcccggacccuccugaggagcccuccuggguccucccaucaccagaguucagagauucugggaugugccacuucuucagggacacacacuuuccuggaauacacgaugauuuuuaaugcuuuucuuaaagaaugccagcugucucacggggcagggaaauggaaaaccucguaaggccucucuucuucuuaacugggaaguaaaaauuccauauucauuguggaagcuuuuggccuccgaucaacccugggcuccugauuuugguuuuccucuuuggagauucagucccgcguauuagggcagugggaggcguggggucgccgcagccucaggaccugcugagcacgggcuucugcugcuuuugauucuuggguagcaggagucacgugaaaacggugccacuaaacaccaaggauguaauugaaguggaggaggcacaguuugaaccagaaauucauguuccgaaucgagggguaacaugaagacccagucauaacaaauaaaucagguagguccucuuagauagaauuuuccuuuagcaaguuagugggaauuaacgugugaaguucaaagaagagaucucauuuaaaccauuucucagcuguuacauuaacagaaaucacuuccaacuauuuuaauaagguaacucagccaccaagucaaguuuuauguucauugucugagucacauuugugaugugggaaguggcauauuuugauuugacuuuugaugugucuguuugacaugccugaugggauagucaccacauacaacguuaaaucagagcuguguaaaauuaacacugcuaauucuaaacaaaccgaaaggugaaaguugucuaugccaguggccugggguggugccugccugaaagcgccccugucugagacaggcccucuuuguaccuucugucccuuccccagggggcugcaucuccugauuccagggaggcccaaaggggaggcaugggcagaaccgccacccggcuucccagguugccuugggcccuucuggaaacucgagggagggggucccagcagggccacgaaggggacucagagguccuggcagcuugaaggaaguggacagggcugagaugcaugcuccugcucuagcuacccggggugggccgcacucaccaagaagggaaggcagacaguggugugacgcggaccccugcugcccugcacgucuccuggggggaucccugcuuccccgccgucccagcucaggcccccauaaaggaacacuacagacagggcagcuuaaacaacagacauuuguguucuuaaaguucuugggucuggagguccaagcucaggcugcuggcaggguggguuccuccucaugccucucuguggcuugcagauggcacccuuucccugcacgacccuguagccucucccugugugcucacauggccucuccccugcauaaucacguggucucucccugcauccuccuguggccucucccugcguccuccuguggccucuccccugcauaaucacguggucucucccugcauccuccuguggccucucccugcguccuccuguggccucucccugugugcucacauggccucuccccugcauaaucacguggccucucccugcguccuucuguggccucuccccgugugcucacguggccucucccccacauccucacauggccucucccccgugugcucacguggccucuccccugcgugaucauauggccuccugugugcucacguggccucuccccucccccacguccucauguggccucuccccugcgugaucauauggccucucuucugugugcucacguggccucuccccucccccacguccucacguggccucucccccaugugcucacaugaucucucccccgugugcucacguggccucuccccugcgugaucauauggccucucuccugugugcucacguggccucuccccucccccacguccucacguggccucuccccugcgugaucauauggccucucuucugugugcucauguggccucucccugugugcucacugcuggugucucuuccucuucuuauaaggacaacaguccagggccccaccuuugggacucacguaaccuuagcuaccuccuuaaaagcccaucuccaaauacagucacauugggaguuagggcuucaacccguuaaucugaggcacacaguucaguccucagcacuuggacacccuccuccgccccggggccccugcccugccuggugccccugcccgcucuagggcugcauaacgggagccgcugcccccacggagcaucugcugugcgacuguuccuggcggcgcccauccugucaccauugcugagcuguuccuuuccuucccccagcaucugaacggcaccugccacaggucggcaggaaugagaagugagaaaaaugagacccacucuucguaguuucugaucucaugguucuguguggggcugggaaugugugucucuaacgcgugcccgaguguuuaaaauggacucugagaaugugucacacugaguccacguggaggucaggcuucuggcgaagugugcaugaaaaacugcuuccccccaggaugguagagucauuuugacaaagucuacccaauuaaaaaagguuguauuuugaaauaauuuuagacucacauaaaaauugcagaacuaaaacauauauauauuuugagauggagucucgcucugucgcccagacuggagugcaauggcgugaucucggcucacugcaaccuccgccuucuggguucaagcaauucuccugccccagccucccgaguagcugggauuacagccacgugccaucaugccuggcuaauuuucguguuuuuguagagaccagguuucagcauguugggcaggcuggucucgaacuccuggccucaggugauccaucugccucggccucccgaagugcugggauuacaggugugagccacugcgcccagccaaaaaauugcagaaauauuaauagcacagagaguuccuauguaccccccaucuccuccacccccagcugcuaacaucuuauauaaccagagaacaaggacccaaaccagaaacuccacguggauacgauguggcagccacagaccccaugcaguucacuuauucuugguggagggaguucugugagacguccccauguuuccagaucaacacgacaaucaggacaucgagggucccaucacccggagaaacugccuuuagagucacauuuucuccugaccuguccuagucuguccaggcugcuaggacaaaaauaccauaaacuggguggcuuauaaacuacaaacaucuguuuccaccguuuuggaagcuggagucccagaucaaggcaccagauuuggucucugugaggccugauuccugguucucaccguguccucacguggugggagggacaaggcucucugugaggcccuuucgugggcucugaucccauucacguggcgggagggaagaggaucuccgugaggcccuuuugugggcucauuuuccaauuacauuacugguuuuguuguugaaucugagcguuuucuucuggacauaagaccuccauuggagauaaaacuugcaaguacauuugauccuugaauaacaugagugugaacugggaguccacuuacacacgaguuuuaaaaauaaauauauuggaaaauguuuuggagauuuaugacaauuugaaaaaagucgcagaugaacugacacccgggacagcaagaacccuccuuccucggcccgcucggcccaucaccacagaggugagaaggauggaggcuccuccacccgcucggcccaucaccacagaggugagaaggauggaggcuccuccacccgcuuggcccaucaccauggaggugagaaggauggaggcuccuccacccgcuuggcccaucaccacggaggugagaaagauggaggcuccuccacccgcucggcccaucaccacggaggugagaagguuggaggccuuugugaugauccacuuccauuuaaugaauagucaauguguuuucucuuccuuaugauuuucuuaguaacacuuucuuuucuccagcuuacuucauuguaagaauacgguauauaauacacaaaacguacagaauguacaggacaauguugaucaccuguuuauguuauugguaaggcauccggucaacaguaggcucucagccaugucaaccuaaagaaagaugcugaggcaaaguuaguacauguggaggguuuauuugggccacgugugaggacggcauccugggggacguagauucagguggcuccgaacauaugcuccaguuagcagcaguuacaguggguuugaaagaaagaaagaaggggcaaguucccacacugguucauuaaaauaacauaagcuauugacuggcuguagaugguucuuugcaucacagauuccaggagcaugaagauaaugggugaaggucacauugucuaacuuguguaacauuucuugugauuuuucagccagccuggaaacaacagggaaggaaaggaagacaaaugccuuuaaacaguuggccccacaugggugcggcgggggaggcaugaugcaggucucacccucgcagcuccgcuggggcuggugaauaccucgcguggcgccgacuccucugagccacuuuuguuucucagugcuuaaguuuugggggaguccaagguuauacguggauuuucggcugcauggggagugggucacccuaaacccuguauugcuaaagggccuaccucauuuccuccugaucuguggcuggaacuaggaucauggauuuggcguuuuauccaggaucccugacucugacccccuguaauuauuuccuaaguaacuagagcaauaagaauaucuuuuaaaguauugagccuuuuguccuugguuucugaaguaaauucugaaagauaaagcuggaagagucuuuuguuuacaaguuccuucaaacacaccugaguuuauguuaaugaggcauuuuuggaacaccccuagauaccgcaggaugaggggggcugguugccaggggaaccagccaugugcucagaggguuggaacuuugagccccacccccaaaccuccggggagggaaagggguugaggcuuagggugaucagcaauggcccacgagcuacgcaaccacaccuacaucaugaacucguacaguaacccaaagggacgagccucggggacuuccagauggcugaacacaugcaggguccuggaggguguugggccccaagaggaccuagaccgucuacaccacuucccccauaccuuuccccgucaucucuucaucuguauccuugaauaacauucuuuuuaauaaacugguagguguaaguaaguguuucccugaauucugugggucccucuagaaaauuaacugaauccaaggaagagguugugggaaccccgauuuauagcuggagggucaaacagccugggacuucaguuggcauuggaaguugaagagaaggggucacggggacugagcccucaccugggggggucugaggcugucuccagguagaugguguugggauugaguuagaggaugccugacuggugucuacuccagaacugaugguuugcuugguguauggagaacagacccgcacauuguggugggagagcagaggaaaaacagccuuuucuacgugggggcuucccuuuucauccacguagaauuuuucacagaacaaaaguuucuaauuuugaugaaguccaauuaauugauauuuuuugauguauuuuuuuaauaugcuuugagugucaacacccaagacuacuucaccuaacccuaggacauaaggauuuucuucuaaaaguuuuauaguuuuacauuuuacauuuagagcuauguccuuguaggcugaguuagugugagguuuaaaucaaggguuuuguuuguucguuuuggcuuaugaaugcccacauguuucuacacugauuuugcugaaaauccuucuuccacugguugcuucugggccuugucaaaaaaccaucugaccacagagugugggucugucuguuccuggacuuuguucuaguccauugaccugugugucugucccuccaccaguaacaucaucuugaugaccaggucuuaaaauugguuaauguguuuccucuaacuuguuuuuggcuauucuaguauuucugccucuguauauaaauuuuagaaucagcuugccuauauuuacaaagaaucuagcugagauuuucauagcaagugaguuaaacuuacaaaucaauuuguauagaguugacaucuuuacuauagaguuuuccaauucacuauuugucccguccuccacugaaauuuuccucgauuuccuucauucacauguuguaguuuuuaguguacaaguccuguacauuuguuagauuuauaccuaaguauuuguuuuaggcaauuauacaugcuacuguguguuuaauuuugguuucuaauuguccacugcuaacuuacagaaacguauaccuaaaaguuacaggacuguucagacucuauuucgucuugguauaaugcaacuuacagcucuggcagcuugcgauuuuugaggaauugauccacuugcucuaaauuauccaguuuguguguuuaggguuauuugauaguauucucugugaugcguuuaguaucugugaggccuguaguaauauccccuuucauuuuagguauuaguuauuuggguccucucacuuuuuuaucagucuugguuuauuaucuauuuuauuaaucucuucaaagagccagcucuugguuugacuuuccucuauuguuuuucuguuuucaauuucauucauuucugccugauuguuucuuuuuucugcuugcuuuggggugucauuuugcucuuccuuugugguuuuucuaauguggaagcugaguuuuuuguccucagaccucucuucucuuuuaauguaagcauguagagccagcaacuucccuuuacauacuacaucagccgcauuguacagguuuucaauguacuuccauuuucauuuuggucaauacauuuuagauuucuuuugagacuuccucuuuggcccauggauuauugggaaguggguggggcugcugcugauugcugggguuguggagaagacucaccaggcccuugacaugugggagcaauggcgucuuccuccuugucucuagacucaacuggauucguacugagaagggcauucugagaaacuucacucccagcuucaacugguccaacauagcaaaaucagauuuuuuaaaaaauagaaggaaguaaauuaacuaagaaaaauacagaaaaauuuccuagaaccaaaacguacgagugaccugauuagaagggcucaccugguguugcgugcaggaaaugagaccugcauccggguucacggucgggaugcuucagagcccaagcacagucagagggaggaacaccaaggagcaggaaucgaagagcccggaauuccucacucacagcagcggaauccaggagacaccaggacacuaguuucagauuucucacagaaaggauuuugaacuaagaauuuuaugccucaccaaagugucaaucacgugcagagauauaacaaccuuuucauauucagauucaacauauccaucuccgauaaaaccuuccucggggcuuugcuggagccagucccuaaaauuaggaagcaaacugaggaaggugugagaugggacucacagacucgcagccugggggagaagcagaagggaccccaggaggaggcaggggaguucagcccugggagccgggaaaggaaaggccacgcguggcuuguuuuuauagaaauaaaggauuuuagguacaaacagcacgugcuuuuuuaaaauuacggaauuacucggggagcaacggaaaacaccugaugcccuccacguaaccagagguggcccgggucgcauggugaccacccacugccaccaccugugggaaccuccagccaagccccagggcaggaggagcuugggaaacggaaaacaggagugcacaucggucgggauggagcggaaaugcugggcaccaaaccccggugaugagaagacagaaaccgcaggaaguacuagagcguacguuuccaugcucgugugugacaugggcagcgugaaaacgaggcuguucugaggccucguuccaccccccucggucccagacuggaaucagccggcuucuccucucgggcgucaccguccugcccugcguccagugccugaacaccuccauuucacagauucugugugauuuucuaguugucugaggagggagagugguccagcucuuucacggugaccagaagugggagucaccagcgguggguuucgaguugcaccccagaccccccggagagccugaggauuggggcguugcucgcuccccacuguagcugcguuccagauacccaugagugcuuuuaaacaaagaaaaguuuuuuuuuguugaaaauguuaaguacaccaagggguagagaccacugucacauaacgguacucaccccccucccaacacugagcacccggagucuuucgaagcaaccccagacccgaccucagucacuccugaauacuccggugggugggggguguuacuguucaugggguuccauccucaagccguuuuaaagucacggaugcaaacacgguccgugucggggcggcgccgcagcuguccuuauucacgcagguuccgacuucgcggccuguaagccccuuuccucuugcuuucgggccuccguucauggguguccucgaucuuuccuucuaauagagaauacguuucccaguguuccucugccucccuuuguucagugggccagcguuuggcuuacguuaaguuucuccccugccguggccuucgaggugggcacugcgggucagcaggacugucuuccggccucccugccuggggccaccuggggcccugacucccugacgguggccuccggccccugggaggauggaguucggcucugucccggggcccucguuccccauaaguggccuccagccccugggaggauggaauccggcucugucccggggcccugacucuccauaguggccucuggucccugggaggauggaguucggcucugucccggggcccugacucuccauaguggccucuggucccugggaggauggaguccggcucugucccggggcccugacucuccauaguggccucuggucccugggaggauggaguccggcucugucccggggcccugacucuccauaguggccucuggucccugggaggauggaguccggcucugucccggggcccugacucuccauaguggccucuggucccugggaggauggaguccggcucugucccggggcccuuguuccccauaaguggccuccggccccugggaggauggagucgggcucuguccuggggcccuguuuccccauaaguggccucuggccccugggaggauggaguccggcucugucccggggcccugacucuccauaguggccucuggucccugggaggauggaguccggcucugucccggggcccugacucuccauaguggccucuggucccugggaggauggaguccggcucugucccggggcccucguuccccauaaguggccuccagccccugggaggauggaauccggcucuguccuggggcccuguuuccccauaaguggccucuggucccugggaggauggaguccggcucugucccggggcccugacucuccauaguggccucuggucccugggaggauggagucuggcucugucccggggcccucguuccccauaaguggccuccggccccugggaggauggagucgggcucuguccuggggcccuguuuccccauaaguggccuccagccccugggaggauggaguccggcucugucccggggcccucguuccccauaaguggccuccagccccugggaggauggaguccggcucugucccggggcccugacucuccauaguggccucuggucccugggaggauggagucuggcucugucccggggcccucguuccccauaaguggccuccggccccugggaggauggagucgggcucuguccuggggcccuguuuccccauaaguggccuccggccccugggaggauggaguccggcucugucccggggcccucguuccccauaguggccucuggucccugggaggauggaguccggcucugucccggggcccugacucuccauaguggccucuggucccugggaggauggaguccggcucugucccggggcccugacucuccauaguggccucuggucccugggaggauggaguccggcucugucccggggcccugacucuccauaguggccucuggucccugggaggauggaguccggcucugucccggggcccugacucuccauaguggccucuggucccugggaggauggaguucggcucugucccggggcccucguuccccauaaguggccuccagccccugggaggauggaguccggcucugucccggggcccugacucuccauaguggccucuggucccugggaggauggaguccggcucugucccggggcccugacucuccauaguggccucuggucccugggaggauggaguccggcucugucccggggcccucguuccccauaaguggccuccggccccugggaggauggaguccggcucugucccggggcccugacucuccauaguggccucuggucccugggaggauggaguccggcucugucccggggcccucguuccccauaaguggccuccggccccugggaggauggaguccggcucugucccggggcccugacucuccauaguggccucuggucccugggaggauggagucgggcucuguccuggggcccugguuccccauaaguggccuccggccccugggaggauggaguccggcucugucccggggcccugacucuccauaguggccuccggucccugggaggauggaguccggcucuguccuggggcccugguuccccauaaguggccuccggccccugggaggauggagucgggcucugucccagccccacguucuuugccugcuuccaccugugccugucugcgccgugcagacacugguucccagccugccugugccuccugccgcuguuccaagcugugggggggacccagcucacccccaggguccaguucagacuggaagggaauguggccccccacacccucagccuugauguggggccagggacacccgcuguggggggugaaugugcugauuagacccuggguggauccccacacacaagcagucagagggucauuuacagccugagcucacuccgcaaauaugaucaggaugggaacaggcagcuggcagccuccugccucacuccugucccucacgaggggacgcagcucugccugaccccuuggggaggcaccaaguccgcccugacuccgccccgccugaaucugcuggcugcuuugcgggcagcuccugagggcagcuguguucugcugagacugagccaccucugggcccugggccucugcucgaggcggccagcguucagccaagcucguccuucaccucagggggccugugugguugucacgcacaguguccagggucagcuugucagcgccggccacccgggcggccucagucagcacgcguuccccaaaccuguggggcccacgcuuggugcugaggguugaugaggagccagggaggaccaggagaguggaagugggaccuucugccagcuccguagaggacagccuggaaccggcucagacuggaggcagggaggcccaaggggcaggagaacucuccgaggggcagaaacagcacugcaguggcagucgcccauggagcguggagugcugguccacgacacccucucgacccacggugaaacgcgccccauggggcaaggggcugggcugcuugcuggucaguggcaggcggggugggaacacacagguacacggggcccaccugggucucugccacucucuccuguccacacgggagaggaguugaauccuaaggcaucucuuagcagccccagcgccauuguggggccacugccugagagccccugagcuccauccccuuugggucaccucucugggacccaguccgacuguucguaagauucaagggugcuggcugcucugugcccgcucguuugacgcuuacaacuacacgcagguaacuucuuagccggcuccgaacucagugugugguucccgcgguguaggcuucgguugcaccagguucccuccugugucccaggagcaggaagaggcugaguccacccccaccccaccccgccugccuccacgacacccaaggaccaggugccaggugagagccggacuccaauccugcccgggcgucaugugcugcuggaaaaagcuuuucaucuccuuuuccauucucaggagcgcugcuccccgggaagaccgugaaaaccggccuggucuauaugaaagacugaaauguuaucaguuccguaucuccguguuucuuuuccuuaaaaguuuguccuucauagcucagugauuuuaccucgcucuaaucaauuaucaaucaugaaauugaaaaacccacagauggucacagguguuuucaaucuucagagucguuauuugcuuugugucuacucguccuccuguuaacagaccaccagggcgucuccagcuuucauuguggguuugcccuuuucuccuuucgguuccuuuggucucgguacagugucugugcuuccauuuucuguccugugugagccccaggccugggcuugugagugggcgguggccccaaggcugugcacauggcccuguccaggcuggcagccgcgggagcacacgaaggcaucagagcuccgugcugugugugacacaggggcccccuccuucggggaagcguuccagaacucuccagccccuuccgcucacagccccagguccuucuggccccuaugagugugguguggucaguaccggguccuucuggccccuguggugugguguggucaguaccggguccuucuggccccuaugagugugguguggucggcaccagguccuucuagccccuguggugugcuguggucggcaccagguccuucuagccccuguggugugguguggucaguacuggguccuucuauccccuguggugugguguggucaguaccagguccuucuggccccuguggugugguguggucaguaccggguccuucuggccccuaugagugugguguggugggcaccagguccuucuggcccaugguguggugugucggcaccagguccuucuggcccguggugugguguggucaguaccagguccuucuauccccuguggugugguguggucggcaccagguccuucuggcccaugguguggugugucggcaccagguccuucuagccccuguggugugguguggucagcaccagguccuucuagccccuguggugugcuguggucggcaccagguccuucuagccccuguggugugguguggucaguacuggguccuucuauccccuguggugugguguggucaguaccagguccuucuggccccuguggugugguguggucaguaccagguccuucuggccccuguggugugguguggucaguaccggguccuucuggccccuaugagugugguguggucggcaccagguccuucuggcccaugguguggugugucggcaccagguccuucuggcccguggugugguguggucaguaccagguccuucuauccccuguggugugguguggucggcaccagguccuucuggcccaugguguggugugucggcaccagguccuucuagccccuguggugugguguggucggcaccagguccuucuagccccuguggugugguguggucggcaccagguccuucuggccccuguggugugguguggucggcaccagguccuucuggccccuguggugugguguggucggcaccagguccuucuggccccuguggugugguguggucggcaccagguccuucuggccccuguggugugguguggucggcaccagguccuucuggccccuguggugugguguggugggcaccagguccuucuggccccuguggugugguguggucggcaccagguccuucuggccccuguggugugguguggucggcaccagguccuucuggccccuguggugugguguggugggcaccagguccuucuggccccuguggugugguguggucggcaccagguccuucuggccccuguggugugguguggucaguaccggguccuucuggccccuaugaguguggugugguuggcacaguagcccccacgccuccuucccagccuuucuuucugcugguccucgccuugguuucccacucggaggccccagggaggagacggcgcguggcuggccccagucgcugccacggagcugcccccaccccagcgcuugcccaugcuuggaggacucgccgggcgccuggcaguucaggugcagccccuagugcucugugcugacugagccccucccuggagcuggcggagcccgugucccugcuccguccucacggugucugugcgcguccuuaugcucuuguuucuggaucguugucacuaaagaauggauugagcuguuuugcagacagaugcguaauucuguccgauagaaacgucccgugagcacagaccggccuggauauaauugccgugguuuggaugugguuuguccccgugaaacguugaaauuugacccccagcguggcugugugggaggugcuggggucucgaggggaccccuugugcacggaugaaugccucccacagcgcugagugagcccucgcaggaacgcacugcgccccacgacgccgaccuguggaacggacccggcugccucgguuucucuccugcguccucccuugccacaugcucucugcguacaccacugccuuccgcucuccacccggguuaaagcagccugaggccccccgcaaaggcagcugcccggucuuggacauaccccaaccagaagcaugagccaaauguccuaucagugacauuuuacauucuuuuuccuauaccaagucuccagaaugucauguguauuucacacucacagcccacggaggaccugccacagcuccagggcuucggccacgugaccagggcacagccaccgugugcagaggccucgcaucacggccacgcugggugcggaggucgcggccacaccgggugcggaggucgcggccacgccggguggggaggucgcggccacgccgggugcggaggucgcggccacgccgggugcggaggucgcggccacgccgggugcggaggucgcggccacgcuggguggggaggaccuguguuuguuuucucaggucguccucaccaccgugcaaacggcagaagcuccaggugucuggcugcagagucaaccugccagaaaaugccucuggauuuuucagcaagcaaaaguugagaacaggaagcuaaaugguugcuuuguaaucgugaaauccguuuuucugaggguugagggaaggcuguauuuguccgggcagauguuucacauuugcuggaaacugcagccucucagggggccucggggcccgugggguauucacggaugugccaagcccccugccuggaacuggcaccaggugcuguggccuuggcuggccuggcuuccaggacccccucggggcucuuccugaugucccagggggcacccugugugacaggcacccaccugucacgacgcagaagcaccaaagcuuugaugugcgaaacguagguugcucgaaguuaucccauagaacugcguuauuucacuuuaaaauguucguucugagaguuuccuuggugguagcaaagacuuuuuuuuuuaauuuuuggccaggcacggugacucacacccagagucccacaacuuugggaggccaagguggguggaucacuugagcucaggaguucaagaccagccugggcaauauggugaaaccccaucucaacaaaaaauacaaaaauuagcaaggugugcugguccacaccuguagucccaucuucucaggaggcugaggcaggaggagcgcuugagccggggagguugaggcugcagugagcugugaucacgccacugcauuccagccuggguaacagcaagacucuguauaaaaaaaaaauuuaaaagauggggucuugcuauguugcccaggcuggugugcaguggcuguugacagguguaagcacagcauacuguagccucaaacuccuggccucaggcgaggcucgaauucccaccucagccucucugcugggaccacuggcgcgugcaccaccacgcugggcuuuaaaauuuuuacuuaggccggggcaguggcucacgccuguaaucccagcacuuugggaggccgaggcagguggaucaccugaggccaggaguucaagaccagccugggcaacguagcgaaacccugucccuacuaaaaauacaaaaaucagcccugggcaauguagcgaaacccugucccuacuaaaauacaaaaaucagccaggcgugguggugcacaccuguagucccagcuacuccgauggccgaggcacaagaaucgcuugaaugcgggaggcagagguugcagugagcugagaucgcgccacugcacuccagccugggcgacagagcgagacucugucucaaaacaaaacaaaauaaauuuucuuuucuuuuuuuuuuuuuuuccugaaauggagucuugcucuguuacccagguuauagugcaaugacaaucuuggcucacugcaaccuccgccuccuggguucaagcgauucuccugccucagccuccagaguagcugggacuacaggcaccugccaccacgcccagcuaauuuuuauauuuucaguagagaugggguuucaccacauuggccaggcuggucucaaacuucugaccucaggugauccgcccaccucagccucccaaagugcugggauuacaggcaugugccaccaugccuggcuaauuuuguauuuuuaguaaagacgggguuucuccauguuggucaagcuggucucgaacucccgaccucaagugauccgcccgccucagccuccaaaagugcugggauuacagacgugagccaccgcgcccggccaacaagacaaauuuuaaggcuaugccuuugcagucaggcccaggcacccucagccuuaggcguccacagaugcgacgucugucccugcagguuagguuagguucccacuuuuuaggguuuuguguaaguggggucacacugugcacacuggugacugccucccuucccuguugccgacagacaucugugcaccgugcacacuggugacuggccucccuucccuguugcugacagacaucugugcaccgugcacacuggugacuggccucccuucccuguugcugacagacaucugugcaccgugcacacuggugacugccucccuucccuguugccgacagacaucugugcugcccugaccggcaguuuguucccuugguugcuggugagggcuccacuggacucgugguacgggcaccacagggcuuauccauucacuguugacggacauuugggggccuccagucuggggcugcugugcguggagcugccgugaacacacacggggacggugcugggacugccgugaacacacggggacgggugcuggggcugccgugaacacacauggauggugccggauggacguguguuugcauuuuucuuggguaaaugucuaggacuggaacggcuggcugcguggaagucuguguuuaacucucuaagagccugccugcucugcaaaguguuuauacuguuuuuccuucccuucagcguuauguaagauuuuuacuugguacugucaguguuuauuuuuauuuuuacuuuuuauauuuuaagagacagggucucccucugucgcccaggcuggagugagugcuguggugcgaucacagcucacugcacccuugacuuccggagcucaaaggauccucccaccucagccuccugaguagcugggccuacaggggagcaucaccaugcccagcuacuuuauuauuauuauuauuauuuguagaguugcccaggcuggucucagaguccugggcucaagcgauucucccgccucggacucccaaagugcugggauuacaggugugagucacugugccuuauuuucaguuuuuaaaauuguaacaguccuagagggugcaaugguauuucauugcaguucgaauuuuauuucucugucucuggaaucugcaaccagaugcacguagcacccccacccccgcagugugacagccccgaaugucuccaaacaaauguuccuggggacaaaucagccccaggugagggccacugugcugaugaggacuugucuuaaccagcgaccuuccucaggauggacgacaagcagaaagucuuuaggcuucaaagggauccacagugagacgaggcuguguuacacgaugguucucagccauugugucucugccugaccugcguguucacacacacagcaccuccaggaacguacagaugcuggcguaaucucagugucaguuauaggaaaacaucacuucagccacccaagaagugaaaaugucgugggcuccaugguguccccccaaaaugauauguugguguccucacccccaaucucagaaugugggcguuguuuggaaacaaggucuuugcagaugcaaaguucagaugaggccguuagguggacuucccuaccgaaaacucauuucccugaugacuagucacauagagcacguuuucacgaccugacuaauuuacgucugaggaaguguuuucagcccuucucccaucuuuaacucauugccugucuucuuauuaaugggugcugaggguacuuaguguucgccgaacguacauccucagugaaacgcacuuauugcaaauguuuugucccagccuggauuaucuuuucguuuucuuugcaggaucuuucaaagaaccaaauauuugacuuugguggcaucugguuuauccaugucuucugcugugauuugugccucuucuuaccugagaaaccuuugccuaccccauaaucacgaauguucucccuggaugagcucguugccucuuuuguguucagcucacugagguccggucugaggcuggggcuuuguguuuggagccugaggcaaggguugagggccaugguuuguaaggacaccagugguuccagcgccaucucucauuuccaccacugacgccccugaugucuucagcaaacaucaaaccccagccaggcggcucugcuucuggucucuguucuguuccguuugucugucugcccauaagcugauaccaaucaaccuugaucaccauagcuuuguaguaaaucuugaaauacagucaugaaacuucaacuuuguucaugguuuucaaaauugugcuggcucuccuagguccuuuguguuucuauauacauuuuagaaucuccguugagccaggcaugauggcucacaccuguaaucccagcacuuugggaggcugagcugggaggaucgcuugaggccgggaguuuaagaccagccugagcaguguagugagaccccaucucuacaaaagaaauguaagaaaauagccaggcacgguggugugcgccuauaguccuagcugcuugggagguucaggugggaggaucgcuugaggccagggguuugaggucagccugagcaacagagugacaaacaucucuacaaaaaaaaaaaaaaaguaaaaaucagccaggugugguggcacacgccuguggucccagcuaccugggaggcugagauaggaggauugcuugaggaggucaaggcuacagugagugaugaucacagcacuggagaagggacacgucagccacgucaugaagccccuugagccccgucccuguggagaagggacacgucggccccguggugaagucucuugaggcccugacccuguggagaagggacacggauucaucugucacuuucucgugacacuuuguggaaauaaacugcagguuguuugugacaagcuguucuuuuccgcuaacucugucaacguuaauugcuucuagguuuucaccucaaauggccccacggugaucaugcccaccugguucugcucgcgagcgugguucucccacgugggccccuuuaacgagggaggucagguaagggccgaaggcgggaaucaggucccucccccagguucggggcccugucucugugugugggcucugcacacuggccacccuccgccuugccaugccuccggggcucugcagauuuaggaaaccccugccugaggguccucccggugcccccuccuggcaccugccagcaucuuaguuguuuugcugaaagcaggggguuucugcaugaaggcugugggugcccugggcaucugcaccugaccuacacuggcuccagguuacugcauccugguuuaaaagcugugucugggaaagcgcaggacacggaagcuuuuggcagagcugucucugggacaacagagggagaaggggagcccauccuccccccgggggugcaccugcaggcgucuguguccccgucccccccaugggggugcaccugcaggcguccauguccccgucccccccgugggagugcaccugcaggcgucuguguccccaucccccccgugggagugcaccugcaggugucuguguccccguccuccccaugggggugcaccugcaggcauccguguccccguccuccccaugggggugcaccugcaggcguccauguccccguccucccugugggugugcaccugcagguguccauguccccguccucccugugggagugcacguucaggcauccauguccccguucuccugugggggugcaccugcaggcguccguguccccguccucccgugggggugcaccugcaggcguccgugucaccgucccccccgugggggugcaccugcaggcguccguguccccguccuccccguggggugcaccugcaggcguccguguccccauccccccgugggggugcaccugcaggcguccguguccccgucccccccgugggggugcaccugcaggcguccguguccccguccccccgugggggugcaccugcaggcgucuguguccccgucccccccgugggggugcaccuguaggcguccguguccccguccuccccgugggggugcaccugcaggcauccaugucuccguccuccccguggggugcaccugcaggcguccguguccccguccccccgugggggugcaccugcaggcguccguguccccaucccccgugggacgcaccuguaggcguccguuuuaaauacuagcuaugucuauuguuuuuuguguuuuaaaaacuccaauucuauguugguuagauuuucuuagucuuucuaacccuuuucacuucuuucauuauauaauuucuauuuuccuuucuucagugucccuuauuaaauuuuuaauuaaaaucauuuucucuuaaggauuuuguaauuuagucuucauuuuucauauauuuuguuccuuuuuuuuuuuuuuuuuuuugagacagggucucacucuguuccugaggcuggagugcaguggcucacucacuacaaccucugccucccagguucaagcaauccuuguaccucagccuccugaguagcugagacuacaggugcacacaaccaugcccagcuacuuuuuuccuauuuuugguagagacugguuucgacauguugcccaggcuggucucgaacuccugggcucaagcaauccacccccccgaccucagccuuccaaagugcugagauuaaaggcaugagccaccacacccaaccaauuuugucucuucuuaaaauuucuuuuuuuaguuaaaucgauccaauuuuauauaaaagcuuuauugagguauaauucacaugccauacaauucaccuauuaaaaugugcaauucaauuuuuuuuuagcaaauuuauagggcuguacaaucaccagucaccacuaccaucuaauguuaggaaguugucaucccccaaaaaacacuuccugcacccaggggcgcaccucaucuaacagccaccugccagcccuagccaagcacuaaugcacuuucuucaaugcucuagacccaccccauuaggguccaguuuugcacuuaguccuugaauuucugauucaagaugggucuccgccaccuccccgcauaucccacccuguagccugaaacacugguggaggguguggaauuuaucuugguggguuauuuacaggggucucuguuuccugguuugggguuuguugcuauuguagagggagaggcugaauuuuuauccauggaaguguugccaguuuuuaguuuucucugcuggacuucaugucccugcguuccgcggacuccaaucgcugggcccuggcucgagcucucccccuucuguccccgcguggugacugcugcuuccuccuggagguucgcgcuggggauggggcucuagagaagggcggguggcgcuggggacgagcccuggggaaggaagcgcgucccugacucggcuuccuuuugccucaggauccgagucuccacagccucuggcccggccuuccugggaguggcuuuagcucacgcuuuucuccuccaggcaguucugggugcuccaucccccaaggcugcccgaggaugguucugugagcagauuggggcugggcggcggccacacuuccuccacucggcuucuucccugaugccuuucuggguugugaccccucccccucucccugcgccccgccagggguccuccacaccacagggcaguccaggcaccuggaggcugauugggaaaagccugggggaggagugaggccauuucgggccucucaggucucagcagcagcaaucaggggaggggagaaaaaugggacagauccucugcgucccccuccucccagggcagaggcaccacccgggagcggcuguugacuaaauucucacuuuacugccagaaaauaagaaaaccccaagggucgggcucuucuggugauaggaagagagaaaccuuuuuucucuucuuaaaccuguaacauguugagaguuccagugcucuuuagagcugccuuugaagacacagaaaauuaaagaaaauaccucagugaccccugcgaggguccguguccaccagcacccgcgggagccuccacccuaaaucacccgugugaggguccgugcccaccagcacccacaggaaccuccacccuaaaucacccgugugaggguccguguccaccagcacccgcgggagccuccacccuaaaucacccgugugaggguccguguccaccagcacccgcgggacccuccacccuaaaucacccgugugagacagcaugugggcuucugugauuccuuugucuuuaucuuaugguggauaaacuuuuagcagggcugacacaugauuuugaggucuguucuuugacucagcaucuucuuacaaaucuuuccaugucaucgugguuuuuguaaaagggaucgcccuggagaggcggagguuaaacagugccuuuuuuuuggacguggaaccauagcacugccugucuguccugggagcaaacaggccagcgguugggccgugauaguuuggggacuuuacugaccugcacuugaaguuuguguaccagccaaggagagaagaggcuggacuuggugauagacuggcccugcugcuaggcucucagaaaaccugcccuuuccuggagcaaaggugucuccgggcggcugacccaggugagcugccgcagagaaccacgaggagaccagacuccacgcccugcuccucccucaguuuuguuugaauuuaagaaagcgacaggggcccggcuccacacaaggcccagagcccugggcugaggauuggggucacccaggagaggagcaagcagagggcaggggccacugggaucaugggccggggaaagcagggcccagguucucacaggacagaaaagucuggugggaaugccugcagaauguucuggagcagagucccacugacauggagggaguguucggggauaagccccgugggcugagguucaaguuucugagcuuggacaagugagcagggcuggcacaggcccggggcugccuccccacugcugggcuccccugcccgcagccccacacgcccacccagcaccacuguccucugcccacagucggcacuuugagucccuugagcuucuggggcugcagccacuggcaggaaaggauggggacggaggccggaccagccauccaggagccguggcugugagacccugacccaccccagccccuuuccucggcugccugucuuccucuuugcccugagaccuuuacugcucaaaauggaauuuggggcagaaccaagacccagcccacccucccuuccccucuuucccgccuguggagaagcucgguugcucacgucuguuguggucgccgccccacgucccuguugagccucuagaccgguuucuuugcaacaaaagccuuuuccaccgguuccugguuggccggcugagcgcagguguagugugcauccggggcaggcacgcguuucuggggccccagugaugccucugcuucucccgcccugcagggcgucccggaggaccugcuguucuucuacgagcaccucaggaagggcggcggcgucauccgcguggaccagagucuccugcuguaucgccaccacccacaggcggccacgcacugcguccucgagugagucagccccgcccggccccgggacgccugagaggccaggaacacgggaggcgcccgaggucggggccgggguugguggggccgaccccagaggcuguggucaggcucugccuugagacccagggucuggugggacacggggcaacagcacaucccgaggguggcggggauucggcguccacgaaggggcauuucccaagggcgccagggagcgccagggugaaggccgaacguccuucccuaguucccagagguaaaaugaccacgcgccggguccuucugaaacccugugcucccuuuaacccgacgggagucucaugagugggguccggcggggaccacaggccuggggggcgcagcugccguggaggguggcagaggcacggccagggaaucgcagcacccagugaggacgcgcccagugcugcgggguccgccucccucucccgugucacugugaggagcggccacgugggcccgggucugggggugccgcguggcugcguuggagccguggcaggggugaggcaaaucggggugaaacugcauguagaauuccuuccuuagauccgggcagacaguucccuccuuagaacugugaggacacagaggucucggccaccugccugccgcgugccgcagcguuaaguuggaaagcaggccgccguccgaggcuugcgucucggccccuacggguacucagggcccccggagucucaagaccccaacuagggucaugugugggugugggagccgcgauggucccaggccugccgugaugggguugagacucucggcaagaucccagcuccccagggggucuaagguccaaggucacgggguggggcugggggguuggcaggagggccacgagcuuccccauugggggcaucauccucacuccugcaugcuggggccucccgcguccgcgcuccucucccuuaugcccaccggcaccuuggccgccuccucaugcggugacgugucccugacacuucagcuccuuugcaacauuuccagaaaugcugucuugugcuuuugggaaaaacuggguuuccaccuuucccggugcuaaggcggggccacggcuuccucugaggauguaaaaagagaggcauagggcgcccuggggagccuguucucccugauuaaaugagaacuuuuuaaaaugugaaaaaugaagaugaaccaaauacagacaucauggcugcuucuacauuuuaccuuccuacgaugggccaacauuuucagaccagagaccccuaggaaagcccaggagacaaggggccgucgaggaggccggugucagaggccccccaaaccucgcgugccacccacggccacagaggccccccgcuuucuucuggagcccugacugcuuuccugucacgugaacccccuggggucccuaagcugaugucaguggaugaggaggaucaggcucguccccccgccccgagacacccaacacacccgggcugcuaaggacaagaugccaaaacccggcgaggcugcgucaccugguggggaaguccccgcagccgucugcaggagcuguccucacccagguucucacacacacacacacacugcacgugcacacagaccacauguacagcaugcacacacauacgugcacgaaaguauacacacguacucacugcacacgcucacugcacacacgcacucacgugcacacacacugcauguacacacaucugcacgguacaugcaggcaugugcacucacugcauacauguacucauacugcaugcacaggcccucacugcacacacguguacacaugcguguacacacauccacacaguacauacaggcauguacuccgaacaccugcacacacuguacacgugcucauguacacaugcacucaccacacaugcacacugugcacacacaacauacacccccacacaguguacacacacaccauacacccccacacauacacaccauacacccccaguguacacacacacacaccauacacccccacaguauacacacacaccauacacccccacacaguauacacacacacacaccauacacccccacaguguacacacacacacauacacccccacacaguauacacacacacacaccauacacccccacacaguauacacacacacaccauacacccccaguguacacacacacacacaccauacacccccaguguacacacacacacaccauacacccccacacaguauacacacacacacacaugcuucaguguccccaagucacugacugggauaagcaucucccugugucccaggugggguccggacuauugagguggcugcagaggguuggggaggaaaagguagacuccaggcaggaccucccugacagugccuaagcccugcagcucccugagcugacagaggggaccccguguccccccaucccccccaucccauugccuguggggguucugcuacaaacagggggugccacaggguugggggggagucacaaguuuaucccgggaggcggaggcagcagcagaaucguagaacagcgaaauccugccccgaucccgaggcugaacccacgagggcccugcucaggggaggcccgucaccagccaguguugguugugucuggcccagaccccaccccggaggagacucccacggacacagcucccuugacacagcagagggcaucccaggacucggccagggcagggucugugggguaccgggcuucagcguggcuacaucgcggccauuggggaggacagcaucugggacacaucccacgccguucuggccccguuggccucugcauccccugccccucuagcuucuggcccguccagcuccuggggcuuugagacgggcucagcccgggcagcuccaggagcaggguugagggagaggcacacacaggcagacagcgauggggcacguggggaggggcugcggugggaggagagagggcggggcugggaagggcccgggcagcgauggggcugggcgcugggcagagcagcaggucaugggaaggagccugcuccccccgggacagcagccuggggucgacuugucacagcagagggagaacagagaccagguucccaggggaguggaaggguucggggcagcgacccugaggcagaaggucguguccaagugugaacgcugggauuuuaugggaugguugcauguguccuuauggacaaagguuucucugggaaacuggacuugggucaaguccaguccucugcguccuacagaaauucugccuuccagaaccuucuagauucuuaagugacagcuucucaucuguccccaccuguuggggucuaauggaagggguggauccccaccuaggcauguggcuacguccagcuggggcagguggccugacuguaggacagccagucucucuuaggcauugggccagguguccacuccacuggcaacgugagcugagcacacaucaugucccuguaugucagcaucugugugcaucuguggggccuccggccugccuaucacccucuucuccaccgcaggacgaccaucuggacccaccgcguccgcuuccuggaagagcaggcccugccccgcugggcggccuucaccaucuggaacgcuggcaagcaggggcgccggcuguaccgcagcuugacugccggcagccagcgcaaggugagcauccugccacccuccaacacugccugcccugcccccguacugucccacagcacaggcccuggccccggccuguccagagcugcccuucugugcuuguccccaggugguggcauucugugacguggacgagaacaagaucaggaaaggcuucuauugccacgaggacucucaggugugcagggccgcauggugucacccuuggggucaaccaccugcuccggggcugagggacagcugcuccgagccuucccccuuggcagaguccaccugggccgugcuggcuccucggggccuccagggagcccagcccccauucuuggggggagaaccccgcugucccucgugggucuaggccuugggguagcccacccuggucaguucugcagucgggugucaggcggggguggcgggagccggguuccugcucugaacaccugccgcagucugugacccuggcacguuaucugcugcccaagcccuggcuccugugugagccaacuugguggcugcgugcacccugagggcgucucuccggggacaagcuccaggcucgggcaggacugauggccacugucacucucaggaaagacccaagccccgaauccccauccugcacuuccgagccgcccggccacccuucgucaucugcgugaagcuggugaguguggggcccuuggccguggaagggcuuggggaucccgggcucugccaccuggacaacccgcccugcugugcaaugacuguguggccugggaugagaccccagccgauggugggcauggggacaggugccacagccguccacaacagcaccacagaccaggcuguggggugguggccgcugcccugggggcaggaggcagcuggagaggguggccugcaugggugugggggggauggauuccggucucucuucugucuuaaaauacccauaaagccaacauuuguuagaaacuugcaaagcacgaggcccugcggugccaugucugaggggccaaggccaggaccuccagcucccguggacugagguggcugcaucggggauguccucagccccugagugugaacgacccuugccuggggugggcaggugaugggugccucgggcuccaaaugcagccuuuuuccccaagcguggggaguccaggcuggcugcggggggcugaggugaguaguuuuuuuuuuuaauuuuacuuuaaguucugggauacaugugcugaacaugaagauuuguuacauagguuuacaugugccauggugguuugcugcaccuaucaacccgccauguagguuuuaagccccgcaugcauuagguguuuguccuaaugcccucccuccccuugccccccacccuccaacaggucccagugugugauguuucccucccuguguccauguguucucacuguucaacucccacuuaugagugagaacaugcgguguuugguuuucuguuccuguguuaguuugcugaggaugaugguuuccagcuucauccaugucccugcaaaggacaugaacucauuccuuuucauggcugcguaguauuccaugggcuauaugugccauguuuucuuuaucccguguaucauugaugggcauuuggguugauuccaugucuuugcuauugugaauggugcugcaguaaacauaugcgugcauguaucuuuauaauagaaugauuuguauuccuuuuggguauauaccaauaaugguauugcugggucaaauggcauuucuggcucuagauccuugaggaaucaccacacugucuuccacaaugguugaacuaauuuacauucccaccaacaguguaaaagcaucccuacuucuccacagccuugccaguaucuguuguuucuugauuuuuuagaaaucgccauucugacuggugugagaugguaucucaucaugguuuugauuugcauuucucuaacgaccagugauaucucauugugguuuugauuugcauuucucuaaugaccagugaugagcuuuuuuucauguuucuuggccacaugucuucuuuugagaagugucuguucauguccuucgcccacuuuuugaugagguuuuuucuuguaaauuuaagucccuuguagauccuguauauuagaccuuugucagauggacagauugcagaaauuuucucccauuccagaggcugccuguucacucugaugauaguuucuuuugcugagcagaagcuccuuaguuuaauuagaucccauuugucaauuuuggcuucuguugcaauugcuuuugguguuuuagucaugaaguccuugcccaugccuauguccugaaugguauugccuagguuuucauguaggguauuuaugguuuuagguuuaagucuuuaauccaucuugaguuaauuuuucauaagcuguaaggaaggggucuaguuucuguuuucugcauguggcuagccaguuuucccagcaccauuuacuaaauagggaauccuuuccccauugcuuguuuuuguuagguuugucgaagaucagaugguuguagaugugugguguuauuucugaggccucuguucuguugcauugaucuauguaucuguuuugguaccaguaccaugcuguuuugguuacuguagacuuggagaauaguuugaagucagguagcgugaugccuccagcuuuguucuuuuugccuaggauugucuuggcuauacagacucucuuuugguuucauaugaaauuuaaaguaguuuuuucugguucugugaauaaagucaauggcagcuugaugggaaugggauugaaucuauaaauuauuuuauggccauuuucaugauauugauucuuccuauccacgggcauggaauuuuuuuuuuccauuuguuuguguccuacuucccugagcagugguuuauaguuuuucuugaagagguccuucacauccccuauaaguuguauuccuagguauuuuauuuucuuuguagcaauugugagaguucacucaugguuucagucucugcuugucuauuauugguguauaggaaugcucgugauuuuugcacaucgauuuuguauccugagacuuugcugaaguugcuuaucagcuuaaggaguuuuugggcugagacaaugggguuuucuaaauauacaaucaugucaucugcaaacagagacaauuugacuuccucucuucauaucugaauacucuuuauuucuuucucuugccugauugcccuggccagaacuuccaauacuauguugaauaggaguggugagaggccauccuugucuugugccaguuuucaaagggaaugcuucuagcuuuugcccauucaguaugauacuggcuauggguuugucauaaauagcuauuauuuugagauacguuccaucaauaccuaguguauugggaguuuuuagcacuaaggguguugaauuuuauugaaggccuuuucugcaucuguugagauaaucauguggucuucgucuuugguucuguuuaugugauggauuauguuuauugauuugcguauauugaaccagccuugcaucccagggaugaagcugacuugaucaugguggauaagcuuuuugaugugcugcuggauucaguuugccaguauuuuauugaugauuuucacaucaguguucaucagggguauuggccugaaauuuuuuuuguugugucucugccagguuuuggaaucaggaugaugcuggccucaugaguuaguagucccuuuuuuucuauuguuuggaaguuucagaaugaaugguaccagcuccucuuuguaccucugguagaauucggcugugaauccaucugguccugagcuuuucuugguugguaggguauuaauuacugccucaauuucagaacuuguuauuggucuuuucagggauucgacuucuuccugguuuagucuugggaggguguauguguccaggaauuuauccauuucgucuagauuuucuaguuuauuugcauagagguguuuauaguauucucugaugguagcuuguaucucugugggaucaguggugacagccccuuuaucuuuuuuuauugugucuacuugauucuucuuuucuuugccuggcuaguggucuauuuuguuaaucuuuucaaaaaaccagucauugauuuuuuugaagggauuuuugugucucuaucuccuucaguucugcucugaucuugcuugucuuuugcuagcuuuugaauuuguuugcucuugcuucucuaguucuuuuaauugugaugucagggugucgauuuuagaucuuuccugcuuucugaugugggcauuuagcacuauaaauuucccucuuaacacugcuuuagcugugucccagggauucugguacguugucucucuguucucauugguuucaaagaacuucguuauuucugccuuaauuuuguuauuuacccaguagucauucaggagcagguuguucaguuuccauguaguucugcgauuuuggguuucuuaauccugaguucuaauucgauugcacuguguucugaaagacuguuaggauuucuguucuuuugcauuugcugaggaguguuucacuuccaauuaugugguuaauuuuagaguaagugcuguguggugcugagaagaauguauauucuguugauuuaggguggagaguucuguagaugucuauuagguccgcuugguccagagcugcguucaaguccugaauauccuuguuaauuuucugucucaaauauugacagugggguguuaaagucucccauuauuauugugugguugccuaagucucucuguaggucucuaagaacuuguuuuaugaaucugggugcuccuguauuagguguguguauauuuaggauaguuagcucuucuuguugcauugaucccuuuaccauuagguaaugcccuuuuuugucuuuuuuaaucuucauugguuuaaagucuguuuuaucagagacuaggauugcaaccccugcuuuuuuugcuuugcauuuucuugguaaauaaccacgggugagugguugauagagugagccaggccccaagcgguacuguugggggguugugggggacacacagacaugggcaccugugacagcuagaagcacgccacaccagggcgggucacgguuccugccccgcagaagccgugaggccagcguguguuggucuacacugcccggccugugaugagcugucacacaacuaauccaagucaaguccaggcagaacaacgugagcagagccucuugggcacagcuuucuggcaacuacuggcgcaccucauuuuauugcacuucauugugcauuuuauaaauuacaggcguguggcagccccacgagagcaaccccaucagugccccucuuccagcagcacgcccacuccacgucuccacgucuccccaucuccacguguuaauucucgcaauaugucaaacuguuacuguauguguuacggugaccuguggugucacuacuaucucggggcgcccauaugaaucagugaacuugauugauaaaaugcgaauguucugacagcagcugucgccuccccgcucccccccaccccaccccuccucaggccucccuauucccugaggcacaacauugaaauuagguuaacuaauaaccccacaguggacucuaaguguucaagugaaaggaagagucgcacgucucucgcuuuaaaucaaaagcuagaaauguuuaagcuuagugaggaaggcaugucgaaagccacgacuggcaggagaggcccagcuuucagccuaacgguuagccaaguugugaaugcaaaggaaaaguuauugaaggaaauuaaaagugguccuccagugaacacacaaaugauagugcggauagggagaaaguguuaguggucugacagaucaaaccagccacaacauucccuuaagccaaagccuaauacagagcgaggucccaacucucuucaauucugugaaggcugaaugaugugaggaagcugugaacauaaguuugaagcuagcagagguuggcccacaaggcuuaaggaaagaagccgucuccguaauaugagugugaggugaggcagcaggcucuccagaagaucaugcuacggucacaauggagguggccgcacucaaccacagaucuucaguguagaggaagcaaccuugaacuggaagaagacaccaugcaggccuuucauagguagggagaagucaaugccuggcuucagagcuucaaaagacagucugacucuuugccgugacuuuaaaacccaucuaugccuaguguuccauuauuggaacgcuaagcaugugcaaguuuauauucugcuuaaggucacugccaagaucugauugcaaaaauucgaaaaauugcaaccucagccauaaauggguuaaguugaaggcaguggucgccauucugagaauccuaggauucuuaggaaugaggcuaaaucugcucugccuguggcucuagaaauggaacggcaaggcccagguggcagcacaucugugcacagcacgguugauggaauaguguaagcccaccguuaggcccagugcucagaaaaggagauuccuuucaaaauacgacugcucauugacggugcaccuggucacccaggagcucugaggcugauguacgagggguucguguuuuugugcugacacagcauccguucugcagaccguggguccaggagucauuccaacuuuccagucuuauuggagaaagacguuuucuaaggccguagccgccaaagauagugauugcucugauggaucugagcaaaguaaugaaaaccuuugaauaaccguuguccaaguuaccggggacauuuaggugaguaaacgggaggcuccgagaagcaguuauaaaaugcaaauucuacacgaaucugguuuaguuuuucagaaacagccucuucaggaucuacuucucagggacccccucuccaaccccgucagugccgcucuuccagcagcaugcccacuccacgucuccuugugguaauucucgcaauaugucaaacuguuaucguauguguuauggugaccuguggugucacuacuaucuuggggcacucauaugaaccccaaggcacuuggugaaaacccuucccagggagccggcugagcaugggaaaagagguuccuccuuguccugcacacgcuguguccuuggagggcccagagcccccacggucaccugucucuugcuuguucuuccaggggcagcuggcaguguggccucacagcacaugcuuguuccaucucuugcucuuuucacguguguagauuggagguuauuccgugugaagccgcuggagcccccgggcucuacuguugcugugacuuuucuauucagggaaauuuccagcuuauuugagccauauuagcaaagugacaggaaaccagcccuauguacccaucccuggagcaagcguguccaucuuauguguccuccacaccuccaaauccccacgcugguguuguggcacucauucuagccuaauuucauccauuauuauuucccuaucucaaggagauaaaaacuguuaaaaggaccauaaaaccaccaucccaccacagaauuccaaauaucccaucgauguucaaaucuuccuaauugccuuauaaauugcuucauguuuuaaguuugcuugcuggaacccggcagcguccgugugaccuuuacgacaugaccuuucugucucccugacgccgacgcucuuuucuuaguucagcugaagaaugggcuuguguauccugcacucugccgaccgguucccugugguuuugcguguucugcuccauccuuuugagagguggucagaccgaggccgcaucaggcuccccugcaauuccguuuggcgggagcagcuugcgggucucagggcaccucgguggcacuguuguugugccuuccuccaccguuagcuggaagaguaaagagaaacccaagguucacguuugucacuaaaacacccgcucuucgauuauauggauguuucaugcauuugugauacaguuacuuacugauguaccuuuuggccauuuuuaaucaucugcuguuuaaaaugcugcugcaguauuuguauauauacauaauuucgcucaaguggcucuguguggaauaaauucuaaaaauuucugggucaaagagcacacacauucaaucccagucuggcuguucaccacccgcagcugcugugccaacccaacccaccagcgauggagcaccugccucgugcccuuaaagggagggaaagcaucuucucacauauuuauaaacugcuuuauuuccccuucaguaaauuauuauuuucauuagcccauuuuucuauuggucaguauuuuucauaaggaaaacucuccgacaugcugcaaauuuuccugccauuugauauuuuuguauuuuugccauugugauauaaucaaauuaagugacuuucauuuauggagucugauucauucuaagacaaucacuccugguugugaaauuuaaaaaacaacauugucccauuuugcuucugggauuucuaguuuuuaauuacaucuuugauacaacuggaauuucuuuugauuacagaugccaauuuuucuauuuggauaauugucccaacaucguuuacaucacugcuuuuccaggaacgaaaugccgucuauguugguugugaacgugcauuuggcaccuggcagggccaacccucauggcgugugcgugaacacaucccuaaaccauagucuaauuuauccuauuuuuguaguucaugugagcagaauccagugucuguguucucgcaucugguuuucacuccacguguuuggggugugugcguaucgcugugcaugguguggacuuucuccacgucccgugugcaaacgccaccccacccagaggccacgccaggacccaggccugugggcagugguucccgguuugcccuugcaaggacgcuguguccuccugcgugagcaucccugccucgggucuaauccugggaguggaaggcaggucguggguguggcugcauccucagcuucucuggaugaugcccaggaacaugcccagagccagagggcccagcugcucggcucccucacacugggcugggcacuuggucgccagccguuuggggaguguguucucauggugguuucaggugugagucugaccaacaaccccccgugcccgcuggacacuggaguuccuuccucucuggcgguguuucucaucaggguuccccaccggccuacugcacgcugcgucucuccugaccuguaggaguccccuacaccucuggcugcucgacuuuguugguuuaauguuuugcaaaugucuuccuccauuuugugguuugccuuuucauucuccuaauggaacauguugcuuuacagaagcaucuaguuuuaacagagucuuguuuaagacggugucaacacgcacugggcuggccuggucccugaacucagguguguuuccuuugcaaacucuagagcagagagacaagggaggaaggacagauagcggcagaguguguggaaauguuuuccaggaaggauggcuuugagugacagcaucauuugagugacagcagugguaggugguguaauggauucugaugugguggggguaaggggcgcagccaagcuccgauuccuccugcugggcccaaggaccaaggacugugacaggaaugcauagucccuccucuguccugccagaggccagagacuuguguccaccacucugccgggcugucuucaggaacuuguucaggaggugcuggggugcagggcacgucugaaaggcauuucuggacaccugcuguggccucauacaggagaguaggugaccuggccaaggccagcacacaggacaagauuaagcauccagggacccggggucacagcccucacuccauugcagggguggggaugacagaggccagaggagaucagacaggggcagcuguugaugguucugagaugcaguuucugucugaggggccuccucccacuccuggccugugcagagggguggguguguggagggaaggugggucugcccuggucaaacagcagaggcauugccuguuagucucauuccauuccgagugcccccagggagagucagccaccuuauguagagaggcaaggccagaaggcagggggggccuccccucuggugaccaacagggccugugguacaagcagugccggcugcugcccucucuggccuuugucuccuuccagccucuccgcuauuagcagaggagcagaacacuugacagguggacacaggccacccccaaccccuggcccuggaggaggcuccacaguggccuccuagagccaggagaccggacugagcugaaucugcugcuccugacaggaccucacagggggcgccuuugaggacaaccugaggucacugcacuugcaggagggccaggacuuccuucacuucagcugacggacccauggcagcugcucccaggugggucuuuucaccgaagaaccaucuggguuuguuucuuuauuauguuucauuuccuuuucauucugcucuuauucuaauuuucuuuacaguuaguccucugcuuauguucagcucauuaauuuccagccuuucuucuguaauguauaauucacgacuucagaaucgcuuaagcaccacuuuaggugaacucuaucuguuuugauuaacuuuuaucuuucauuauauauuuuauaauuuucauuauuucuuuuaaagagauguuuuuaaaaacauuuuuaaaauuucuguguacacacacacacacacuuggguucuguaacuguccauugggucaaguuuuucuccuucaaccgugccuuaugacacuuuauugaaauguaccaauucaauaaaauacacuaugguaguaggugaucaauuucuucuugaauguuugcuuuaguaucuucuaagacuguguuacaaauguaggaaaguucuaucaaucaucuuccuguugaacugagccuuuaaucaucauauaguaaucuauuccuaauaacacuauuugccuuccuuuaacuggagaacuuugucauuaacagagguuuuaauccauucacauuuauugugucccaaaauauuuauuucuaauuguguguguguuuugcagcuuguucugccuuuuccucuugccauucuugcauauuuugauaguguauuuuuuauucuuguuccauuucucuccuacuaguauagaaguuaucuuccccauacauuaacuguuugugugugacuaaauacuucaacaugcaccuagccaagcugauaacugaauuaucugcacucuguuccaggagaacauagacuuaagaugcucuaaauucagccaccaacucugccacugauuuauaugcugcuguuguccauuuuaagcaauucuacgugcuuuaaaaaaaaauccacauauaagccaucuuucuauguuuuuauggucacaguuuauugcuucccuugcuccacauuccuccaacuauccaacugcgaucauuucccuccugccuaaaguuuauccacuaaagcagugguucucaaccaggggcacccccagaagauauuuggcagugucuggagacauuuuuuuuucuuuuugucacagcuggguagggggaugcugcuuccaucugggauguugcugaacacccugcaauaaacaggacagcucucaaaacaaaugacucaaccccaaauauuaagccaagauuaaaaaaccaaacagauaagaauggcauauuuuuaucuaaaugacuuaauuuuguucucuucuuuaauguuaugcugugggcacaauucaagcaacuugacagcuauuuucucucagcauaaugaagaccuuggucuacucacugcucaacuccagugcugcugcugggaaauugguagucguuuauaucacucuguccuucuuacaguucugcaguuucacuguggcaggucuaaaugugagacuguuaggcuucuguaucuggggacuguugcaugucaguauggaauaucugcaucauuucauuucauucugagaccccaauuacccaaagguuagacauucuucaaugucucuugauguugcugucauaucuuccaguucucuggauaauguuuucagaucuuccaguuuucuaauucucucuucagcugugucuaagcuauccauugagcuuuucauuucacuucuuacauuucuaggggcucuguuuuuuucuaaucucuucuugaucauuucuagcccuuuucaaaaauguacucauauuauagccuacauucuaccagagagguuuuguauuugcaucuucugcccuugucugggaauaccacuggucagggccaagucaaucaaauuuuccacuuuaggaguuuuggggaucauacagguaguauuaauucaggccacuucaggggagauagauugagauaagagucuugcugcuguuccuuugaaaaagacuuauuuagggucccagcuuuauauagugguccauuagaucuggcccugggccuuaaauucucucauccauucugcuaucaaaauagcgugacuagauuccagggcucagcagaaacccucaggaucuccaaggucucugcucucacauggaggguuucugguuagcaccuagaacguguuuguggguacacaaaucccacaucagcuccccggucccagggauacuggcuucuugcugcucucuaaacucacaaagcuugcuccacuucugggaccacaagcauucucuuuucugccauuggacacagucuggaccucugcccaaaugcugccccuucagagagguuuucugaacaccuucucggagucaacacccaacaugccauuccauugcccacuuuaucuuuguucauagcacucaguguugccugccuugauggugcuugcuuguucauuugcuauugucugccccagcuaucaugugagcaagggguuccuugccaaacucuaucaccuggacccuggugggcuccagaaacggcugcugaaagagggcuuuccaggccaccaggugucuggugagcacaagugccccagugauggaugggauccagugggaaagaggcaguggccaguggagugauccacuuuccucggguugcuaaguuagaccgacauuaaaagaagaacugcuuugccacauagugucacugaugggucuggguggguaaucgaccugccuccaugucuuaaaaugccauuuaucuggaaucuucuuuuaauugcacuaagaacaguucaucauguuuuucucagaagccacuuguuccuuccauccucagugcaucccaggccagcaggagcuuugugagcugcaggcauggcgauggugcgccuguuccacacccagcaggcgcaaccagagucucgugugugccgaccacaggagccaagccuuuuccacuguguggacucauguggccaaggcuaggccuggucacccaggacccucaccacgugaccccagccaaucgggacaguucaaggaggaggagaccccuauuacacagguuggaauaaaauauuuaaaucucguaaaaa

SEQ ID NO: 192338 - RNA, 55989 nt, Homo sapiens
agucgggaggcuuagcuggggccgcagcgcggcggcaacaucacucucgcugccgcugcuccgccccauccccuucuguuuuucucucucauucuccaguggcggcggcggggaaggcggaggcagaggcagcagcagccgcgcuggcugcaaugaaugaucccccagcuuggggggaggacuccaggugagccucugcccucgggaggcccgggacccccggccgcccacgaccggcagcccacgcuauggaucccuagaggaaggaggagaagacagcucgccgcccacccccaucccauuuuccucuuccuuuaucucauuguugccgaagcuguuuacggcagcgcucccucugcuccugcauggggcgggcuccgggcacggcugcucggcaggcgcugcucccgcggcgacugggggauucugccuaauucaccucccagccggugcagagaggaccggagagcgguggaggcccggacugcagcagcguuggggccaccucccagcguccccacccuaggaggcugcaugcggauugaagagcugcgccugggggcugggccggccccgcugaucccgaccuagcgagcaggauagcaggaccgcccaggcugcggaggggcucgggggcaggaaggucagagcagcaagauggccaguaagaccaaggccagcgaggcccucaaggugguggcccggugccgcccccucagcaggaaggaggaggcugcuggucacgagcagauccugaccauggacgugaaacugggccaggugacccugcggaacccccgcgccgccccgggggagcugcccaagaccuucaccuuugacgccguguaugaugccagcuccaagcaggccgaccuguaugacgaaaccgugaggccccugauagacuccgugcuccaggguuucaauggcacgguguuugccuauggccagacgggcacuggcaagaccuauaccaugcaggggaccuggguggagcccgagcugcgcggggucaucccgaaugccuuugagcacaucuucacccacaucucccgcucccagaaccaacaguaccugguccgggccuccuauuuggagaucuaccaggaagagauucgagaccugcucuccaaggagccgggcaagaggcuagagcugaaagagaaccccgagacuggcgucuacaucaaggaccucuccuccuucgucaccaagaaugucaaggagauugagcaugugaugaaccuggggaaccagacccgggcugugggcagcacccacaugaaugaggucagcucccgcucccaugccaucuucaucaucacuguggagugcagcgaacguggcucugauggccaggaccacauccgagugggcaagcucaaccucguggaccuggcuggcagcgagaggcagaacaaggcaggccccaacacagcgggaggggcagccacaccauccucggguggcggugguggcgguggaggcaguggugguggugcugguggagagaggccuaaggaagccuccaaaaucaaccucucauuaucugcccugggcaacgugauugcugcccuggcgggcaacaggagcacccacauucccuaccgggacuccaagcugacccggcugcuccaggacucccugggggggaaugccaagaccaucaugguagccacacuggggccagcuucucacagcuacgaugagagccucuccaccuugcgcuuugccaaccgagccaagaacaucaagaacaagccccaggugaacgaggaccccaaggacacacugcugcgggaauuccaagaggagauugcccgccugaaggcccagcuggagaagagggggaugcuggggaagcggccccggaggaagagcagccgcaggaagaaggccguguccgccccgccuggguacccugagggcccagugauugaggccuggguggcagaagaggaggaugacaacaacaacaaccaccgcccgccccagcccauccuggagucagccuuggagaagaacauggagaauuaccugcaggaacagaaggagcggcuggaggaggagaaggcagccauccaggaugaccgcagccuggugagcgaggagaagcagaagcugcuggaggagaaggagaagaugcuggaggaccugcggcgggaacagcaggccacagagcugcuugcggccaaguacaagguaagggccccagaggagcugggcacucgagauguccccgcaggggaucccggcaaggaggcucuucuuugagagucugugaccuggccugaaguggagguucucccucagcaccgcacacugcccuccugccaaaugugcccccagagcagccaggcaaauugcugugauaccgggcugccagguacaugcacaggcacacacacacgaagcaacguggacaggcggucucucaagccagugagcuugggguggucugaccugcugugggcauuuccugcugguggccucaggaucagucaggucugugggauggccaggcagccucuugugaauguggguucuuguuccuucacagccuccuccccugaggcuuccucccucugcagcaucuucaaaccucacgucguuuuaauaauaucauuugguuagugcuucaguucaaaaaaugccccauauauaugauccauacaugaucucauuggauccuuuggccauccagggucacaguucugaaauccccauuucagaggugaggaauuaaagcuuggagaagugacgugaccaagguuccauccuaugaaguggcagagcugagcuggaacccauggaccucaugcuguuucaguucuuagcugggcaaagugggaccaugaacagauucugcucccugggaaaaugguccccugggccuuacagugcaggagccauugcuugcuaucauuaggaaagagauuuggggguuaugcaggagguaggguggaaaaagcaccaaacucuauaccagagaccaagagacuggccuagccauucuacagcucauugaguggccuuguguaaguugcuucucucuuuucucaggccucaguuuaccuuucuguaaaauagaggguuggccugggugaucucugaggcucuaccuaucugauaauucuauggccuauauuaaucugagcagcaagccaaccgaccccugccccgaggccucaucacaguuaauauccaauuccccauaacccugagagaugucaggaccucagcauccuuccugagcuguuuccucacccccgggaccuuccaggcucuaauggggcuaacuacagaggccccucccuguccagucauagaccuauuaaguugcauugcugaggaugccacaacucaauguuccaggcauuuccaggccccuggagccuucaacacuagggguggaaggaaggacacaggaagccaugagcuugcugggaagagcaaaauauugccauuucuuauuccuucucaggaaugugggcuggggagcaggggggcccagccuacagccacugggagagugacagaugagcuguaugccauugucuguuuugggaaugugcugcugcagcaggggcucuggccuuacauauuuaauauuuaauucacuucuuugagcccaggaagaguuaugcugagcuguuuccucaaggaaaggaucaggggccuggaaccuuuagggacauccugagagaagcaagauauuagaggcagggccguuagauugaagcccucccuaggagggagggaauccaguguuugcuuaccuggucaaucugccauugauuuugcuaagaagaccccccaccucccugaaagcuggaaggcaacaaaggcuaagaagggaggaaaaugcaauaacacacuucggcugccugagggauggggugaagguuuccguuguugggaacugaccaguuucccucagugagauccuuggaucuaaggcaguauggggcacagaugauagaacggccaagagaucagggcggccagcaccagaauucuugcaccagaggcauagcccacaaaauaucacagucuuagaguuggcaggagcuuuggaaaacugagaccuggacuugcccagggccacacaggugaguugaggagagccuagccccuuuauauauggaagagcccagccucuuuccacugcuugaguccuaauguuaccugugcuacuugauaaucagaguaauucauuuuuauauaaggcguugacaucuuaaucucauucgauccucccaacaaccccaagggguggguacuauuauuuccauucaacaguuaugaaaacuaaggcuggggagguggagugagugucuuaucagcucgugacccugggugauaggcagcagagccaggacuggaacccaggucuucugaugcccccagcccugugcucuuuccaaggcaucucagauuccuccauguuugcucacugugugacucagggcaaccgccuuucccucuccagcccucaggcuuccauucaccuaaugaggaggagaagccugaccuugcucccuggggagugggugaaacagucacuauguaccagguguucagauggaagcaaagggggaggagugccugggaaauuccacaacaggaaugauuccauacccugugacuucucaucacacucagccuaggacaaucagcagccagcaacccaaaauggaaccuagacagaggacccaaguuccccauagccccaaggcaccgccugguucagugucggauguuucuaggcugguggaaacaauuugagggcucuugaggaaucuacaggguaaagaggggaggagcauguuagagauaccaaccccaguccugccuauuucccaggguugaggauuaaaugagaucauuagcacgagggcauuuaaaauaaguugaaagcaccaaauacauggaaggcauuagcagcuaugggguggcuucuguccaccaagcugggguccagugaucuccaggacagacaucuuuguuguuagcuugacuucuucuuuacccugccaucccagcugccuugccauaacccugcagcuugcugggaguagagccaggcaggagaggucuaggagauuucagaaggcaggcuccccaucugcagcucacuccuguccccccuuucugaguuauggcaucaacuccgcuucuucccugaccagcucccauucccuucuuccaguucaugccacccucugggggcagcuaagugguaguugaugcgacccagugcccucauucacucucucugacucaucucauagucugucucgccagcucucccugccugccaccucccaggcucccuguucucuuuguucuccccucacugugcacaaacaccaugccugucuccuuggaaucucauuucaucccuccuuucauguuuacugugggccucaggggauguucgggugugcaaaugugugagaguuugugauugugaucaguguccuguuuaucaguaaucauuagcaauuuauacuuauguagugucugggggagggagggugugggcgggaaaugcuggugggagcuugauaacauacuaggccugugagguaggaggaauagguaacaucacagacccacaaugcacagugaaaacuucaaauauuugguacugcgcagugaaaacccaaauauuugugcgcaguauacauacugcagugaggacaggugaacacacguagauugguugggagaaggccuacuuuauucaaauguaaucaugcaagacaauuuuuaaaugacugcuuuaauuuugaaauuaacuuuuuuuuugagauggaguuucguucuuguugcugaggcuggagugcaauggcacgaucucagcucauugcaacccugccucccggguucaagggauucuccugccucauccucccuaguagcugggauuacaggugcccaccaccaugcccagcuaauuuuuuguauuuuuaguagagacgggguuucaugagguuggcaaggcuggucucgaucuccugaccuugugauuugcccaccucagccuuccaaagugcugggauuacaggcaugagccacugcaucuggcuuaguuaauuuuuucaaggaguuggacuagaugauuccuaaaacuuugauuuuagcuacuuaaaggaaaaaaagaguguuuguguacagaugauacagaaugcaggcacgaauugaagacagaaacaacagcaucggaugugauccccaauaagaaggucuggagggagaagagcugggguucuuggcuggagcccacucucucuguggugaauguagaaaagagaaccugcagaagcagccccggaagccagagggaugcggucauaaggaggaaugcgaacuguguugaaauuguauugucccuuuuguggguccugcuuucucccaccccucagcagggggauuaaccauaaaugcaagagagaauguuucaagccugagcgacaacaguaacaguaauaauaaugacauuuacugagcacuugcuuugugccaagugcuauccuauauacagauuaucucguuuauuccacaugagcacccuccaagaaaggugcuguuauuguucuuguuuuuuuuuugaggcggagucucacucugucgcccaggcuggagugcaguggcgugaucucggcucacugcaagcuccaccuucugaguucacgccauucuacugccucagccucccgaguagcugggacuacaggcgcccaccaccacgcccggcuuacuuuuuguauuuuuaguagagaugggguuucaccacguuagccaagauggucuggaucuccugaccucaugauccacccgccucagccucccaaagugcugggauuacaggccugagccacugcaccuggccuuauuguucuuguuuuauagaugagaaaacagagcuccauugaggugaaauaacucucccaaggccacaugguugguauaguaaaacuauguaaacccagcuggauuugacacaaaaucugaugcucuuuuaggcuuaaaaaauuaggaauaucagguugggaacugguuccugaggaggugcugaaaaauuauaggaguaggcugggcaaauuauaggaguaggaguggcucacaccuguaaucccagcaauuugggaagccaagguggguggauuccuugagcccaggaguuccagaccagccuggacaacauggagaaacccugucuugacaaaaaauacaaaaaauuagccaggcauggugguguguaccuguagucccagcuacgcaggagacugaggugggaggaucgcuugagcccaggagguugaggcugcagugagccuugauugcaccauugcacuccagccugugugacagagaggaacccugucuuaaaaaggaaagaaaagaaaacugauaggagcugcuguagaugugucacauuugaggugacagaguccagugggcagcuggaguugggccaguggaguuuagaaagaagcccgagacuggaaauggagauugggucucauuuuuuuuuuuuuugagauggaguuucacuuuuguugcccaggcuggaguggaauggugugaucuuggcucaccgcaaccucugccucccagguucaagcgauucuccuuccucagccucccgaguagcugggauuacaggcaugcaccaccacacccagcuaauuuuauauuuuuaguacagaugggguuucuccauguuggucaggcuggucucaaacuccugaccucaggugauccaccugccucagccucucaaagugcugggauuauaggcaugagucaccaugcccagcccugccccucuauuuuugacacucuaucccucuguguaaaugacucccagaucgaggucuccucucuggucucucugcuggccuuauuauaugaagugcuauguucagggcaugggcaucagagucagccaggucuggauuuagugacuuaccaguucugaggccucugaguaccaguuuccuuagcuauaaaaugggauaguaauaguaucuuuguuacagugcuauugaaauaauuaaacaagggccaggcgcaguggcucaugccuguaaucccagcacuuugggagacagaagcaggaggaucacuugagcccaggaauucaagaccagucugggcaauauagcaagaccuugucucuaggaaaaaaagaaaaaggccgggcgcgguggcucaugccuguaaucccagcacuuugggaggccgagguggguggaucacgaggucaggagacugagaccagccuggacaacauggugaaaccccgucucuacuaaaaauacaaaaauuaggugggcuugguggcgcgcgucuguagucccagcugcucaggaggcugacgcaggagaaucacuugaacccgggaggcagagguugcagugagccgagaucacaccacugcacuccagccuggugacagagugagacuccgucucaaaaaagaaaaaaagagaauuaaacaagagaacgaacauaaagcacuuugcacaguuucuggcacacaaguguuaaguaaauaauuauuauugcuaugucaaaccaccuaauagauguuuucacuuggccaccuuccugauauauuaaacacaucacauuuuaguuuggcauucaaggcgcuucagagucugacugcaaugcaucucuucuaucuugccugcccaagccgguuacuccaauaggaaaacccugcaccagcuguucuaccccuuccuuugaaaucaacaugggccucccuauccuacugcugauugcacuguuuuuguguccuggauuguugcugguaaccagggaguacgaauuauggaagcagguuaagcuuaauuuaaagaucucuuuaacaguuaaaauugggcuguuucaagaagaaauagguggccuugaugguggugaugauuucacgguuguauaccuguccccaaauucauugaguuguauacauuaaauauguacagcuuuuuuuuuuuuuuuuuugagacagagucucacucuguugcccaggcuggaguacagugggacgaucuuagcucacugcaaccuccgcuucccggguucaagcaauucuccugccucagccucuuaaguagcugggauuacaggugcacgccaccacaccuggcuaaguuuuguauuuuuaguagagaugggguuucaccauguuguccgggcuggucuugagcuccugaccucaggugaugcacccaccucagccucccaaagugcugggauuacaggcaugagccaccgugccugaccuaaauauguacagcuuuuuacacaucaaucaugccccaguaaagucaugggcucccaucccuggaaguguucaaggagagaccgaaugucaguggugcacuaagggcuugauauaucaggaaagccguugaaccagaugaucuucagaaucccuuucucuuaaaggcccuuaauuguuuaaaauguuauuuuuuaaacaguaaaagagaaaauauuuagcuuucugaaaauuaagaccagaagauuuaaauuuuaauguaguaugaauucaaacaauaauauaauagaggauguuuuucagcucucugucauaaccaguuagagaagagucaaagacaaugggaagaagagaagagagaaagagagagauaauaggagaaaagcaagagagaaauagagggggacaauaaagaggggaaagagaaagagguggggagguagaguggguaaagcuguggacgacaggguuuuugggaagaagaaaccucgauugggagaggaagugcuguaguggagagagugaaauacuguguaucauuccacuguccugaucuuaauguuagucuucaaauagggcuaucuccagucuccagagacuuccacaaagcugaucugguuccauccacauguccccaaggacaccagccccaugcuagacacucugagauuuguggggcugugugaucagcugaguccuguaugaucagacccuugaaagaagccuugagauaacaagugacccauacuccaggcuggguuuggauccaggucacaguccaugaccucuugguguuggugagagcagugucuuguauuccuucucaucccugguggguguggucaguuaacagaaucguugcguccugggggcauuuuguaacacaaagauuugacuagugggaaguauaugacacuaauggauuuccauaugagauucugggcuucaagugacauugaggcucagcaggccuuuugguccaguguuagguuucucgugcuauguguuggcuggaggaggguauuaucauacugcccugagucauuuccagccuccgcagagcacaagauuggaugaaguggcuuugacaauauucucauugugcucugaagacuaggaagaaaggccuggaauucagauagagaggggcacuuuucucugccagcccacugcgccuggccagucuggggcaccucuucuggagcugcugaaccagguggcauguuugaaugaauaaggaaaugcuuccccaggugcaguggcucaugccugaaaucccaguauauugggagggugagguaggaggaucacuugaggccaggaguuugagaccagacuggacaacaaagccagaccccaucucuacaaaaaaguaaaaaaaaaaaaaaaaaaaaaaaaaaaagcuaggcaugguacugcaugccuguaguccuagcugcucaggaggcugacauggaaggauggcuugagccuaggaguucgagguuucagugagccuugaucuugccaccgcacuccagccuggacaacagagcgagaccccaacucacaaaaaaagaaaaugaaacaaaauggucucucuuuccacagauccagcucugcagcuauagaggcuguacaaggcacacccucaugcucagaccuuauaggacacccacacuugugguuugguauaucuagaauuuuuaauauccugagaaguuccugggcauuaacuccaccucauacuaaaaaauuacuuucuaguugucucacuuucuucccagauauacucaacagaagagucccaggcccugggcugagcuauuucuuuuuucuuuuucuuuuuuuuuuuugagauguagucugucucugucaccaggcuggaguacaguggcgugaucucagcuaacugcaagcucugccucccggguucaagcgauuccccugccucagccuccugaguagcugggacuacaggugcgcgccaccacguccugcuauuuuuuuuuuuuuuuuuuuugagacagagucuugcucugucacccaagcuggagugcaguggcgugaucucagcucacugcaagcuccgcuucccagcuucacaccauucuccugccucagacucccgaguagcugggacuacaggcacccgccaccacgccaggccaauuuuuuguauuuuuaguaaagacgggguuucaccauguuagccaggauggucuccaucuccugaccuugugauccgcccgccucggccucccaaagugcugggauuacaggcaugagccacugugcccggcccuuuuuuuuuuuuuuuuuuuuuuuuccuucauagagacaggguuucaccauguuggccaggguggucucgaucuccugaccucaugauccacccgccucggacucccaaagagcugggauuacaggcaugagccaccaugcccugccgggcugagcuauuucuauagcacuagcuaauguacaugcaggguuucuccuuucuucaggugggccagcagaaaaauaacaacaguggugguaauaaugauagcuaccauuucuuccaugcgugcuuaaugccaaccacucugauguguucuuuuuuuuuuuuuuuuuuuuuuuuugagacaaaguuucacucuuguuucccaggcuggagugugauggcgugaccucggcucacugcaaccuccaccucccggguucaaccaauucuucugucucagccuccagaguagcugggauuauaguggccaccaccacaccuggcuaauuuuuguauuuuuaguagagacaggguuuugccacguugaccagacuggcgccgaacuccugaucucagcugauccgccugccucggccucccaaagugcugggauuauaggcgugagccaccgcgcccggccugauguguucugauguguucuuuauguguaucauuuugcuucauccucacgguagcgugaaucuucaucugacuagugaggauacugaggcacauuaaggaaugaacauuccaaguucgcacaccuagaaagugguagggccagaguuacgagcccaugucugccugacuccauaacccaugaucuucaccuccacacuguaaugccagcucagacaggaaggauuuaugccagaucccugacuaauaagccccagugggaacucuugucuccugagauauuuaacucaucuuuguccuucuguaugaugcaaacccccagcuucuaaccucagcccagcaccauucguucguauaaucaacaaaucuuuggccgggugcaguggcucacgccuguaaucccagcacuucgggaggccgaggugggcagaucacuugaggccaggcauucacgacuaucuuggccaacauagcgaaacccugucucuaccaaaaauacaaaaauuagcugggcaugguggcgugugccuguagucccagcuacuccagaggcugaggugggaggaucacuugaauccaggaggcagagguugcagugagccaagaucacgccacucucuugccugggcaauagagugagacucugucuuaaaaaaaaaaaacaaaaacccaacaaaucuuuuuaaguaaccauggccaaggacauaaaucaguagguauaguuaacuucaucuuuaaauucuuuaaauuucuggaaggaaucauaagaacucgcaauaaugguuauugcuagggauuuuaauauggaggggaauuuuuauuuuucacuuuauaccuuuuuauuuuauuuuucacaauaagcauguaauacuuuaaaaagucaucugggacuuuuuuuuauuuuuucaaaaguuuugggggaacaggugguguuugguuacauggauaaguucuuuaguggugauuucugagauuuuggugcacccaucacccacuuuuaaaaaauuaaacaaaaauuaaucugaauuuuuuaaaggaaaaagcccuuugucaggguucuauguuuuaaaaaagacgggggggacauauaaaagauauauguuaaugccuaguuggaagauuugcuuaaagguaaugaauaauugaggaaaauccaggguugauaauaaugcucaauuauacucaguuauugguaauccugugaccuuggacaagucacuuucccucccaggagcuguaaggaaugaccaauagaugauuccugaccggacgcgguggcucacgccuguaaucccagcacuuugggaggccaaagcaggcagaucaccugaggucaggaguucgagaccagccugaccaacguggcgaaacccugucucuacuaaaaaugcaaaaauuagcugggugugguggcacacgccuguaauucuagcuacucaggaggcugaggcaggagaaucacuugaacccggaaggcggauguugcggugagccgagaucacgccacugcacuccagccugggugacagagcaagacucugucucaaaaaagaaaaaaaaaaaaaagaugauuccuugcuuucuguaccauuugcugauucaccuuggaagcaggccaggguuagaaaccagccugagugaaggacagugaaggacagagaggaaugacccagccuugacugggagccuagaggcugugugacccaggaccacgaaccuaaccccucugggccccgcaccugaucuguaaacugcucagacuacacuauauauauccuuagguucauccaguucugacacuggaacauucuguugucuggauuugcugaagagaaacccucuagaaagucacaaauaagcaagggaaauagggcggaaaggugaagauaagcauugaucugaggggcucaugguuuuuucacuaaaguagaagggcugauuaguuuccuuccugcuuuuuuucaaggugagcugaggcacuucugggcauccuugccuuguucaguuuaaggcugguacuggaguccagcucgccucaucccuuggccaauaguuuccugaucucaaauuguucuuucuucuugauaaggaaauuccuagcacuugaaccauucgucauuuuuguuguguuuugagccauccaaggcggagacucagacucagucuccugauuuuugucucccagggaaggauaucauugaaaauagcauuauucaucugaaaaugguacucuucauccccuccccauugucucuuucauuucuucuucccuuacugcugacuccucaagauguacaaucagggcgcuggaaaaggagaaauaggucugugagggaagggguggcuauauuuucuaagagauggaagcggggucuguugagauuguuguuuugguuuugcuuuuuguggcaagugguggguaaaauaccaaugagauaccgaaacagcgaguaacgacuaccauuuggguguaauuuaucacuuaccaacacuuucacaucuauucucaaacucgcugguuguuuuguuuuguuucuguuuuuuguuuuguuuuguuuuuugagacagggucucacucugucaccuaggcaggaaugcaguagugcaaucucagcucacuacagccuccaccucccgggcucaaggaauccuuucaucucagcuucccaaguagaugagauuacagagauggaacuacaggcacacaauacuacgccuggcuaauuuuuaaaauaaauguuuuguagagauggggucucacuauguugcccaggcuggucuugaacuccuggggucaagugaucugccugcuucagccucccaaagugcugggauuacaggcgugagccucugcacccagcccaacuugcuguucuuacccaaggccugaaagguagcagguauucuccccauuuuacagaugagaaaguggaaguccaaagggcugaagagcuagguuuuguagcaaagagaguggcagaguguguagcccgacuggagcacccugacucccacacccagccaccuuuauaucauuccaccacagaacuugugcaggggcccuucccacaaauauuuucccagaguuuuuagccucucucugggacucuagggauccugacaaccucccugccagcacacaguuaagagcucuaacccacuuaucucagagacccccauaagacucucacacaggcagaagcagcagcagcagagcccugccuauuucagccaaaagagaaagcaaggaggcucugagcuuuccugaugguuccugaguuggcaaagguacaaauaccaaaugcugcuucucuccaaggugcuuuccugucugaaccuggaagaaagccauggaacagagaaaaggacauugggcuuggaguuagggcggugguggucaaauaucacucugccauuuacuggcuccaaaccuugagcaaaucacuucgccugucugggccuuaguuuucuuuuaugucaaauggggaucauaaccauuaucucauaagguucuugugagcaucagauaggacgauuaagguaaaaaggaguuaacccaguugaggcacauggccaguugcaucugagacuccugucuccugcggaaugucacagauagguggcaguggcagggcagagccuguuuggcuucucuguccuuguaaaaucauacuugaugcuaucuuuccagaagaguggcuggcugggccuggcugucuccauucuagcuuuccacgucagugcuuuaugaguacuggggccuccuuucuccccgcucugguuuugcacuccauuugcuccuggaauaguuaaaggugagucucugaguauccccggcugugucuacaagcuggcauugucccuguagugaccuggcuguugucacagcagcugaccugccucugauaccuggaaucagagccuuagucaaauugggaaguuauuuggaaagcacauagucaauauaagagcagcuagacagguggggcgugguggcucacgccuguaaucccagcacuuuggaaggucaagguggguggaucacuuaaggucaggaguucgagaccagccuggccaacauggugaaaccccaucucuacuaaaaaugcaaaagcuagcugggcgugguggcaggcaccuguaguuccaguuacuuaggaggcugaggcaggagaauugcuugaauccaggaggcagagguugcagugagccgagauugugccucugcacuccagccugggugacaaaaugagacugucuuaaaaaaaaaaaaagagcaucuagacagauuccuuaauuaggagacucaggcuucaaggacuccacuucuaggccuuuguuucccaucuauaaagcauggggguugggguugaugauucccaaaguccccuugguuacccugcccuucauauccaucucucaagugagagacuauggugcccuggagcucccagcccugucuuuuccacccccacagccugugcuggccuuuuaguuacacuggacuuguuuagaaucagcagaaccaaacccaauccuguccccaggcccacccaccuauagucuuuugcucugaaauauuacaaaagaagcauugacuggaauggcugagagcuucagggaaguucucuugaagacuaggaacuccacauucucauguccucugcuugguauauucuagacugaauuaggcucagggauuucaggcaucccugucccucccuauccucauaggugaugguuaaggauagagaucucuaaaaaaauuagucgggugugguggcucaugcggcuauuugggaggcuuaggugggaggaucucuugagucuggaacauccaggcugcagugaaccacugcacuccagccuggacaacagagcgagaucccgugucucaaaagaaaagaaaaggcucaagaucucugagagaaaggaggagauggccacugguauccucagacaaauguggaaauaaaaaaguaaaggaaaaaaaucuauuucuaagccaagaaaggaaucucaugcaugacauauuuccgagcaugggagugaagcagacagcuuggggugagacuggggagaaggagggagcagagacccugcaccuggacugaggcccacccacagauuucaugccagagccaaccccaucuucccagcacaagacuggucugucagccaggcuuggcugagaguguggguuugagcaagugggcaagacuuggccagugacugauaaggcaaauucaguugacauucagaccacgucugugcugggucccggcagggcuggcagagaaacacaggggcauuggacagacggguggagugauaguggccaguuagucaucguccaggauucucuuuauggagcccagggcccagcccgcaggagagauugugaagcagaguucuagguccacagaggagauccaacgcggaagcagaugagcagaaaccagcccaggagcuggucuugagacuccuguaauggggaagagggaggaaggagggcugggacuuggggacucagcagucaugcuuggcuaaugcaucagaccccaggccugacuggcagcucaaauuaugccugauaguguccagguggcuucaagaacugggugaguugguagccuuugagugagaaggacuugggccuagguguggauagcuggggaagguggaggcugaauaaacaaaaaauuucauuuugaaucugagguccaucucuucacuugaaaaucaccaaaaaaauuagccggcaugcuggcacaugccuguaguuccagcuacucagaaggcugaggugggaagaucuuuugagcccaggagcuggaggcugcagugagcucugaucaugccacuacauuccagccugggcaacagagcaagaccccgucucuaauggaaaaagaaaaaucaccaaaaaguuuuuaaaaacacaauauagaguauguugggaaaggaaagcucaggccuccacaaagaccaccuuaaagguauggagaauauaaaaugaaugcagaggcucgauuuuauaucuauuauuauaacaaauguuuauuuuuauuuuauuuuauuuauuuuauuuuugagacagagucuugcucuguggcccaggcuagaguacaguggugcuaucucagcucacuguaaccucuggcgauucuugugccucagccuccugaguagcugggauuccaggugcacgccaccaugcccagcuaauuucugucuuuuuaguagagaugagauuuugccauguuggccaggcuagucucaaacuccuggccucaaaugaugcaccugccuaggucuccgaaaguguugggauuacagguaugagccacugugccuagccauaacaaauuuuuaaaauaauaauacuucaugcggagccagggaugguggcucacgccuguaaucccagcacuuugggaugcugaggugggcggaucacaaggucagcaguuugagaccagccuggccaacauagugaaaccccaucucuacuaaaaauacaaaaauuagccagguguggugguacacaucuguaaucccagcuacucaggaggcugaggcaggagagucgcuugaaccugggaggcagagguugcagugagccgagaucacgccacugcacucuagccugggcaacgaagugagacucugucucaaaauaauaauaauaauaauaauaauaauaauaauaauaauaauacuucaugccuaugaugcuguaauaaaaaugguuccauuauuuacugcuggcaguaguuuaagucauuagaaugauaauugacaauauguuccaagauacacaaaauguuuauaacccuuuguccucuucugaaauuccuuucuaagaaagucaccuaaaaaagcaaaaaauuaggcugggagugguggcucacaccugugaucacagcacuuugagaggcugaggcagguggaucccuugagccagccugggcaacauggcaaaacccugucucuacaauaaaauacaaaaauuagccaggcgugguggugggugccuguggucccagcuacucaggaggccaaggcagaagaaucauuugaaccugggaggcgggagguuucagugagcugagagugcaccacugcacuccagccugggugacagagugagacucuaucuuuaaaaaaaaaaaaaaaaaaaaaaaaaauauauauauauauauauauauacacacacacauacauacacacacacacauauaugcauauauauacauauacauguaucuauguacacauguauauguauauauaugcauauauguguguguauguguguauauauauuuauauauuuauauauuauauauuauauauuauauauuauauauauuauauauuauauauuauauauauuauauauuauauauuauauauuauauauauuauauauuauauauuauauauuauauguauuauauauuauauauauuauauauuauauauauuuuauauuauauauauuuuauauauuauauauauuauauauuauauuauauauuauauauuuuauauauuuuauauauuauauauauuauauauuauauaauauauauuauauauauaacauauauuuuauauauauauuauauuauauauauauuagguaaaguggaaauagcaagacauaagcuuguguuuauacuauguccauagaggugaaaaaagggccaggcacaguggcucaugccuguaaucccagcacuuugggaggcugagguggguggaucaccauaggucgggaguucaagaccagccugaccaacauggagaaacccugucucuacaaaacuacaaaauuagccgggugugguggugcgcgccuguaaucccagcuacuuggaaggcugagacaggagacucauuugaacccaggagguggagguugcgugagccgagaucgugccauugcacuccagccugggcaacaagagcgaaacuccgucucaaaaaaacaaaaacaaacaaaaaaaaaccagggaaaaugaaagaaaccaaguagccaugguagggaauauguggcauuugucauuuuauuucuuuggugauuuugauguuugugcaauucuuuuuuucugaaaggagagaaagacaauaaaggguuaaaaacguguccccagaauucuuuaauagacugguauuuccuccaggguuaacucuugaaguaacaaauuucguaaauguauuaccuucuauaaacaguaaaacuccuuuucguuuguccuaaaaacugcugcugucaaaccucaagacgugagcucuuacucuaugugccaggauggauuggaaaagccuggaucuuuccuuuucauccccaguuuugauuguuucauuuccagacuuauccucuuaacuuuucuuugucuuuucagaacagagucuuuuuuuuuuuuuuuugagauggagucucauucuguuacccaggcaggagugcaguggcacgauuucagcucacugcaaccuccgccucggguucaagcgauucuccugccucggccucccaaagugcugggauuacaggcuugagccacugcgcccggccuaagccucccuucucuugaucuucucucugcuuuaugucucuggagaugcaguaagagaacuacacacaguacucccaauucagccacaucaugguuuuauaugaggguacaauguuuuguuucuaaaaagccuucaugauggugccugggcagaugcuacugacuuuuuuagcuguggcagcauauucagccagugucuucugggaacaguggaguguuacuccuccuccuccuccccuuuuuagggcuuauaauugauugcccauggcuaucauuuaauuaguagaguuaggauuccuuuuccccaaaauguaaaauuguaauugaugcucaucugccauuuuuugucagcucacauaggcuagaaauucuguuguacuuuaccaccuaggaggauuugggggugucugugaaguuggguauuucacccaugcacuccuucuugcacagcuucagagauuaguccuguuguuucacacuugagugcuuuccauccagagaaauaccuguuuauuucuguuuccuuucccuaguucacuuccccuuucuccaucucuucacuccccauguaacuuugaauaaccucugaugugcagccuugccaggagugcuuuaaccuccagaguucuggucauuggcuuccccaugugcuguaauaaccuauuccgucccauucugaaagaacucucagagauuagucagacaccauuuccucuugccggaaacauguugauuuccuuuagcagguucugcuuccuaaaggagucaccacagccccugcaauaggaagagcuugggcuuuggagccaggcaggccuaggccaggucuccauuuaaguuuuuuguuuuuaauucucuuucuuuuuuugagacagggucucacuguugcccaagcuaaagugcauuggcgcaaucucagcucacugcagccucaaccucccaggcucaagugauccgccugccacagccuugcgaguagcugggaccacaggcccacaccaccaugccugacccauuuuuauauuuuuuauagagacggguuuugccauguuacuugggcuggucuugaacuccuggacucaagggaucugcccacuucagccucccaaagugcugcaauuacaggcauaagccauccugcucagcuggaucuccauuuaaauuuaaugagaggcauauaacuaucauuuuuccagugaaagcucacagaugguuaucugccaagcagugugcuaaguccagggacccugagauacgaguaagauaugauugcuguccuaagggagcuuacaggcgagagagcauguaaacgaauaaugauucuaucaugagaaauaguaggaauauggccugguuacugagggggccaucaugugaccuuggauggguuauauaaccucugugagcuuucacuggaaaaaugauagugcuaauaauaugcaugccccuuacaccaguccuuuucagacauuuaugugcauccaaauuaccugggaaucucaguacaauauggaucucaauucacuaggucugaauuucuuauuugauuugcuuauuuauuuuugagauagggcguugcuauguugcccaagcugaucuugaaccccugggcucaagcgauccuccugccucagccucccaaacaauggggaccacaggcauaagccaccacaccuggcucuggaguguuacaaaaucuccccagguguuucuaacaugcagugauauuugagagcaagugucuuuugauuauaaagaauaaagaaugcuagagccacauaaaaugcuggggaaaaugaagggucucaggguugaaauggacaagcgugucccagauucagaggccaggccagacagcaggcuccugaagaccugugacccaguaguuaggggaucagguauccaugguccacaacaguaggggccuccuccaugugguucuucucuuuucucucacacccaccccaccccuccugccagguuccccagaugaucgggccccaugacagugaguguggauugaugaaugggaggagaaacugggauaaagagagcccaagguggccgggugcaguggcucacaccuguaaucccagcacuuugggaggcugaggcaggcggaucacuugaggucaggaguucgagaccagccuggccaacacggcaaaaccccaucucuacuaaaaauagaaaaauuagcugggugugguggcaugugccuguagucucagcuacgugggaggcugaggcaggagaaucgcuugaacguggcaggugaagguugcagugagccaagaucgcgccacugcagaaaaaaaagagagcccaaggaagggaccuggaacccacucugggacaacccccaaggauucuguuugguucaucaaauacguauugagcacuuguuaucugccaagcacugagcuaaguccagggacccagagauaugaguaagauaugacugcugccaugagggagcucacaggggggacagcauguaaaugaauaauuauucuauuaugagaaauaguaggaauauggccugguuacugagggggcccgaaagagcaauuucaaggggaucagggaaaauuucccaauggucaaggugugucuugcagaaaaaguggcaguuuuccaguuagauguggagugggaggaggaacccaggugcuugugaaaugccauggcccauugagggagcuggaauucuuuuuuuucuuuuuugagacggaguuuugcucuuguugcccaggcuggaguacaauggcgugaucucggcucaccacaaccuccgccucccguguucaagcgauucuccugccucagccuccugaguagcugggauuacaggcaugugccauuaugcccagcuaauuuuguauuuuuaguagagaugggguuucuccauguuggucagacuggucucgaacucccaaccucaggugauccgccugccuuggccucccaaagugccgggauuacaggcgcuagccaccgcaccgggcccccagggagcuggaauucucuuggugaggcuggaguacagagcauacgcagagcaugaauaguaagaggaaccgggaggccaggccagcucccggggccugucacugcagcugaccuuggauuucauccuguaaggaauggagguccauucaguaguuugaagccaaggagcaagcauucagaguugugcuguuuuuuguuuuuuguuuuuugugaugaagucucacucuggcacccaggcuggagugcaguggcgugaucucggcucacugcagccucugccucccuaguucaaccgauucuccugccucagccuccugaguaucuaggacuacaggugcacgccaccacacccagcuaauuuuugucuuuuuaguagagcugggguuucuccauuuuggccaggcugguaucgaacuccugaccucagaugauccgcccaccucaacuucccaaagugcugggauuacgggcaugagccaccguccccagcccaggguuguguuuuuaguggaucugccugggugucauguggcagagggguggaaggggacacugaggcaguggggagaccacagcagugguccaggagaguugugggggcugcaaugaagccagcagguagcagugagaaugaaaaaugggggguggugggagccgcacugaggagcagauuugauggccuugacucacuggccagaugcaacggaugagaggcagggcagggaugaggcgaggcaggugagucgcugaggaugcaguguaagggauucuucccucucaugguccugcaaaugcugaccuggagugugaaggaggagccuaggauggguuuaggucuguggcaaggcaaugcgguaagaggggagaucauuaaccaggagcgcaggcggcugcaguguggcagcauggacagccuccagggcucaaggccucuuccuccugccuuggccucugaggcuguguggggcuggaaugaagcucgugccucucuggcgggcccaacuugcucagcgucuuugggugacaaagccucacacagcccauuccuugaccucccaaaagccacuguuaaccccugucuggcuguguucccaaugauguggcucuuacagguggucuccugcuccccaagucugacagcacccccugcuuugagaucccucagguaggucagcuguuuccacugggaaaaauuccaguggagaagcagccagcuuuuuccacugguucaaggugauuucaaccuuccaggaggcccgugaugaagccagaggacaacuggguacccugggacagcaccuucuucuuauuuuauuuucauuuucuaaaauuucaaaucgggcacccccccaaaccagaauagguuuugaaaggcugccgacagcacccucuugaaaauacauuuuauguagucacaguuuacacaaaucugacauuauuucagcuucagauuccaaagcacugacuaggggcuuucacagagugagacuggggguacgagguucaaaucucuccucuuugcuacucaauagcugcauggccuuaggcuggucauucucaaugucuucauuuauuaaaugcggaggagaauagucccucuuagggggggauggaaaccaugguguuaaaggcuuagcucagcaucuaauagauacuuagcgcuccacaaauguuugccagccauccuggaacauaggcgguguuccaauauuguagaugacagaccugaagggauuaauuugcccaaagccucgagguaaguggguagaaccaagucuucccggcccucuccaaagcuccugcugugcugggcccgugcuguuccuucuugcugugcagucugcucccuuuggcuuuucuucugcuuuccacaucagcugaagauuuagacccuuuccugcugccuguguugagagcugucuuccugaguuggaagccaguuagcuaaaggcugggcuaccuggugacuguaucuuaucuuucccaauccucaacaccagcuggguccugguugccaggauuagguugccacccccauccuccuccuagcccugguggaccaaccuuuccuguguacccaaagcaaacagaccaguugcccuagauuccccgaggggcacccucugugccucccuaguguuccugcugacaauaagagccuugugcugggaccugagacacuagaggggaaaacuccauucucccugaaagccacaaggccccaucugggacacaucugguguccacucccagaaggaccacagagcagggaagcaaaaucucuccagcuagcaauguuguggacccuuugcaaagcccaccucccaaccccucuguguccccaggccauggagagcaagcuccucaucgggggcaggaacaucauggaucacaccaacgaacagcagaagauguuggaacugaagaggcaggagauugccgagcagguagggccuccaggugccagguccccuuggagaguguggccugcagcucaugucugggaggugcagggccguaaaccaugguggacucuggaucucuggaauuacagugcugagaaucucagacaugccacccugggucccacaggucuacuagcccagggucuucccuuuggcaggggcacugcuagcuggugggcgagaggacgugauagcucuccauaacaucagccuccacaagccaccugguacuaauuccugggccuuccacaagguggugugaguucuuugccaacuguaugacuguuucccuaaaucaucaagagccacaguuuguuggucuuaccaaucaaccauuauacuacuuggggagagggugaggcagcuuggaaggcagugugaugugccuccaucugugugacuaacgccucuggaguaggccagcucuuaggggcuggggucuccauccacauggggcagagccuggcaaaggcauggcccugggaacugagaggaggguucccaggggcucugcaggauugggugggagcaguggaugugggccaugggccauggugaagccaggucccgagacaggcagagugagccaguccccugagcuuuccuggcccucccgaguaugcacugcuccuuugagccacacugcccguccuuggccuagaaacgucgugagcgggagaugcagcaggagaugaugcuccgggacgaggagacuauggagcuccggggcaccuacacaucccugcagcaggagguggaggucaaaaccaagaaacucaagaaggugagacgcugcagcaggaccgguuaaggugugcuggaggcccagcagucucugcccaagggaugugugcuucagggacuccuccccauuuggcuggaacugcugaaccccugagugacauggcuuggccucgggggugagcaacagggggaggcaggaggcgggggcuggggguggaguagagccuuuucuccugggccagggugggcuaugacaggcugcaaacucugucacuugcaguauccagcguuaccaucuucaugguccugggugauuaccccguucagugucaccagugagucacaguugggauagcugggccuggagcagggccaggggaauacagagaggcugaggaggagacuggaaccccgggaagcucagguggggaguguaaggcccucaaggacaugucaagggaugagaauagccgcucaccagaacccugcaaagcccguggcaagggaaagacauguacaugugaggggggucuagggcaggaagcagcaaagcucuagcuuggauucugggaaaaaccuggaggcccuucggggugggugauguggcugcccaggggcaggccuggcagaggcacugccacuguggcaguuaccacggacccagcccucaguggcuuuggagaggagcaggauggccaugcuaccuccacaccccacuuuugagagccccugaagagacuggagugggaggggucaccuuccaaacucguucaggcuuccugcuuccugagcugggucuccaaauaagccccggguccuaguuccggcucuucuauuggcugguugugugaccuugagcaagucugugccuggcuuccucaucuaugaaaggaggguauuggaccaaaaggucccugggguccccucccguuugaacauuccacgaugcugauagcagcugagaaagagcagacaauggucacaggccucagugaaggagggcggggcaccacuuuaaauagcccagcccaauucgugguggguugggcacagcggggaguucagaaaaggacccgcagccucauccugggcugagucgguagacucugagccugcagcccugcggcccaggcugggugacuggggccucguugccacaccaagcagccucugaguggcaccuguccccacccagcucuacgccaagcugcaggcggugaaggcggagauccaggaccagcaugaugaguauauccgcgugcggcaggaccuggaggaggcgcagaacgagcagacccgcgaacucaagcucaaguagggcccgcagcucuuuucaucccggguccccacagccagccaucauuacucaggccucuccuccccuaaggccucauccugacugucuccucucccaugaguccuuuaggaauaaaaugcgucugagggcugagggaugggcccacgugcuggaguuucuucuaccuccucugccuguauuugaugaaccccucaaaauggacgcuaggugcuggccaaaaguaacuccgaaggcccugaggcuaccaucuuugcauaagaaucagugauuuuaaauuuuuuaaaaauuauuuuuagggccgggcgcaguggcucaugccuguaaucccagcacuuugggagccgaggcagguggaucaccugaggucaggaguuugagaccagccugaucaacauggugaaaccccaucucuacuaaaaauacaaaaauuagccgggcaugguggcgcgcacuuguaaucccagcuacucaggaggcugaggcagaauugcuugaaccugggagguggagguggcagugagccgagaucaugccacugcaauccagccugggcgacagagcgagacaacgucucaaaaaaaaaaaaaaaacaaaaacaaaaaaggccgggcgcaguggcucaugccuguaaucccagcacuuugggaggcugaggcagguggaucacgaggucaggagaucgagacuauccuggcuaacacggagaaacuccgccucuacuaaaaauauaaaaaauuagccgagagugguggcgggcgccuguagucccagcuacuugggaggcugaggcaggagaauggugugaaccugggaggcagagcuugcagugagcugagauggagccacugcacuccagccugggcgacagagcaagacucugucucaaaaaaaaaaauuauuuuuaaauuuguuuuaaaaauuauuuuaaaaaauguguguauauaguaguugcauauauuaauauugaugggauacauuagauuuuuuuuuuuuggagauggaauauugcucuaucauccacccuggagugcaguggugcagucuuggcucacugcagccuccaccucccaaguucaagcgguccuccugccucagccuccugaguagcugggacuacaggcgcccaccaccacaccugacuaauguuugcauuuuuaguagagauggaguuucgccauguuggccaggguggucucaaacuccugaccucaggugauccguccuccucggccucccaaagggcugggauuacaggcaugagccaccucgccuggccacaugagauguuuugauacaggugugcaaugugaacuaagcacaucauggagaaugggguauccauccccucaaacauuuauccuucaaguuacaauaauccaguuacacucuuuaaguuauuuuaaaauauacaauuugcuggcuuauaccuguaaucccagcacuuugggaggcugaggcagguggaucaccugaggucgggaguuugagaccagccuggccaacguggugaaaccccaucucuacuaaaaauacaaaaauuagccaggcaugguggcaugugccuguaaucccagcuacucaggaggcugaggcaggagaaucacuugaacccaggagguggagguugcagugagcugagaucgugccauugcacuccagccugagcaacaagugcaaaacugucucaaaaaaaaaaaaauauauauauauauacacacacacacacacacacacacauauauauacaauuaaguuauugacuauagucacccuauugugcuaucaaauaaaaguauuuauucauuuuucuaauuuuguguaccuguuagaagcagugauuuuucaagcugcaguauuucuguagggauccuuuccccuuaacuucuugauuuuccccaccuccacauugccucugccucuuuuuuuaaaauaaauaaauaauuaauuaacuuauuuuuuuuugagacggagucucacucugucgcccaggcuggagugcaguggugugaucuaagcuuacugcaagcucugccucccagguucaugccauucuccugccucagccuccugaguagcuugggacuacaggcacccaccaccacgcccagcuaauuuuuuuuuguauuuuuaguagagacggaaaugguguuucacuguguuagccaggauggucuugaucuccugaccucgugauccgcccgccuuggucucccaaagugcugggauuacaggcgugagccaccgugcccagcccccucugccucuuggcuuguugcuucuaauccuucaacccucacaugcaccacguggucucucgcucacccauuuucccaucacuccuucauuccugcucccagguaccuaaucaucgagaacuucaucccgccggaggagaagaacaagaucaugaaccggcuuuuccuggacugugaggaggagcaguggaaguuccagccacuggugccagccggcgugugagucucuaacccagcugucugggcugggggacuuguggguccacuccaggucggggcuggugaggggccugaggccuugccugcagggagacagauguuuuguggauuggggaaaagauggggaggaugccgaugggggaugaauuucucaggaucuaauuguaggggucucuaugauggaaggguguucugggaaaaaaagugucucauuggccugggaugcagaaaauaccuugugagggaucucgggagggaggaagagcaucucagccucuugacaauccuagcgaaugcuaacaucuggccaggucuggugaauauucauuugucagaugcccgaaauagcaaccacaguuaauauuugccaagcgcuacugugugccggaugcugugcaagacucaggagacagaagauaaauuagacaugguccgagcucacaguccagugggaaauaaguaaucagaucaugaugugauagagcugugauccaaucucagugcgcucgcucauccgggugauuucagcauuuccaccuguuuccauguccuaguccuugggugcagcugcggccauuggcuggguguguggcucccucugcugguggccaugaagaacaucccaacagagugaggccuugcccggcugaaccaugggcccuuaauugcaaauauauagagagaggugcuuaggaggcuggacaccaaugcaccuuccuggagauuauuugcucucucuagaauauuaauguuaaaauagggcaagagucucccuaaaucugggaugggaagcuagcaagaggucuacagcuucucacugaagcaucagaugccuacuugguuauuuuuuuuuuccuuucuuccuuuucuuuucuucuucuuuuuuuuuuuuuuaacaacuauagcuuagaugccuauuugaucuuucuuaaaggcugauuuuacuuaaggugauaccacauaaguuuguaaguggcaagcacgugaauagaggacuuuucaaugguauuacuuugcaccuacaauccaccuuuccaaucuagguagagauucucaauaguacaucagcugucauagagguuuuccacccuggcuggagcuagaauaccugcagagagucugauuuaaagggucccaggucuuagguuuugugauucugcauuugaagccaggcuagaaaaccacugcuccaaugacauuugcuggaguuggaugcuggcgaggcuucacucugaaggguuaucuuaugcuuagaaaaguucuuucuagcugggcgugguggcucaagucuguaaucucagcacuuugggaggcugaggcagguggauggccugaggucaggaauuugagaccagccugaccaacauagugaaaccccaucucuacuaaaaauacaaaaaaaaauuagcugggcgugguggcaggcgccuguaauccuagcuacuagggaggcugaggcaggagaaucucuugaacucgggagguggagguugcagugagccaagaucacuccauugcgcuccagccugggcaacaagagcaagacuccgucucaaaaaaaaaaaagaaaagaaaagaaaaggucuuucugcugggcaugguggcucaugccuguaauccuguaaucccagcauuuugggaggccgaggcggguggaucacuuggcgucaggaguuugagaccagccuggccaacguggugaaaccccgucucuacuaaaaauacaaaaaauuagccgggugugguggcaugcaccugcagucucagcuccuggggaagcugaggcaagagaaucacuugaacccaggaggcagagguugcagugaaacuugcucuuucgcccaggcuggagugcaguggugugaucuuggcucacugcaaccuccgcuuccuggguucaaacgauucucgagccucagccuccccaguagcugggauugcaggugcaugcuaccacgccuggcuaauuuuuuguauuuuuaguagagacgggguuucaccauguuggccaggcuggucuugaacuccugagcucaagugauccaccugccucagccucccaaaaugcuggaauuauaggcaugagccacugcaccaguccuuagaaaaguucuugaguuuaaaguuugcaggugaaggaauuucuuuacauuggauguaguagugccaccaaugugcucaacuaguugugggaugggagaggcuuugagaaggugugcauuaacuuuuguuguuguuguuguuugagacagggucucacucugucacccuggcuggagugcagugguguaaucacagcucacugcaaccucagccuccccaggcucaugugguccuccucccagcuaauuuuuuuuucuuuuuuuuugguauuuuuuguagagacaggguuuugccauguuacccaggcugaucucgagcuccugggcugaagcgaucugccugccuuguccucucaaaguucuaggauuacaggcgugagccacugcgccuggccacgucagcuuuuuauuuugaaaacaagaauugcaagaauaguauaaagaauucucguauacccuucaccagauuauuaacauuuugccauaucuugcuuuaacuuucccccaaccacuugagauuaaguugcagacauuuugaccuuuuaccuguacuuccgaaaaaugagaacauucguguuccacagugcaaugaucaaacucaggaaauuuuguauugucacaauauuauuauauaggcaauauuaaaauuugccaauguccuuuaugaugauuucccucccuccccaccugcagucaugcauuucauuuaauugucaugacucuuuggucuccuuuaauguggaacugagaagggauuuugacuugaguuuagcaguuucuugcuucagaggaauuuauucauuucucaaaacacucugcaauuuugacuugacugccucaagcacaugauccagacucaaaguguggcaggugcuuuaccugaaguucgaaugagcuuucugcauaaugauuaugaauuuccuucccucccucccucccucccuucauuccuucccuuucuucuuucuuucccuuccuuccuuccuucuuuccuuccuuucuuucuuucucucucucuuucucucuuucucuuucucucuuucucuuucucucucucuuucucucuuucucuuucucuuucuuucuuucucuuucucccuuucuuuauuuucuuccuuacuuccuugcuugcuuucuugcuuucuuuuuucuugagucucacucugucacccaggcuggaguauauaacucacugcagcuucgggcuccugggcucaagugauccuccugccucagccuucugaguagcuggggccacaggcaugcaccaccacaccagcuaaauuuuuuaucuuuuguagagacagggucucacuuuguugccuaggcuggucgugagguccggggcuuaagcgaucccccuccuacugccucccaggguugggaucacaggcaugagccaccccacccagccuggacuuccccuccuuauuuauguuauuuauuuauuuguauuauuuuugagacagagucuaucucugucugcacucaggcuagagugcaguggugugaucacagcucacugcagccuugaccuccugggcucaagugauccucccacucagccucccaaguagcuugaaccagcaggcagucgccaccauggccagcucauuuuuucuuaaauguuuuuuaaaaguuugcuuucuuccaccagguguucaugccuguaaucccagcuacucugguggcugaggcagaaagauugcuugagcccaggcuauuguaagcuaggaucaugccacuguacucuagccugggcgacagaaugagacuucaucucuaaaauuuuuuuuuaauuuacuuucuuccuuuuaaguaacccuuacuucaauugcaaacaauguuuucauuauggaaaauuuaaauaaacauagaaagaaugaaaauuccaccuagcuaguaguaguguuuacuaacaauuggauuugaacuuuccaccaucuuuucuuuuuuuauacauaaacuuuucuccuuuugaggguuaaaaugguuuguauaugcugaaaaaaaccauucacagauuuuaaaaauuaaaauagcuaccuuaaaacagcauacuuuaauuaauuuuuacaguaauaccuauaauaacuuuuuuuuuuuuugaggcagucucgcucugucacccaggcuggagugcaguggcgcuaucucagcucacugcaagcuccaccucccggguucacgccauucuccugccucagccucccgaguagcugggacuacaggugccugccaccacacccggcuaauuuuuuguaguuuuaguaaagacaggguuucaccauguuagccaggauggucuugaucuccugaccucgugaucugcccgccccggccucccaaagugcugggauuacaggcacaagccacugcgucgggccccuguaguaacuuuuuaaaaagaaagaagcuugcuagaauacagaucuuucuuuauuguguaaauguugccaauuucuagcccauugucuuuuuuacccugaucuucugcuuuaaaggcaaguuugugcucuuuauuaaaggauucuaaugcucucugcucuuguugcccaggcuggagugcaauggcacaaucucggcucauuucaaccuccaccucccggauucaagcaauucuccugccucagccuccccaguagcugggauuacaggcgcccacuaccacacuugguuaaauuuuuuuguauuuuuaguagagacaggguuucaccauguuggccaggcuggucuugaacuccugaucucaggugauccgccuaccucggccucccgaagugcugggauacaggcgugagccacugcgcccagccuucuuucuuuuuuuuuuugagauggagucucgcucuguccccaggcuagagugcaguggcgcgaucucggcucacugcaaccuccaccucccagacucauguaauucucuagcuucagccucccgaguagcuaggauuacaggugcacaccacgacacccagccaaguuuuuguuuuuguuuuugagauggagucuagcucugucgucaggcuggagugcaguggcgcgaucuuggcucacugcaaccuccgccucccggguucaagugauucuacugccucagccuccugaguaaccgggauuacaggcaugugccuccacgcccagcuaauuuuuguauuuuuaguagggacuggguuucaccauguuggccaggauggucucgaacuccugaccucgugaucugcccaccucgcccaccaaaaugcugggauuacaggcgugagccaccaugcccggccuaauuuuuauauuuuuaguagagaugggguuuuaccauguuggccaggcuggucucgaacuccugaucucaagugauccgcccaccuuggccucccaaagugcugggauuauaggcacaagccaccucaccuggcccccaccuuuccucucugugauucuucccacuguccuugagcagggaaaguugugaaaagagagucaguucuuugccaguggaaaccuggaaaacucugauuuuuccucagaagcuauuugcuuuauuuuuauuuauuuuauuuuauuuuauuuauuuuuugauacggaaucucgcuaugucacccagacuguagugcaguggcaugaucucagcucacugcaaccucugccucccaggcugaagcaauucuccugccucagccuccugaguagcugggauuacaggcacccaccaccaugcccggcuaauuuguuuguauuuuugguagagacggaguuucgccauguuggcuaggcugguuuugaacuccugaccucaagugaucuuccuaccucggccuuccaaagugcuaggauuuacaggcgugagccaccgugcacauccaaaaacuauuugcuuuaaauuuaccuccauaguguuaaguuguauuauuuugcuguuguuguugagauggagucucgucugucacccaggcugcggugcacuggcaccaugauagcucgcuguguugccugggcuggucuugaacuccuggcuucacgcuaauccucccaccucagcuucccaaagugcugggauuacaggcaggagccacugcaugcaacuggccuuaaauuuuauucuuuuuuuuuuuuuuuuuuuuuuuugagauauucucacucugucacccaggcuggagugcggugacacuaucuuggcucacugcacccuccgccuccuggguucaagcaauucucaugccucagccuccuaaguagcugggauuacaggcuugagccaccgaaccuggccuuaguuuuauccuuuguaaagggacuacccagaccaagaauuauugaacccaggcugcagcugugaaaggacaggauuuuuaacuaccagacuauaaaguagagcagcuuuuauaguguuuucuuuuccaagauucuuugcaaagaauuaguccuaacacacacucauuaugcccauuaauuuaaaucugcauauaguugcuuccacuuugcauuuguaaguuuguguuggcaacucuucuaaaugaauaccaauuggacaguguucccuuaaauuuuuuuuuuuuuugagauagaguuuugcucuuguugcccaagcuggagugcaauggugugaucucgguucacugcaaccuccaccucccggguucaagugauucuccugccucagccuccugaguagcugggauuacaggugcccgccaccacgccuggcuaauuuuugcauuuuuagaagaggcgggguuucgccauguuggccaggcugaucuugaacuccugaccucaggugauccacucaccucagccucccaaagugcugggauuacaggcgugagccacagugcccggccucccugaaauucuuauauugaaaauuuaaagcuauaaauagauuuacaagguuuuccgaaauuaugguuaaguauauucauaacuuaaccaugcuauuuuaugcagaauauguuuguaccuguucagaauaaagaccaaguacaacauaugugaagaaaauaugcaaauacaucuggguaggguaaaaggcaauuauaggcuggguacaguggcucaugccuguaaucccagcacuuuaggagacugaagcagguagauggcuugagccuaggcauuugaaaccagccugggcaacauagcgaggccccaucucuacaaaaaaauacaaaaaguuagccaggcauuagcacaugccuguacucccagcuacuugggaggcugaggugggaggauugcuugaaccuaggagguugaggcuucacugagcugugauuauaccacuucacuccaccuggccuggucaacagagugagacccugucucaaaaaaaaaaaaaaaaaggcaauuaugauuuaccaauguucucuacuacacuuaaauacaaauuauaugaacaguaauuacagaaugcucuaauauaauaaagaauuccaagaaauaaauuacuuuaaaacaguuauuaagaaauaucagguagcugugcacgguggaucacaccuguaaucccagcuacuugggaggcugaggcaggggaauugcuugaaccugggagacagaaguugcagugagccgagaucaugccauugcacuccagccugggccacagagcaagauuacauaucuaugaaaaaaaaaagaaagaaagaaauaucagguaaucaugaauauauucuuuucuuuuucuuuuucauuuuuuugucacuguccacuuugcuaugucugaugacugcaauuugcaguauuuaauauuuauuucagaacuuuaaaaaauacaaaaauagaaaaggcaaguaaaaaaugguucuaggauuuuuuuuuuuuuuagauagaauuuugcuguuguugcccaugcuaaagugcaauugcgcaaucuuggcucaccccuaccucugccucccagguucaagugauucucuugccuccgccucccgaguagcugggauuacaggcaugugccaccacgccuggcaaauuuuguaauuuuaguagagacgggguuucuccaucucuacucuccaucuccagccuguuggucaggcuggucucgaacucccgaccucaggugauccgcccaccucggccucccaaaaugcuaguauuacaggcgugagccaccgugcccggccaguucuaggauuuuuuauaugaaacaaguuuuuaaaauuacucuuuuuaaagccaagauaagaugguuagaauaaaguaaaaacaauuccacgguaauugaaaucccaguugugauucugacuuagcagagagagucugguggggcacaguagggggcagggagcugcuggccuggaucucugaggucaucugccccaugucccucauuucaccacagaagguugagggcagggagguccuugaacaaggcagcuuuccucauuucaggaaccauggggucugaggcugcagcugugaagcaaacuucuccacuccccagagaaaagguccuuucuucagcauuggaucccaccacuugccgcaucacuuaauuagggcuaaaaaacaaacagaaaaguuauuucucuccaaagcauauuuaacuaauuagggcguuguuccauuugcucaacucaaguguggaauauuuugcuuuauuucggccugugguauucuggggaugagaacacuaagagcugcucgaagugagaggaaaaaacauuguuuguaagaaauuaccugaagucaugcugucccauuagaaagcuucuguucaaaaaacauucuuccuccaccuacuccagcucuaagcauccaucccacccucugaccagugccucucucucaaacaaggaguugucaggcagcucuugagaaauauuccuaaucaacuuauuuuggaaguuuagcccuuucuuuuuuuucucuaccaucuccauguagccauuauuugauauaaaauaauauaaggugaggugccuuccacagucauaaucuuguauaauauuaaaguuacuuuaaaaaacauuuuugcacuggcgcgguggcucacgccuguaaucccagcacuuugggaggccaaggcgggcagaucaccugaggucgggaguucgagaccagccugaccaacauggagaaaccccgucucuacuaaaaauacaaaauuagccaggugugguggcauaugccuguaauuccagcuacuugggaggcugaggcaggagaaucgcuugaacccaggaggcagagguugcagugaggcaagaucgugcuauugcacuccagccugggcaacaagagugaaacuccaucucaaaaaaaaaaaauuuuuuuuugcaacuaggucuagcaauaaauauuuuacaaguacaaccuuuuauuuuuaguuucucauaauagaccgucgccuaagcuggagugcaauggcgugaucucagcucacugcaaccuccgccucccaggcucaagcgauucuccugccucagccucccgaguagcugggauuauaggcaugugccaccacgcccagcuaauuuuuguauuuuuaguagagacaggguuucuccauguuggccaggcuggucucgaacuccugaccucaggugauccgccugucucggcaucccaaaguccugggauuauaggcaugagccacugugcccaaccuagauuuuuaaauuuuauuuaauuuuuaucuauuuuuuugagacagggucucacucugucacccaggcuagggugcaauggcaucaucuuggcucacugaaaccucugccucccaggcucaagcaauccucccaccucagcccccugaguagcugggaccacagguacaugccacgaggcccaguuaauuuaauuuuuugagacaaggucucacucuguugcccagugagugcaguggcacaaucuuggcucaccuucuuggcucaagugauccucccaccucagccuccuggguagcugggaccucaggcuugugccaccaugccugacuaauuuuuuauuuauuuuagagaugaggucucacuacauugcccaggcuggucuugaacuccuggauucaagugauacccccaucucagccucccaaaguauugagauuacaggcgugagccaccacaccuggccuagacuuuaauuguguuuagguaaaauugucuucuucuucuuuuuuuuuuuuuuaaauagagacaggguuucacuauguugcccaggcuggucuccaacuccugaugucaagcaguucacccaccucagccugggauuacaggugugagccagccccacaaaauugucuucuaaagggugauauaugugacagcauccauacccugugguuuaugguacacaaaauuccauugcaacuuuagcccuuugaccuuuguaaccccagccacccuagauucuuuucuuuguuucuuuucuuucuuuuuuugagacagggucucacuguguugcccaggcuggaaugcaguggcacaaucauggcucacuacagccuugaccuucugggcucaagugauccuccugcuucaacuucccgaguagcuuagaccacaguacagacauggaccaccauacccagcuaauuugcuuucauuuuuaguagagacgggggucucacuauguugccuaggcuggucucgaacuccugagcucaagugaacuccucccaaagugcuggguuacaagcguaagccacugugcccagccccuagauucuuuuuaaaggcaucauggugcaguagagagagacuagacuuuggauuuagaacauucugaauuuggccgggugugguggcccacgccuguaaucccagcacuuugggaggcugagacgggcagauaaccugaggucaggaguuugaggccagccuggccaacauggugaaaccccgucucuacuaaaaauacaaaaacuagccgcgugugguagugggcgccuauaaucccagcuacccagaggcugagguaggaggagaaucgcuugaaccugggaggcggggguugcagugagcugagaucgcaccacugcacuccagccugagcaacagagcgagacucaaaaaaaaaaaaaaaaaaaaaaaagaacauucugaauucuagccccugcucugccacuuacuaguggccuugaguaaguuuuuuucuguuguuuuuuuguuuuuugagauggagucucacucugucgcccaggcuggaguacaguggcgugaucucagcucacugcaacccccacuccuggguucaagcgauucuuccgccucagccuccagaguagcugggauuacaggcauacgccaccacaccuggcuaauuuuuguauuuuuaguagagaugggguuucaacauguuggccaggcuggucucaaaccccugaccucagguuauccacccgccucagccucccaaacugcuaggauuacaggcgugagccaccaugcgccuggccuugaguaaguuuuuuuaaccucucugaacccaaauuuuuucaucuguaaaguggggauaacaauauguaccuugcaggacugucaagguugaaaugaaauaauguaagguuccaggccugugccuggugcggaggagaugaucaaugaagaguugcacucacacugauaaaccaauauucuaauuauggggacucuggagaaaccggccugcucuaucccuuagaagugcccuacaagggcaguuugacuuuauguuuuuguuuuagauguugauuuuuuguuaaacugccucuggguuuauuuuauuuauuuauuuauuuucauuuuuauuuuuuugagacagaguuuuacucugucacccgggcuggaguacaguggcacgaucuuggcucacugcaaccuccaccucacagguucaagcgauucuugugccucagccuccugaguagcugggauuauaggggugcaccaccaugcccagcuaauuuuuguauuuuaguagaggcaggguuucaauguuggccaggcuggucuugaacuccugaccucagguaauccaucugccucggccucccaaaagugcugggcuuacagguguaagccaccucacccaggcucugccucuggguuuaaagagagaguguuucuugcuauaaauagaaucaggaaagaaaguuaaacugguuuugucacagaggcaaaguucaccccaguaagaacauuccuagcucugcguugagucccuggauuucuucacagaccugugagaauugaagacagugugaagcagggagcaguugcagcuucccaggcgggucggggacagcauggaggggaaaugggaaggcugagaguucagacaagcagggcaguggaacaagguggacagauggccuaccaggagaaagcagccagaucgaagaggaaagccugacugucaguguugaaugcacaggaaggaacuagaaggaaacacacccgaugaugucggaugccugcuuucagaacaagagggggaggccagccgcgguggcucacaccuguaaucccagcacuuugggaggccaaggcagguggaucacuucaggccaggaguucgagaccagccuggccaacauggcaaaaccccgucucuacuaaaaauacaaaaauuagcuagaugugauggcugucaccuguaaucccagcuacuugaaucugggaggcagagguugcagugugccaagaucuugccacggcacuccagccugggugacagagugaggaagggagggagagagggagagcaggaaggaaggagaggaaggagaggggaaaggaagugaucaaacagccaggaaagagaaugaugucaaccccugagauggagcugagagaugacuuuuuaauauuaaaggggaaaaaaugauaguagccaauuacggagggaggguccuaggagaacgcgucagauguacugcacgcaggauaacugugguuguggggcccugcugggaggggugcuuaaagggaggggugcauaaacgcagacccaggccucagcuccgggcugccaaaaccugcuuccuacagaggaucaaucauggaaaguaggccuggggcagaagagggagccgaugggaaggucggugccccaauuacagacucccuucccccaacccuucucucccacaugccacccagaauagcccuggcaucuuuauugggucaggcugccaauuugcgcugauccucugcucacccagcccugucccucuguccuguucccagcgccugagcuuucaaaggcacucacuggcccaucuguucuggcccaguguccuccugagagaugauacuagaguccuuggggggaacccccacccuguggcauagaaugagguguugcccgauucaaaaauuucacaaaauaauuuuuuuuuuuuuuugagacucagacucacucugucgcccaggcugaaaugcaguggcacgaucucagcucacugaaaccuccaucucccagguucaagcaauucucugaguaaccuccucaguagcugggguuacagguaugugccaugcucagcuaauuuuuguauuuuugguagagaggggguuuuaccaaauuggccaggcuggucuugaacuccugaccucaggugauccaccugucuuguccuccuaaaguguugggauuacaggugugagccacugugcccagccacaaaauaauaauaauuuuuuuuuuuugagacagagucucgcucugucacccaggcuggaaugcaguggcaugaucucgguucacucaaccuccgccucccagguugaagugauucucucaccucagcauccugaauagcugggacuacaggugcaugcuaccacacccagcuaauuuuuauauuuuuaguagaguccggguuucaccauguuggccaggcuggucuugaacuccugaccucagguaauccaccugccucagccucccaaagugugggauuacaggcgugccgugagccaccacaccuggccaauaauaauuuuaaaaggaguauaugggaagauucagauuccuagucucucccuaauugcaugaccuuggacacaaaaggcgcugcaccucccugagccucagucuucuuugcucuauccacaccuccggagguuguuaaguucagaugaacuguguagaagcacguuguaaauaaguugccauuuuccuaauuuucccacuccccucuuagaggggauggcucugcauuuccagcagcgucugcagcaggacugucuccuugcugccacugccacugaggcugccucuccucacgggcacgccucccggcauccuguaagcucagcugcagacccagcuggggcuucuggagccuuaucuuuccuuguuuucaucuauagagagggucagcagggaccacuaaugggguacggcaccuuuuuauaugcaucauaaacuaaaccacaagaauguuauuucccaucacugccagcugcagaaggcagccauuguucugugggccccugcacagcuuguucugcuguucaaggacagaauguccuaagcuuugaguuacucggccuguuucuucuccucuuccaacugucgccuuuugacuuuuauccuugcucauuucauuuguauccccacuugaaauuagcaaguggaauugaaaauaaaucauaaucacagcugccauguguuaagcccuguggcagguguacugugcuaagugcuugucuuguuuaaucucagaaauucuguaugauagggaugauauaucugaggcucagagauaguaagccacuuccccaaguaaaagagcuugaaggggcagagccagcauucaaacccaggucugccuuacuccaaaaccuguguucuuuuauuuuuuuaaauggaaguagcuuucuuguuuucuuuccuuucuuuuuucuguuuguuuuuguucaggguaguaaaaguauuuuaauaauccaucacacucaccaaauugcugaaagugaauagcacucaaugagcucucuaggauguagaccaauggaaacuuccauaaguguaaucacuuugaaaagcaauugacaauaucaaguaaagcugaaaauccacauacccugcaaugcaacacuuccauuccuggauccauaccccagggaaaauguuaaauauaagcaugaaaauaccuuuagaaauguucacagcagcauucuuuacaaaacuggauggcaggcauacagauacauauuuccuguagauguuugaacuaauuaauuaguauaaaguuauacauauucauuguaaaaaaauuuuugagauauugcagaaaggcagagagaaaauaaaaaucacccauaaucacacaauucaaagauuauaacugucaacauuuuguugaauaucuagacuuuuuccuaagcagacacacacacacgcauuuccuuaaaacuggccagguaugcuggcuuaugccuguaaucccaacacuuggggacacugaggcugggggaucacuugaggccaggaguuugagaccagccuggacaacauagcgagaccccaucucuacaaaaaauuuaaaaauacaaacaaaaacuucaucuuuuuauuugcucuuuuauuaauauauuguggcagucuuucugcauguauguagagccacacacaaauuuuuuuguuuuguuuuguuuuguuuuuuuuuuuugagacugagucucacucuguuguccaggcuggaguguaguggcgugauguuggcucacuacaaccuccgccucccggguucaagcgauucuccagucucagccucccgaguagcugggacuacaggugugugccagcgugccuggcuaauuuuuuuuuuuuuguauuuuuuuuaguagagaugggguuucaccguguuagccaggauggucucaaucuccugaccucgugauccacccaccuuggccucccaaagugcugggauuacaggcgugagccgcugcacccggccgagccacauaaaaauuuuauugacuacauaaaguuccuucauaggacugaauaguaauguaacuggguccuaauaauuuaaccaaccccauuuugguuguuucuaauuuuuugcaguuguaaauaaugcuucagggccaggcacaguggcucauacuuaaagucccagcacuuugggaggcugagguggaaggauagcuugaggcaaggaguucaaaaccagccugggcaacagagugagacccugucaaaaaauaacaaaauuagccaggugugguggcaccugccuguagaccuaucuacucaggaggcugaggcaggaagacuauuugagcccaggaauuugaggcugcagugagcuaugauguugccaucacacuccagcuugggugacagagcaagacucugucuauagaaaaaaaaaaggcuucagcaaauaccccugcauguaaauuuuucucuuuaccucugauuauuugcuuagugaaguuccuaggaggagaaauuugggucaaagaauaugcauuuaaaauuuuauuauuuauuuuuuuuuaagacugagucucacucuguuguccaggcuggaguacagcagugugaucucagcucacugcaacuucugccucccagguucaagugauucuuaugccucagcuucccaaguagcugggacuacaggugugagccaccaugcccggcuaauuuuuguauuuucuguagagacgggguuucaccauguuggcuaggcuggucucgaacuccugaccucaggugauccacccaccucggccucccaaagugcugggauuauaggcaugagccacugcgccuggccauaaacuuuuuuuuuuuuuaaauuagagcugggaucuucgcucuguagcccagguuggagugcagugacuauucauuggcacaaucauagcacgcuacagccucagacuccuggccucagaugauccucccaccucggccucccaaagcguggggauuacaagcaugagucucugaggcuggccuguuuguucauuguuuaaauaacagcucuguugagauguaguugaccuaucauaaguucaccauuuuaaaguguacaauucaguggauuuuuuuuuagcucuacugcuuaauaauguaguggauuuuaguauauucagaguuauacaaccgucaccacuaucuaauuccagaacauuuucuuucuuuuucuuuuuuuugagauggagucucgcucugucucccaggcuggagugcaguggggugcgagucggcucacugcaaccucugccucccggguucaagcgauucuccugccucagccuccuuaauagcuggaauuacaggcaugcaucaccaccccuggcuaauuuuuguauuuuugucagggaaagggucucaccauguuggucacgcuggucucgaacuccugaccucaagugaucugcccacuuuggccucccaaagugcuggguuuauaggcaugagccaccacgcccagccuaauuccagaacauuuucaucacuccaaaaagaaacccugaaccaauuagcaguuacuccucauucuccucaaaaccccuuuccccagaccuagacaacugccaaucuacuuucuguuucuauggcuuuaccuauuccagauauuuuauguaaauggaaucacacaauauguaguccguugcgacugaguucuuccacuuagcaaaauguuuucaagguucguccauguuggaacacucaucaguacuucauuccuuuguauuggugaguaauauuccacucuaugaauauaccacauuugguuuaucaacacaucaguugguggacauuucgguaauuuccacuuuuuggcuauuauaaauaaugcugcuaugaucauuuguguacaaguuuucauaugaauacauguuuucaauucucuugaguauaugccuaguaguggaagugcuggguuauaugguaagucuauguuuaacuuuuuuuuuuacauucucacuaauaguguaugaggguuucauuuucucuacauccucaccaacauguguuacugucugucuuuaaauuauagucauccuaguggaucugaacugguauccauuguggguuuuuuuuuuuucuuuugagacaaggucuuaacccugucacccaggcuggagugcagugacaugaucacggcucacugcagccuugaccucccaggcucaggugauccucccaccucagccucucgaguagcugggauuacaggugugugcuaccauacccugcuaauuuuuuuuuguauuuuuuguagagacagggucuugcuauguugcccaggcuggacucaaauuucugggcucaagggauccacaugccucagccucccaaaguggugggauuacaggugugagccaccacacccagccaccauugugguuuugauuuagauuucccuauaugacuaauaauguugaacaucuuuucaugugcuuaucaaccauuuguauaucuucugagaaauaucuauugagauccuuugcccuuuuuuuuuuuugaaacggagucuugcagagucucacucugucacccaggcuagagugcaauggcgugaucuuggccuacugcaaccucugccucccagguucaagcaauucuccugucucagccucccaaguagcuggaauuacagauacaugcugccacgccuggcuaauuuuuuguauuuuacuagagacgggguuucaccauguugcccaggcuggucucaaacuccuaagcucaggcaguccaccugccuugggcucccaaagugcugggauuacaggcaugagccauggugccuggcccuggaguuucaguucuauuucauuaaucuauauguucgucuuaugcaaguucuauaguaucuugguuacuauagcuuuguaauaaguuuuguuuuguuuuguuuuguuuuguuuuguuuuguuuuguuuuguuuuugagauggagucucacucugucacccaggcuggagugcaguagccagaucucagcucacugcaaccucugccucccggguucaagcaauucuccugccucagccuccugaguagcugggacuacaggugugugccaccacacccagcuaguuuuuguauuuuuaguaaagacaggguuucaccauguuggccaggcuggucucaaacuccugaccucaggugauccgccugccucggccucccaaagcgcugggauuacaggcaugagccaccacaccuggcgcuuuguaauaaguuuugaaacugagaaaugugaggcuucuaacuuuguuccuuuucauuucaagccugaguuuuuaaccauuuuauuaugcuaacuccuaugaagaaaaauaggcuggguggaguggcucaugccuauaaucccagcacuuugggaggccgaggcaggaggauuaccugaggucaggaguuugagaccagccuggccaagauggugaaacccccugucucuacuaaaaguuaaaaauuaccggccaggcgcaguggccuaugucuguaaucccagaacuuugggaggcugaggugggcggaucaugaggucaggagaucaagaccauccuggccaacauggugaaaccccgucucuacuaaaaauacaaaaauuagcuggaugugguggcaugcgccuguaauaccagcuauucgggaggcugaggcaggagaaucgcuugaaccagggggucggaaguugcagugagccgagguugugccacagcacuccagccuggugacagcgagacuccguuuccaaaaaaaaaaaaaaaaaacaaaacagaagaaacaacacacaaugaaggcugggugacagugagacucugacucaaaaaaaaaaaaaacagccaggugcagugauucacgucuguaaucccaguacuuugggaggccaaggcagggagaucacuugaggucaggaguucgagaccagccaacauggugaaacccuguccucuacugaaaauacaaaaauuagccggguguggugguguuugccuguaaucucagcugcucaggaggcugaggcacaagaaucacuugaacucaggaggcggagguugcagugaacugagaucgcaccacugcacuccagccugggugacagagcaagacuuugaaaaaaaaaaaguauauaaagcuacaagcuaaagugagacuggauuucauuucagccuucaaucaguccuuucuacugcagaaacaauuuaaagcaacaggagugaagaaauauuaauauguaccucuuuguguuacacaguagucuccacuuauccaugggggauacuuuuuuuguuuuguuuuuuguuuguuuguuuuugagauggaguuuugcucuuguugcccaggcuggagugcaauggcgugaucuuggcucaccacaaccuccgccucccagguucaagcaauucuccugccucacucuccugaguagaugggauuacaggcaugcaccaccaugcccagcuaauuuuuuguauuuuuaguagagauagggugucuucauguuggucaggcuggucucgaacuacugaccucaggugaucuacccgucucggccucccaaagugcugggauuacaggugugagccacugcaccuggcaggggauacguuuuaagaccucuaguggaugccugaaacugcagcuaguaccaaacccuauauaugcuaugagguuuauuuuaaauuuuauuaauuuuuuuaaauuguuguggguacauagcagguguauauguuugugggguacaugagauguauaagacaaaacaauuauaacaauauacucuaauaaggcugggugcaguggcugaugccuauaaucucagaucuuugggaggccaaggcaggcagaucacuugaggucaggaguucgagaccagcuuggccaacgugguaaaaccccaucucuacuaaaaauacaaaaauuagccggguguuaggccaggcacgguggcucacgccuguaauuccaguacaucgggagguugagguggguggaucaccugaggucgggaguucgagaccagccugaccaacauggagaaacccugucucuacuaaaaauacaaaaaauuagccaggcguggugccacaugccuauaauccaagcuacucgggaggcugagacagaagaaucacuugaacccgggaggcagagguuguggugagccaagaucaugccauugcacuccagcaugggcaauaagagcaaaacuucgucucaaaaaaagaaaaaauaaaauaaaguaaaauuagccaggugugguggugcaugccuguaaucccagcuacucgggaggcugacgcaggagaauugcuugaaccugggagguggaggcugcagcgagcugagauugugccacugcacugcagcgugggugacagagugagacuccaucucaaaacaacaacaaaaacacaauauacucuaauagaagugaugcaggugugucugucucucgaaacaucugauuguacuguacuugccuauuuucagaccacaguaacugagacuguggaaagcgaaaccacggaugagggggacaacugcacuagcuucaguugucaagcuguauuagagcaaggagaagaaaauuccagaacuugcagucugcagggccuccuagcuaccugaaugauauuuagguccucaugaugucauuugcuguuuguguuccacagaaauccuuucuaauauagccucuuuccuacagcaguagcagccagaugaagaagcggccaacaucugcagugggcuacaagaggccuaucagccaguaugcucggguugccauggcaauggggucccaccccagguacaggguaagaagcggagaggggagaaagagccuacgggagggaggccgggcgaggugucucacaccuguaaucccagcacugugggaggccgaggcagguggaucaccugaggucaggaguucgagaccagccugguuaacauggugaaccccugucucuacuaaaaauacaaaaauuagccaggcguggugaugggugccuauagucccagcuacuugggaggcugaggcaggagaauugcuugaaccugggagguggagguugcagugagccgagauugcaccacugcacuccagccugggcaacagagugagacuccaucucagaagaaaaaaaaaaaagagccuaugggaggggaugcucacagccucugcuuccccuaaccaccucaucagcccugcuacacccaagacuggcugagucccuagaaggcacagugacugggcacuguucaagccuggcaugauauucccaccacaggcugaaaacauaauguuucuggaguuggauguguccccuccagcugucuuugagauggaauucucucacgaccaagaacaagacccucgugcgcuacacauggagaggcucaugcgauuggacagcuuucuggaaagaccuuccacgucuaaaguccgaaaguccagauccuggucaguaccuccauggucccaggcagcacuggacccaggaggcaggggaacugcaggcgcugggugaugcuaaagaggguuuugcugguacccgaagggcaggaagggcaaggggugacuggggaugucagaaggauuccugcagcaacaggauggggcaaaggagaggacccacuuuccuguuuccuguauuucccuaaccuccccuuucgccugcgucaucuccccugcaggugccagaguccucagcggccuccaccuuccaccacacaugccucccuggccucugcuucucugcgcccugcaacaguggcggaccaugagugacaaccaucacgucaggcugcccauccaauagacuccugggauggggcagccaacccuggcucaucucaucugccgcuuggugcgugugcgugugcgugcaugugcgugugcgugugugcaggggugagaaucuggcagauggugccucugccugcucuucuucgccuccuuuauuuaauucauguuauuuauucgcggagcucuguucguguuggggagaugcccucgccugagccgucugggccuaccguggucacugcguagccucuuuuucuucugacuugagagcucccccagucagaucucaggcuugucccccugucagcugccuccagaagggaagguagccagugccugagaagacagucccuuuucuacccaccgcacuccauaaccuccaucuucucccacacugauggcgagcagccccugagcacuuucugggacugggagacugcuugguguucccugaggacaagagacauccugacaguguugggcaucugcuccccguggacacagccccacucuccacuuucugagccucagacaaccucauucagccucuugggcuccuuuucaaggacauuaauaaccucaccaacauagcucaugcccuucagcuuugacaagaacucacagcuucccaaacucugcuuucugcccaccuuggaugggaacuguggaccaagcaauuaccaucgccuuggaaccugcaggaaauggaacagcaauugagacaacuugaacagucaucaacggaagucccuccacuggauuccuuuguuucuguccccuccgaggagucauuuuggucgacaggcucucaaggcaacuccccauuuucaagaggcugcuccugccugcuucgaucauuucucccugcagcugccuagaccccguucacagugggaggagucaaugucauucuaccccucgcuaaacgaagauauuaacaucuauugcuuuuucccuucaucugucacaggaaacagaagcccaggcacaaucuuuuccagcuuugccuguuaccccuguuucugaauugcaucuuuaagguauuauuuuguugaaaauagauccuuuauucacuaguuacgcaaauugguuccuagggggauacuccuuaccuuccuuugugauggcccaaaaugucucuagguaucucaagugauaaguaaauuucuacaaaaaaaaaugguuaauguucauugacuggcuuuuuaaguguauauuuuggaggacgggugaagaggucauaacgaaagcaagcgagugaauuaggauuucaaagugcccuaauagugugagucuccaguuccuagaauaugaagagugcugucguuggggugaaaccaugagacugacagaucugccugaaauggggggugugggaggugguggcggggguuauucucuuuccuucaggaaaugaacccuucuuacaucauucaaguucugcucugaggaucaagcuugggucugauuuaacucagcgacacugucauuucugcuucauuacuggacuagaggguugagccacccacuugccauuugcuccuguccuuccaggaaaucacaauuuucaucagagcccaagagauuauuugagacucaggauucagaucagagguucgacuguggcugggacaggaguuguguguagaaauucaccagguggccugagcgcagggggaccuccagggcugcguugagcagccucucccacugaccucuuucucguuuguggacaaagcagcacguaucaccucauucaucacuuggacacaucgccuuugcauugucuugucacaccucccucacagucuuauagcacaauauacccaaaucagcccccccaguccgagggcugggcccgagguauggucggaggaggagcuccugccugcgguuuuguguauguguguaugugugugcguguuugugugcguguuuaccuccacaggggacacucuacacucaguguaagaucugcugggaacagggccaccaggaguggcuggaucucagucucucugucucucuuucucuccuuuuccuuuugguguaucaaauauuugauugacaaaguaagggccuugauuaggaccaaauucucguguguugcuauggucuuuauuuaggacaacaauuaacaaugcaguggcccauucuugucacucuacacauaugacuauacgggacauauguaauauauaaauauauauauaaaacauuccccucuguccccuuggcuucggauggaggccuuucuguugagcugaaaugcaccugcagcugggugcugccagcagcuugcaggccccagcccuguuccaaucaaugcaguugacaauaaaggaaugaguaucgucacggaguugacugccuu

SEQ ID NO: 192339 - RNA, 139060 nt, Homo sapiens
agcggcgguagcaguggcaacggcagcaagaggaccggccgccccauagacccccccgcgcaccacccccgccgcuuccucugcuugggugcccccccggucugacuucccuuuucucccaccuuucccggcaccgcgggaaaagcagcgcagggcagagcaggcagggagggcggccggagcccggacacgggagccucccagucaguucaagacccgacaugagggaaaagggacguaggaagaagggcaggaccugggcggaggccgccaagacgguaagggggagggagcgaaggggaaggccgggaggauuuuguucccuugucgcccgccagucgcagggaaagggaggucacuggcccagggacccggcugaaggggcacaaaaccgcgcggagagggcggcgguuagugucgggguugcgaucccugugggaauggaggcgcccggcggaacgugauagccgcggggccguggcgucccucggcgucugcggcgaguccucucaguguuuugaggcugucuuuuggggucgagccgauaucaccuccgcucugugguagcccucgccccggcacggggaagucuguggugcuugcacgguaaccgguucuucucccuugugcggcuggagagcccccauuggaugcagauaggagaaggcuugugcgugcauccagccccggaaaggagaggggagcgcuggagcuggauagaauuuacccguuacagcggacgugccugugaccccgggcccccuguuugucuggcucccggagcagacgagagaucacgaggcuuuuguuuuuguuugguguuggagccgaaagugcaggagguguuuagaaacgaaguaacaggugggacuuguagaauuuuuuuuuuuccuguuuccguagagaccuacucugaacaaggcagcaaugcauggugggacguguaguuuacccggccuucacguuacccuagccaaagggauggugcccuaaugaaguuguaauuagugggcaaaacaauuuucccccuaauuguguuaugacgaaauuuagagguagauuuuaaaaaguggaauauugaggauuagugagaacuuuuaccauauuuuaagaagaaaaaauuaaaagcauguuguaugcagaaaugaaauggcaggagauagugaaguucauacaucguugagggugcagcagaaaaguaauagggcauuaaacggcagcauuuuaauaguggaaagugagagguguucaccccuuuaauggugauuaaugccgguaauacuucgacaacguagcccuucuuagugaacccuuauuagaugccauaugguuuauuuuuuaaugaguuuuuuaaauauaaaaguaauguucacuguggggaaauuuggaaaauuauaaaaaaguauaaagaagaacauuuaaaaaaaaucacauuuauuucaccgcucggcuguaucugcuaacauuugguauauuaccgucuagucucuuuauuuccccaaaucuaggucauacuguuuauucagucuugugcauuuguuucuaaacuuugugcauuuguuuuguaaacuuuaugcauuaggagguugaugaguuuucaauuuguaucucucuuaguuggaaauguaaaaaaguuaagaaauaauagcacauuuuacuuacuggguguuuucacuuacaauaugucuuuguauaucuuccugugcuaguaguuucccucuaaaagauaagacuccuauacuuuuuuuugaagguguagagguugcauccccacagagggcuguuuuacucucaguauaccucaagaccucuuucuguuaauaaaagaagcaugauaaauuuuaauuauagguaagcagaccuggacccuaauuuaugcuaauuaauuuuaaguuccuagggucuuuaaaauuguuuuuuuaauuaaaaauauuuuguagagacagggucuuucuauguugcccaggcuaggcuagucuugaacuccugggcugaagcaguccuccugccguuggccucucaaagcacuaauauuacacaaguuucuagaaucuuaggaguguuuuuugaauuaugaucccuuugauaaaauagucauugggagauugcgacaaauaggaaaaauuagucugcaucuacuuagcuuuuccuauguuaguauauuugcucauuucaugcccuagcuagcuaugugaaaaauaguauuuaaaagauggaaagacuacuuugaucaguagaguuccugaggguaccaguauauuaguagcuugguauuuuucuuugauucuggcaaauacaugaagccccagucucagugaaaauguguuuuagaaagagaaugaugacacuaaaguuuuucuaguagccaaaaucuagaaaacacucuuaauuuugggggguuauuuuauuaccuauaagugaggggauuaaacuaaaucucgguguucaaaauauuucuguuuuugggauaaauagaugaaaauaaaagaaggaccgggcaaagguacauuuguaauauuucagacuguagaauaaugaaaucagaaaauuagugaguugacaaaugaaaguaacuuugaccuaaauaagaauguuaguauuuagauccagaggaauaggaaaagaaguuuuaaggcuuaaacuuauuucuuaggcauuaggaugucaaguguucgaggaacaguuucaucaaggaagcaggugucuguuucuuauuucauguguuuuugauaccuccauuguagagcuaucauguuuuagagaguacuauuaaaauaagguuguuuuccugaccaauaauauaccaauagauauauucaacacauuaaauguagauaugugauacugggaugauacgggguguguguguuuaugugggagagcuacaugguuugauguaagguuauuauaagcaaaauaauaagauucauaauuauuaucauuauuauuauaauuguauuuauuuauuuagaaucguuuugcuaugcucuccaggcuggagugcaguggcuucacagguaugaucguggugcacuaaagccuugaacuucuggucucaagugaucauccuguccuagcuucccaaguagcugggacuauaggcaugugccacugugcuuggcuucauaauuauuauauaauaguagauuaugccaaaaggcugauaaaaugaacuuaaauauauacacuggcuccaguaacuaaggacaccagagaaaggugauggagcugcgauucaccugaucuugaaugugcauucacuacacuggacugccucccuguugaucuuauuuaaauaugcuaguuauaaaaagcauucuaguauuuaguuaacaguuucacauguuuuacuuuuucuuuuuuugagacaggaucuugcucugucgcccaagcuggagugcacugccacgauggcggcucauggcaacucagccaaccccucaagugauccuccugccucagccuccugaguagcugggagugcaggugugcgccaccauucccagcuaauuaaaaaauuuuuuuuuguagagagagggucucccuauguugcucaggcuggucucaaacuccugggcucaagugauccuccugccucagccugccaaagugcugauauuauaggcgugguccacuauacucagcugcauguuuuaaauuuuaagggcaguagugauggugguaaugaaugauuugagcgagagacaaauaguguaguguuuaguacaauuuaaauuugaaaacuuguagcuaaccggggauauugagagccauuacauugacuuuauuuuuugaaccagggucucacuuugucaccaaggcuaaagugcagucuugugaucguggcucacugcaacuuccaucuccugggcucaagggcuccucccuccuuagccuguggaguagcuaguaccacacacaugugccaccaugcccagcuaauuuuuuugugugugagacggggucucacuugguugcccaggcuggaaugcaguggcgugaucuuggcucacugcaacuucugccugccaggcucaagcaauccucccagcucagcuucccaaguagcugggacuacaggcaugcgcugccauaccuggcugauuuuuuaauuuuuuguagagaugggguuucgccauguugcccaggcuggucugaaacaccuggacucaagcgaucugcccaccucugccucccagugugaugggauuacaggcaugagccacugugcggggcccacagcuaaucuuuaaacuuuuuuuuauagagacggggucucgccaaguuucccaggcuggucuugaacuccuggacucaagugaucugccugccucagccucucaaaguguuaggauuacggaugugggccacugcacccugccugcauugacuuuagaacuauguucaaaauuaggcucauuaaaaagaugaaucaucuaaauauuugaugacauccugaggauuuuagcaguuuuugcaaagcagaacuuugaaaauagcagucuuauugaucuuguuugccuuuugacuuuucuuuccuuacccauggcuagaaaagcauuaaaaggugaaagagucccaaaaggacaagugugugugauuguagguggaagggauagagaggcagacuuuagagauuauacacuuaagggacauuggguguuuuuuugggaggaaaaugguaaaaaaaaaaauaugagaaacaagguguggguguuagagaugaggaacauaaccuguaguguagaucuuuggaauauaauuuguagacugaagaaguaguuuuuuuguuuuuuuuuuuaauauauagacuuuauucauugguuaauuauuuugaauguacacaagauuuuaguuuuugucacuuaaaacuuuugucacuuuugucacugcuaaaauccucaggaugucaucacauauuaaucaucuuuauuuaacuuuagaaaauaagguggaagauagaaaauuucuauuaaagauaggcuaauuacuuugauauaggaaguguagaaaauggaaauauuauuauuuuuugagacagagucucacucugucgucagucuggagagcaguggugcaaucucggcucacugcaaccucugccuccuggguucaagugauucuuccgccucagccuucauaguaguugagauuacugcaccuggccaauuuuuauaauacaaauuauagaaaguaaaacgguagauuuuuggcucauggauuacauaaaaauuagugagaaagcauuggcaugggcuaaaacuugagaaacacugacagcuaagcuaugaggaugcaaaggaauaagaacaauggaauggacuuuggggacucuggguggggaaagggugggagggugaugagagauaaaagacuacacauuggguacaguguacaccgcucgggugaugggugcaccaaaaucucagaaaucaccacuaaagaacuuauccauguaaccaaacaccaccuuuuccccaaaaacuauuggggaaaaaaacaaaaaaagaacuuacaaccucccaagagccaauaaauagagacuucugggaaaaaaaaaauucuccugagaaaccgucugggcuaagugcuuuuuggugagcuaauuccuugauaguuuugucuauuuauucuguggaacuuaguuugcuuaagcguccucucucuacuagggucaauuuuaguaaacuguuuucauuaacaguuauccauauaauagagauucucaaauuuauuugccuaaagcuauggaaaauaaucucauagaauuuaaaauuuuuccucucuauaguuauuucucccuuaucaaugcuuacuuuguauauuuguauuacuaucuucuuuauuaauuuugcuagugauuuaucuguuuuguugggugcuuuuguuuuccccuaaguaaacagauuuuguuuaugaauuguuuuucuguucucugaccuuauuaguuuucacuuauaccuuuacaauuuuacucuuagacuuuguuuugguuucuuuuguuaucuuucuagcuauuugaguugggaauuuauuuaaguuuuaauuuuuuuuuucuccuugagacagggucuugcuguguugcccagacuggagugcgguggugcgaucuuagcucacugcagcuucugccucccaggcucaagggauccucuugccucagccucccaaguagcugggaccacaagcacgcacuaccacgccuggcuaauuuuuguauuuuuuguagagaugggguuuugccaugcugcccagccuggucucaaauucuugggcucucgcaauggacccaaaguguugggauuacaggcgugagccacugugcccugcuaauuuuuaauuuauguagcucuuugggcuugugaauuuuccucugaucucugcuuuacauuuaucccauagaucuguuaugcaaaauuuucacucauuguuuuucugaaauucuauaauuuauuucuccuuuucacccaagaguuuaauaaaaaguucuuuaauuuuuaaaaaaauugaggaacugcucugaugcauaauuuucaaaacaacuguguauuuacauucgucaaauuacuuucugcaagucuguuaguacaaggugacuugauguaacacuuuuugcuugacugaucuuuccuucuugccauauuauuuaaaguucuccugcauaaauuuuguguuaauuucaaauuagccagguguggguggcgcaugccuguaaucucagcuacucaggaggcugaggcaggagaaucacuugaacccgggaggcggagguugcggugagccgagaucgugccauugcacuccagccugggcaacaagagugaaacucugucucaaaaaccaaaauaaauaaaauuuuguguuaauuucauaauuuuuucugaccuguuuuuauuccucuauccugaaagcccacaagccuccuaguuuguugaaggaggggaaaaaagcagauuuuuuuuugaacacuuaaauuaaaaauuucuaugaaaggugcugcugcugcugcuacuccugcaucucuuguagaauucugaaaggcguugagaaaauaaccucagguuugcaaaaguccuuucugcuuccccauccacagauucuaucuacucuugagaggcuggacaauuuugcugugggacauuuuucccccccucuacgaaagcugucuggaaggaggccaguguggaagauauaacuaaacuugcuaucuuuguccuguuuacaaaagaacucugaauaccccucuauuucuguauucuuucuuuuuacaucucauagaggccauccucauaguugauauuuuuaaauuuaguauuuuuaguacagugugauuuguuauguuuuuacuauuguuaaaagguuauugaaugagcuaaauuuuagaacucuaaauaugauuuaaaaacuguuacuugcuuuaaauuuauuuccuauucaaguuauauaggcucauuauguuuuaaaaaaacaagaaacaaguagaaguauguaaagaguuaauccuagaugagucaguauacugaaaacaggaauuaagugaaagucugcauacugaaauauugaaaauauuuacuuaccauaccgaaauuaacucugguugauaguuaaauauggcuuucuggauuuuuuuuuaccucguauauacaaacagguauaccuuuauuuuacaugaaauucuauaacuuuauuuuaugaauaucauggauagcuugucgugucauuacuuguguauuuaauaucugccuuauucuuuucuucuuuuucuuuuuugagguggggucuugcucugucacucaggcuggagugcaguggcauucaaucacggcuuacugaagccuugaccuccugggcucaaacaauccuccugccucagcuuccugaguagccaggacaacagggaugugccaccaggccagguuaauuuuuuguuuuuaaacggagccuggcgacagacugcaguggcgcaaucuuggcucacugcaaccuccgccuccuggguucaagugauucuccugccucaguccucccgaguagcugggacuacaggcacgcaccaccaugcccagcuaauuuuuguauuuuuaguagagaugggguuucaccauguuggccaggauggucucaaucucuugaccucuugauccauccaccuuggccucccaaagugcugggauuacaggugugagccacugcgccggccaccagguuauuaauaaaaauuuuuauuuuuuguacagaugggggcugacuauguuccccacccaggcuguauuacaucuucugaagaugcaucugaguuguuagcuuccauggugaacuguggcuugaguggagauucuguaauaaagaccuucuauaaguuaacgaaugcuucuuucaucauaaagacuauguagugcacuacagcaucaaacuccugggcuuaagcuaucguccaccucagccucccaaguggcugggaccacagacaugcaucaccacgccaggcuaaugccuuauucuuuucaauguuucuuucuuuuuuuuuuuuuaguauuucauuguuacuggauauaccaucauuaaaaaaaaucggucccugauuauuuaacauacagguaauuuauaauuuuuuucacuuuuuuuuuugaaacagggucuugcucugucgcccaggcuggagugcaguggcguaaucuuggcucacugcagccuccagcucccagguucaagcgauucuccugccucagccucccgaguagcugcacuacaggcgcacgccaccaugccuugcuaauuuuuguaauuuuaguagagaugggugaauauuggucaggcuggucucgaacuccugaccuaaggugauccaaccaccucgaccucccaaaguucugggauuacaggcaugagccacugcacccggcugugaaauacuuuuuuuauuguggacaagaagaaggaaauucugucuaugccaguaagacuuugugcuccuuuaagacagacuuucuuuuaaaguguuuuuacuugcagaccuuaacugaguuucuuacauaggaaugcuaaaucuuuuuuuuuuuguaccuuuuuaaaauuggagauuaaagagaacauucuuuuucuuuucuuuuuuuggagacaacguuuuacucuguugcccaggcuggaguacagugguggaucucagcugacugcagccuugaccucccaggcucaggugauccucccaccccagccucuggagaagcuugggacuacaggcacaugccaccaugccuggcuaauuuuuuuuuuuuuuugagaugaggucucguucuugucccccaggcuggagugcaauggcgugaucucggcuuacugcaaccuccaccuccaagguucaagcgauucuccugccucagccucccgaguagcugggauuacaggcgucugccaccaugccuggcuaauuuuuguauuuuuaguagaggugggguuucaccauguuggccaggcuggucuugaacuccugaccugaggugauccacccaccucagcuucccaaggugcugggauuacagacgugagccacugcaccuggccaauguuuuguauuuuuuauagagaugcgguuucagcauguugcucaugcuggucuugaauuccugggcucaagcaguccucuccuauuggccuccuaaaaugccgggauuacaggugugagccauugcugccagccuguucuuacuuuuaagagaggaugauuugcauaaagcuagucaaauauauuaaguauuguuugccaugaaaacugguugaguaucucuuucuuugugaaagaaaauuaugcuaagacacaccaagauauuugccuccaaagauucuuuugaguuacauuuggaccuugggaaauaucugugauaauucuuaagucugaccuugcuugacagaacuaaaauugguuaacgguaaaugcgaauguaguuaguucaucuugggcaucagagagcauuguaaaacuugcuaauuauaguauccucugaguaagcugauccaucuuuuggcaaaaauuauguugugagagacuuuucauuugaaaauuucuuggcuacugacuuuaauuagcaguugauacuagaauggacuuucauggcguucacagccugggauggcccacgucaucuuuaaccuugaacucacugauguuugaauuauucaguagcuggcuuagccauauugaauuucaaauaaguguucaaugguguuaguuacuuauuucuaaaugguacacaacauuuuaaauguuuugcuauugauuuauagugacuaguuuccugucugauuugagagguucugacaaauuuuuuaagaaauggauguaaccaugaaauccuaaguagaggacccagcuaaccuguacccacaauccugauacacuugagacugugagauaaauuuguguuguuuuauucuguaugauaauaaaacuuacaaauaaaaugaaucuguguuguugaagcugcauaauagcaaucuaauaguaauacuaaaauuugggaguaugauagagcaggguugucuuaaagaagguuugacuuggguauucuaggacgauggauaaaguauuuacaagugaaugaucggcaagggcauuccaggcagagggaagagcugaaaagaggaaagacugaaaaaugcagcguauguuugaugcauggcuaauuaaccugugaguguuguguagcauaauggaagacaaaaccagaaaaggucgguugggccaaaauguggaggguuauagaagcugggcugacaaguauuuucugggaguaauagagaauuuuuaggcaggagauaauaauguaucuguuuuaagcagauuggggcauuugugggauuuauuauagagggcaggaaagacuggugggaggagauaaaacuuucuuuugucgucuuucacauuuuucucauugcauaccuuuuuuuaccuauacuuaucccacuugcagcuuuucaacaccuuuacuuaagauuuuuuuguuuuguuuuuuguagagccuguguugcccaggcuggucucaaacuccaggccucaaucuauccuuauuccuuggccucccaaaacacugggauuacaagugugagccucugcaccuggccuucuacuuuucugcgagccuccugaaguuuccacacauaaaagaggucuuggaauacucuguagcacaauacaauucucauuuuuuuuuagauagaaccugucucuacuaaaaauacaaaaauuagugccaggcgcgguggcucacgccuguaaucccagcucuuugggaggccaaggcgggcggaucaccugagguugggaguucgagaccagccugaccagcauggagaaaccccgucucuacuaaaaauacaaaauuagccaggcaugguggcacaugccuguaaucccagcuacuugggaggcugaggcaggagaaucgcuugaaccugggaggcggagguuguggugagcugagauugcaccauugcacuccagccugggcaacaagagcaaaacacugucucaaaaaaauaaaaaaaaaauuagcuggacgugguggcgcgugccuguaaucccagcuacucaggacgcugaggcaggagaaucacuugaaccugggagguggagguugcaaugagccgagaucauaccugugcacuccagccugggcaacagagcaagacucuaucucagauucuuuuaaaaaaguaaauauugauauauuuauuucugacaaaaaauuaaggauacuuuugccaggugaaaagcugucuuguuauugguuuggaauauaaaagucauaccuugagaacagaugugggggacaagaggggcaaccauuucccagucuuaguauuggauugcuucauauguauuucucagcucuguuuucuagcagauaaaagguaguaaaugacaaaguuuuaaugaaaaugauuuuucaaacuagauuucuuauagaccucccauagggaauuugcugauucugaaaguugucuaugaaaauugaaguuuugucaggcgcaguggcucaugccuguaaucccagcacuuuggaggccaaggcgggcgacucacgaggucaagagauggagaccauccuggccaacauggugaaaccuugucucuacuaaaaauacaaaacuuagcugggcgugguggcaugcacccguagucccagcuacuugggaggcugaggcaggagaaucgcuugaacccaggaggcagagguugcagugagccaagauggcgccacugcacuccagccuugcgacagagcgagacuccaccucaaaaaaaaaaaaaaagaaaaaagaaaauugaagucuuaagcuuuaaugacaaucuuaaaaauuguauauuuuuaacuuccugugugauuuugguauccauauuuaauggaguaggcagacaauagggaaaugaugcguuuguaccaaguaaaggucacagcugucaucauggugcauuaauggaaugaagguuucaccauaguuugaauaagaaaaugugguuacacguguccacagagcacaucucaggucucaugcaguuggaguuaagaccauugugauguaguuaacaguccagcguuaguuuaauuuuuacuuaaaauggaagcucauuguuuuauauuggauuuuuuuuuuuuuuuuuuuuuuuuuuuugagacggagucuugcucugucacccaggcuggaguccaguggcgcgaucucggcucacugcaagcucugcauccuggguucacgccauucuccugccucagccuccuaaguagcugggacuacaggcgcccgccaccaugccuggcuaauuuuuuuuuuuuuuguauuuuuaguagagacagggucucaccguguuagccaggauggucucgaucuccugaccucguuauccgccuaccuuggccucccaaagugcugggauuacaggcgugagccaccacgcccagccuauauuuggauuuaaaaaaaauuuuuauaacauuuuuauuuuuauuuuguuucugagacagagucucgcucugucauccaggcuggagugcaguggcaugaucucagcucacugcaaucucugccuccuggguucaagcaauuuuugugcuuccaccucccaaguagcugggacuuaaaggugcgcgccaccacaccaggacaauuuuuuguauuuuaguggagaugggguuuugccauguuggccaggcuggucucaaacuccuggccucaagugagccacccacuucagccucccaaagugcugacauuacaagcgugagccaccaugccuggccuaaauuggauuuaaauuguaaauuuuagccuggugcgguggcucacaccuguaaucucagcacuuuuguaggcugagguggguggaucaccugaggucaggaguucgagaccaagcuggccaacauggcaaaaccccuuuucuaaucaaaauacaaaaaauuagcuaggugcgguggcaggcgccuguauucgggaggcugaggcagaagaaucgcucgaauccaggagguggagauugcagugagcugagaucgcgcuauuguacugcagccugggcaacgagagcgaaacuccgucucaaaaaaaaaaaaaaauuguaaauuguaaauauguuuuauuuuuguaauuguguaagagcaauaagccuaagagauuuauaccuaguauaauuuaguaucauuuguguguauguucauauaaaauguaaaauguuguaacuuaaccugguacagugugaccccugagaauuuuuuuuuuuaaauaguacuaaaguuugagauauacuacuuugacuugauguuuucugugauuaaguaaaagauuacccugugcccaaaacuaaauauaacuuuucaaaacauguucuuccuuuuauaguucauuuuccuuucuuuuaucacaauuuaaaaagcuagagucaucaucuguguuuuuaaggucaccugccacuaaaagucuuaauggauuuuugaaaucucuuuucucauuuccauuuccaauuccugugccuuaguugcuguaguuugcgaaacuggauuucauuaccugucuauuaaagcucucuccaauccaucugaccacccuguuuuuguuagaauaaucuuaaaaugugagucucguuguaauguuucuuucuuaguuuuuugcuaacuccucaccugccaguaagguaaauugaaggcguaucgccuggcauuaagaguguuuucuuaugaucuugcccuugccucuguucaguucucuuuuacuguugcugcuuuugugcccagugcuccaccguuaacgagugguucaugaaacaugccauuucuucuggacauaccuguuuuguugcuuacuuuuucugaaauucccacaccuuucuucacuuaauugaguucacuucuauuuuuauuuuauuuuauuguauuuuuuuuuuuuuugagauggagucucgcucuguuacccaggcuggcgugcaguggcgugaucucagcuuacugcagcccccaccucccggguucaagcaguuguccugccucagccuuccgaguagcugggauuacagucaccugccaccauacccagcuaauuuuuguacuuuuaguagagauggaguuucaccauguuggccaggcuggucucgaacucccgaccucaagugaucugcuugcuuuggccucccaaaguguugagauuacaggugugagccacggcacccgaccuguuuuuuuguuuuguuuuguuuuuguuuuugagacagagucuuacucuguucccgaggcuggagugcaguggcgcgaucucggcucuuugcaagcuccgccuucuggauucaggccauucuccugccuuagccucccgaguagcugggacuacaggugccugccaccacgccuggcuaauuuuuuguauauuuuaguagagacaggguuucgccguguuagccaggauggucuugaucugcugaccucaugaucuacccgccucggccucccaaagugcugggauuacaggugugagccacugugccuggccccuguuuuuauuuuaaguuccagagaacucauguccggauaaguuaauuacuuccugcugugagaauuuuuuuuuuuuuuuggagauggagucucgcucuguugccaggcuggagugcaguggcgcgaucuuggcucacuacaaccucugccuccuggguucaagcgauucuccugccuuagccuucugaguagaugggacuacaggggcguaccaccacgcccggcuaauuuuuuguauuuuuuaguagagaugggguuuuaccguguuagcuaggauggucucgaucuccugaccuugugauccacgugcuucggccuuccagagugcugggauuaaaggcgugagccacugugcccggcugugagcugcuuuaguuugcauuuuaaaauuugguuguauuuaaaaauauuguauuguaaugaauuuguccaucugucuuuccuaccaaaauaagagcuuuuuugagggcaagaauuaaugucuucuaaaaaucuuacguuuuggcugggcgugauggcucacaccuguaaucccagcacuuugggaggccgaggcagguggaucaccugaggucaggaguucaagaccagccuagccaacauggugaaacccuaugucuacugaaaguaaaaaaaaaaaaauuagcagggcauggugguuuguaccuguaaucccagcuacuugggaggcugaggcaggagaaucacuugaaccugagaggcagagguugcagugagcugagaucaugccacugcacuccagccuggccgacagagcgggauucugucucaaaaaacaaacaaacaaacaaaaccacaaauuauucuuuauccuuaacaccuguuguguaguaugcacacaauaggcauuuaauaaauacuugucaaauuaauuugaaauguauuuuuugacuaauuuuuccccuucuuguggaacuggauauuuagaucuuggccgucuaauguauuaaagauggauuaagugguuggagaauggaaucaggaaucauauguaccaucauacuuuuguaauuguuuauauccugauacaugccauuguaauauaagugaagcuccuuaguuuuucggugccuuaaaacacuguaauuucuaaauuucuuuguuuggcuuuguaucaguuuuagguauuuucuuaauuauauccaaucaaacauuuuguuagcccuccuuauugauguccuagacauacauagauuuacuucacuuuaguguuugugaaacuugguucuaaguuaggauuaaugcauuauuuuuucacucuauuaauacugauauuuaaaauuuaguuaggagaauguguaacauaaguuuccuccguuucacaaaaguuaaaugaauuuuuuaaauauaggaauaauaugacauuaaauuagcuggaaaauagaggaaaauaaucccucaucauucuaccaucugauacaguacaguacuuuggaaucugaucuuccccagucugccugcuaucauuuacuuuguuaaguuugauuuguuggguuuuguugaggauuuuugcaucuauguucaugagagauaugggucuguaguuugauuucuucuaaaacuggccugauagaaugaguuaguaaguacagaugcuucuugauuuacauaggguuaugucccaagaggcuuauuguaaauugaagauauccuaaguugaaaauacguggcugacuaggagcuugguuuugcuguugcugcccagcaucacaaguaugguuucuacugaauguguauggcuuuugcagcaacauaaacuugaaaaaucaaaucacuguaauuggggacauuuuguauuccuucuguuucuguuuucuggaagauauuguagagaauugauauaguucuuuaaguauuuuguggaguucacuaguaaacccaucugggccugaggcuuucuguuuugaaagguuauuaaugauuaauucaguuucuuugauagaugauaggccuauucagauuaucuguuuuuucuugugugaguuuugucagauugugucuuucaaggaauuggccuuuucuucuguguuauuaaguaugugggcauagaauuguucaagauuucuuuauuuuuucaauguucaugggaacuguagugauauuucuucuuucauuugugguacuacuaauuuguuugugucuucucucuuuuuuacuuagccuggcuagaggcuuauugauuuuauuggucuuuccaggaagcagcauuugguuuuguuaguuuuuucguauugauuucuuguuuucaauuucauuguuuucuguuauaauuuuuguuuucuuauuuguuacuuuggauuuaauuugcuuuucuaguuuuuaaaaauggaagcuuaaguuuugauuuuaguucuuuuuguguuuuguuuuuuuggaggcagggucuagcucucugucgcccaggcuggagugcaguggugugaucucagcucacugcaaccucugccuccugggcucaagcaauccucccaccucagccucccaaguagcugggacuacaagcaugcaccaccaugcccaauuaauuuuuguauuuuuuguagggaugggauuucgccauguugcccaggcuggucuugaacuccugagcucaagugaucaccagccucggccuccgaaagugcugggauuacaggcaugagcaccacacccagcauagaucuuuuuuuuuuccucugagauggagucucucucugucgcccaggcuggagugcaguggcaugaucucggaucacugcaaccucugccauccggguucaagcaauucucuugccucagccuccugaguagcuaccauuacaggcaugugccaccacgcccggcauuuuuguauuuuuaguagguacgggguuucaccauguuggccaggcugguccggaacuccugaccucauauccaccugccuuggcuucccaaagugcugggauuacaggcgugagccaccgcacccagccagaucucuuuuucuaauacaugcauucagucuuuaaauuucccucuaagcacugcuuuugcuauaucccacaagcuuugauguuauauauauauuuuuuuguuuccauuuuuuuuuauuuuugaggcggaguuucgcucuuguugcccaggcuggagugcaguggcgcgaccucggcccacugcaaccucugccucccggguucaagugauucuccugccuuagccuccggaguagcugggauuacaggcaugcgccaccaugcccgguuaauuuuguauuuuuaguagagaugggguuucuccauguuggucaguacucccgacgucaggugauccggccgccucggccucccaaagugcugggauuacaggugugagccaccaugccugagcauuuauuuuauuuuauuuuuaagagacaauguuuugcuauguugccuaggcuggucucaaacuccugagcucaagcaaucugcacaccuuggccuuccauagugcugggauuagaggugagccgcugugcccggcaaaauauuuuaaacuuauuuugagauuucuuauuugacccauguguuauuuagaagugugcuguuuaguuuccaaauauuuagggguuuuccaacuaucuuaaugauuucugguuaaauuccacuguagucugagaacagacauguaugauuuguuucuuuuaauuuguuaagguguguuuuauggcucagaauguagucuaucuuggugaauauuccaugugagcuuaagaaaagucuguuuacuuugcagagucuuuagcuccucucugcguuuuguccagguuguauagcuacauucagugggagugacaggguggaauaugcuuaguccauuuuaagaauuggaacucaucccuauauuuugagguauuucuuucggagagauuggaaauaugguuacuuguaauuugcuucuuugauacguugcuuuauuuaagguauauaccuauuuguaaugccaccagcaauguaugaaaucacuaguuuugccacauaagggauauauuuuaaggguaacacuuuuugcuuaaaaguuauaagacagcuuggaaguucagcuauaauuaaauaauauugccuuaaaugguuagaaaaguauaaaauauaaguaauuaaauauauauuucagucugagguuuuucauguaaaauucagguuucuuagcugggugugguggugugugccugcagucccagcuacuugggaggcuagguuaggagaaucaacuugagccuagcaauucaaggccagucugggcaacauagcaaaacccugucucaaaaagaaaaggccaggcgugguggcucacaccuguaaucccagcgcuucaggaggccaaggcaggcagaucaccugagguaaggaguuuugagaccagccuggccaacauggugaaaccccgucucuacuaaaaauacaaaaauuagcugggugugguggcaggcgccuguaaucccagcuacucgggaggcugagacaggagaauugcuugaacccaggagacggagguuccagugagccgagaucacaccacugcacuccagccugggcaauaaagagcgagacuccaucuccaaaaaaaaaaaaaaaauuagauuucuacuuacguucacuuuauuugucaccauuucuucccuuuaucaauuucccucuuuauauuaggcuuuaaauuuuuuuuuuuugaggcggggucucgcucugucgccaggcuggaguacaguggcgugaucucagcucacugcagccuccgccuccuggguucaagcaauucuccugccucagccuccugaguagcugggaguacagguauguacuaccacgcccggcuaauuuuuguauuuuuaguagagaugggguuucaccauguuggccagaauggucuccaucucuugaccucaugauccgcccaccucagccucccaaagugcugggauuacaggcgugagccauugugccuguccaaaaaaaaauuuuuuuuuuuuuuuggaauguagacacaauggagaugaggaggacauggcugcuauggaguaaaggaaggcaccaaacuaauauacccgguuugugauggagaggccauuuugucauuuuguucugaaaccuuuucuggcuuucgcuauauaggauaagggauuuaggcagagaccaagggaaauauuauaaauauuaucaauuuaaaagaaucaguuguuuguaucuguaagcuaauggagggagcaguucuuugguaauugucuuagguucgcuuaggguaggaucaauuugcaaacacuaaaucucagugucauauauguggagauucauuguauucagcauugaauguaguuaaauauuuauugagcacuuacuauaugccaggcacugcucuaggaucuguggauguagcagugaacaaaugaggaaaaauaaaaucccugccuacagaacugcuuaaacccaggagauagagauugcagugaguugagaccgcgccacugcacuccagccugggugacagagagagacucugucucaaaaauaaauaaaauaaaauaaaguaaaauaaaaaucccugccugcauggaauuuaacagauuuguagguaggggugaaagauggacaacaugguaaauaaguaaauuacaguauauaguauguuagugguaagugcuguggggaaagugaaagcuggaugacuggggaaugcugggcugguuuugaaguaguucgugauuuaaauaggauagucagggaaugcuucacugagaaguugacauuugaccaaacauaugaaggcagugaagcuuugcauacauccaggaaaagagcguucuacauugguggaguagauggugcaaagauucugaagcaggagagugccugccuuagucuaggaaugaugagguagccaguguagcuccaugauuaauuggaaguuuauuccacgaaugcaaagcuacuuuguuauuagaaaaauauugauucauuaaauuacuaggucaaugaugaaaacuauaugcagagauggguacauauagguacaauccuugucccagcuacccagacaaagauuuuauuuccuagacucucuugugucuagauagugccaagugacuauuuuugcaguagaaugugagcagaaguaauacgugucacuuccuagccaagguacucaagaauagggugugcuuuuucucuguguucucuuuugggguuggauacagaagaacuccauggcucaccacauggcucaccacauggcuuaccacauauuggaaagagccuuguuuuuugaauugcuuuauugagaaaagcugcccaucuccccccccccgccccccccaaaaaucuaacagccaauaacacaaugaugauaaauugcuagagacaaguauaugaaaaaauuagacaugugaugaagaaacuugcuaucauuacuguuauuuggcauuauucuagaacuuguagccuauguaguauuaaaaaugagguauaggacacugucccagcugccaccuagacucgucuccaucgaggaccccuuugaccagaaugacugggccacuuggaccucguuccucucagggguggacauccagauugugggggaugaccugacagucaccaaccccaagaggauugcccaguccuuugagaagaaggucugcagcugucugcugcugaaggucaaccagaucggcucggugacugaaucgauccagguaugcaaacuggcucacucuaacggcugaggguugauggugagccaccacucuggggagacugaggacauuuucauugcugaccuugugguggggcucugcacaggacagaucaagacuggcgcccccuaccccuuggagcgucuggcgaaauacaaccaacucauuugaggauugaggaggcucuuggggacaaggcugucuuugcuggauacaaguuccguaacccgaaggccaagugagaagcuggagacuccaggacuccacuggacagacccaggucuuccagaccugcuuccugaaauaaacacuggugucaaaaaaaaaaaaaaaaaaaaaguauaggccaggugagcaguggcucaugccuguaaucccagcacuuugggaggcugaggugggcggaucaccugagguuaggaguuugagaccagccuggccgacauggugaaaccccaucucuaauaaaaauacaaaaauuagcugggcauggugguacaggccuguagucccagcuacuugggaggcugaggcaggagaauugcuugaacccaggaggcggagguugcagugacccgagauugcacugcugcacuccagccuggcgacaaagugagacuccgucucaaaaaacaaaaaacaaaaauuagguaugguggugcaugccuguaaucccagcuacucgggaggcugaggucagagaauugcuugaacccgggagacggaggcuguggugagcugagaucacgccacugcacugcagccuggccgacagagcgagacucugucucuaaauaaauaaauaaauaaauaaauaaaugcauuaucaagauuguguuucugucucucucucuuuuuuuuuuuuuugagacggagucucgcucugucgcccaggcuggagugcaguggcacgaucucggcucacugcaaccucugccucccgggaucaagcaguccacucagccucuugaguagcugggaccacaggugugugccagcaugcucggcuaauuuuuauauuuuuauuuauuuauuugagacaagagucucacucugucgcccagccuggagugcaguggcaugaucucagcucacugcaaccuccaccuccuggguucaagugauucuccugccucagcuucccaaguugagauuacaggcaugcaccaccacacccagcucauuuuuguguuuuuagcagagacgggguuuuggcauguuggccaggcuagucucaaacuccugaccucagggaaucugcccgccuuggccuuccaaagugcugagauuacaggcaugagcuuaauuuuuauauuuuuaguagggauagaguuucaccauguuucccaggcuggucucuaacuccugggcucaaagcaauccacccaccucggccucccaagaagugcugggauuacagaugugagccacugcgccuggccuguuaccaaguuacuaucuauaaagguguaucauuuuacccucuccacuguuuaguguguaugugccugucugauucaacucuugaagaauuuaauauuaccaguuuaaaaaucuuugcuauuuuguugagugauagauaaacuuugagguaucugucaaaaggaguagggaagguaugucauauacagagcagcaugagcgaagguggcaugcuggcagugugugagcggcacugucugccagagcugaggagguucuugagggauauguguguugcaggacacugaaaguuucuauuuggauguguuucuuaauggcuugugcucuacaguaagccuguucuugacaucagcuccucaagacagacacuggcagcagucucuuaaaauggcuuacuauagaggaugaguggaauaggucauagucucugcugcaguagcugguuccaaggccguauuaauauucaucaucuccuucugccacugccuagucuagauuuccgucacucauggccagacugcagcugaucaagguugcuugccugaagccaucauuccugaggagucuaagccccuauuucucuuuuccauaucaugccuuugccauaugcuguacuugccuuuuaucauuagauguggaagcacugaggagcaccuacuagguuaagcuacaaauugcugucaccuucagagccaccgaagugguuggcucuucuuuuugaggaauuauaacaggguucugagaguuggauucugcugaugacaaguuggacaacucagcagcagcaguggcucuuuucauuaauuagcugacaaaaccuuaggcaaguuauuuaauuucucugcacuucaguuuucacaucugaaaaaaaaugggcugauaguaucuaccucauagguuuauuguaaagguuaaauaagcuaauauaucuaaaucacuuagaauagugcuuggcaguuaaaugcuagauaaguauuaacuguuaguguuauuaacucuaaagaguuugaagagaguuugguugagagcuuuuuuucuugaacuagggaguguguauaaccuccagacuuuuuggauaauuaaaagaauccaagcuaggaaagacuaaacccaagugacuugauagagcuguucagaauugagggaccccuagguaaacuaugcccaugagcuuacaaugucagcuucuguaaucuucucuguauaucuguaggugccucucuguauagguuucguauuuaaguauucucagcuacuuuuacacucaaguuucugcgcccaaaucuguaaauuuauuugcauuuucccucaccuuuuauccuuuuuuaaaaagaggcauuuuuacuagugucugaagcuaaucuugccacauauguuccuaauuccaucagccaaccauuaaguguuuuagaucugucauauaauaggcacuaguaauacuagaugaauaaggcugggcauggugguucacacuuguaguccuagcuacuugggaggcugaggcaggaggauugcuugagcccaggaguucgaggcugcagugagcuaugaucauguacuccagcuauaaaacugcaugccaccuugggcgacagagugagucccugucucaaaaacaaaaaaacggugcacugugauaagcaguacuggggauguauacggugcugcuauaggagcauggcuauuuuugaagccaugggaggaugaaaauguccaaggagaguagacacugaggagaaaagaacccugaagaagaccaacauuaaaagacuguggagaaugaggaaguugcuaguagagagguagaguagagugaaccacaagagucuagugugacagaagcugaacagaaaagugcaucucaggacacagguagugaucaguagauaacugcuaaacagccagguaaggacuuuuucccucuuuccuccaaaggcucuguuagaucacauuucugucuaaauaccauguguuccuuguuacucucauguguugagcuccugaacucaggugagugaguguauagugaguuugguagcugagggaaaccgcauccucugaauucauuuuguucuugaguaucaaaucggaacuaguaccucaagcucagauaaugagggauuugucaaaaaccguaugugaaauuacuugccacucaugguggaaagggggaagaugggauaugcagggauauuugggucucccuuaugcugguucagugcaacuucauuugacaaaacaauuauuccucaauuccacauguucuguuuccuuuauuguccuagaaagaguuguuuuaauccccuauuacuaccuuuagacucccagucagugcuaaauccccucacaucugauuucuucccuccgcauuaaguggaauccgaauuuacaaagcuaauuaaacaucccuuuguugacaaauacaggggauacauuucuguuguuaucucagcuucuaggcagcauuugacauuguugaccaccuaaaccuuagaauacuuuugucuuuucugaaacagcaguguuuucugguuuucuucucaucucucuggucauuuaguuuauuuccuaguuuuucuucucuggcucuuaaacguugauauauuguucuauagcagaagcccucaucucuucucacucuauauuggcugaucugauuuacugguauggcacaaguuacccuaauuaaagcuuuugggcaguaaaugagccuuuuaacacugauagaacuuuauauauagaucacuguguuacuuauuuggacauuuaaaauguagcagucauauagauuauacaaaauucagacucugcacaucuguauaucuggaaugaacucauaauguaauaguaauugaaauauucccguuauuuaggcuagaaucaaacuugaaucuuagaggcaacucaguuauucucgaguguuagaaaauauaauuuuuaaauccuuuuuauuaacugaauugggaaucuacaagcuaagaaguaaauauauuaagcacccuuuaaaaaucuagcuuuaaaucuauguaguguugauuuuaguuauucugagugguuauucauauugucauaaaguaguuucuaaaaauuguacuuuaaaguuuccaugagcaguucaguggaaugagguuuguuugauaaacacugcccuccugugguuaacguaagcuaacaguuuugcaaaacuacuguagucauuuccgcuuguggaagauaauguaaugguucauacagcauguuugcucaguaauauauguggccaagaaaggguuuuuuucccucauucucucccucuugguuuuuuccuagugugucugcacauucuucucauuucuauccaugcacauuuucuuucuuuuuuuggugggggaggcagagucucauugugucaccgaggcuggaguccaguggcacgaucucggcucauggcaacccccaccucccaggcucaagcgguucucgugccucagccucccgaguagcugggauaacaggcgugugccaccauacccagcuaauuuuuguaucuuuaguagaaccaggguuuggucauguuggccaggcuggucaugacugagcccggcccaugcacuuuuucuuaugugaauuauaagaguuaaauguaaacgaauacagaaaaaguauuaagcuaucaaagggagggaagcuacauuuaaguguaaacaugcuuaaagaaauagaaaagaccagucaguuacaauacauaaaauuaauaaaaacuuuaauggaaaaucaauagugauaaaaagaugaagaauaaacuggaagaaaggguuuguaguaaaugugacaguaaauguuucaauauauuuaauguaaauuagagagcucucacaaaugguauauaaguggacaauagccaaugaauagccaauucacaagugaggaaauacaguaauuaaagcacaaaaguauauuuaaauccauaaugcugcuuuauaaaaugauacucauauuaauagugguauuugaaacagaaaucaaaucaccuuuggagcaugccagaaaaccagcuaauuauucugaaaacaguaaauacaaaaauaaguuacuuauccugcccuuuucuuucuuucuuuuuuuuuuuuuuuggagaaggaguuuugcucuuguugcccaggcuggagugcaguggcacaauguuggcucauugcaacuuucgccucccagguucaagugauucuccugccuccugccucagccuucggaguagcugggauuacaggcaugcgcccccacaccuggcuaauuuuuguaguuuuaguagagaugagguuucaccauguuggccaggcuggucucaaacuccugaccucaggugguccaccugccuuggccugcugggauuacaggcgugagccaccgcaugcagccuuauccugcuuuuuuaauaugaauuguaccucggguaaccaaauagauaguggaaagcaucuauuuuuagaaggacucuggcuuauaaaugaaaaaggaacgauagacuaucagcacuuuccagccccuaaauaaaaugauggagauagugaucaucgguggcugcuaaaacaauuagauugaaaugcugaugggaaacuuuauaauaaguggaucagauagaccacaucuaucccacugauauaucuuagcaucucaaaaaagagaucauagauguuuuguguguucugauguggugugguaggaaguauaccauaagccuaugaaguuuucuugcuaaaauaaaaucugaaucugagcaagccucuagauuucgauucuaauuuucaggaaaugcaagggacagaggaccauacgauuagcaaaauacagaauguguguaacuacaauacaguuuacuaguuuuuucucuaaguaaauuggaagaaaaagugagagaaacccauagauuaaaagauacuucaagacauguguuagccaaaugcaguauaugugggucuauugauuugaacaaaccaacuguuuaaaaaaagugguuuuucccuguaaauuugggacauugacuaaauaauuugauauuaaggaauuauagucauuuucugagguguaaaaaaaaaaauuuaaguccuuguuuucagagauauauacuacaauaauaaugaaugaaaugucugaggcuugcuucagaauaacccaguuuguggacggagggugucugaagguauggaggaaacaagauaggccauguguugauaauuguugaaaaugggugauggguauguggugguucauuguaauguucucucucauuuggugaauuuuuuuuagauuuccauaauaaaaaguuuuaaaaguguaauauuuaagucuuuaauugaaaaacauuuuucuuucuccccaaaacuauagcuuuaaguagucugaaaaaauuuaguauaauacuuuucuaaauuaaaacuaauuuuaggccaggcaugguagcucacaucuguaauccuggcacuuugggaggcugaggcagguggaauguugagcccaggaauuugagaccagccuggacaacauggcaaaaccccaucucuacaaaaaguacaaaaacccagcaguucgagaccggccugggcaacauggcaaaacccugucucuacaaaaaaauacaaaaauuagccaggugugguggcauaugccuauaguccuagcuacucaggagacugagacaggaggauagcuugagccugggaggcggagguugcagugagcugugauugcaccaccgcacuccagccugggcaauacagugagacccugucucaaaaaagacaacaaaaaacuuuuuuuuuuuuuuuuuuuuugagucagagucucacucuuucauccaggcuagaguaccguggcgcugucucgucucacuguagccucugccuccuggguucaagugauucuugaauucuugaaccagccuccugaguaacugggauuacaggcgcccagccaccaccacccccagcuaacuuuuuguguguguuuuuaccagaggcagggaaucuccauguuggccaggcuggucuugaacuucuggccucaagugaucugccuuccuuggccucccaaagugcugggauuacaggugugagccacuguuccuggccuaaaaaaaaacuaauucuaaaugccuagcauuuaaaggaaacugugauaaacauuuuuuuaaaagaaaauaaauauuccauauauauauauguaaauuuuuuuuuuuuuugagacggaguuucgcucuugucauccagguuggagcgcaauggugugaucucagcucacugcaaccuccgccuccugguccaagcgguuuuccugccucagccuccguaguagccgggacuacaggcaccugccaccaugcccaguuaauuuuuguauuuuuaguagagacgguguuucaccacauuggccaggcuggucuugaacucuugacuucuggugaucugcaugccuuggccucccaaaguacugggauuacaggccugagucacggugcccggccuccuuaaguaguuuuaaccaacugguuuacuguguuugauuaaaguacagaacaucuuggaaaucagugaaauccuuacuaaaaagacauaauuuuuggucuccacuucuauuuauuuauuuauuuguuuguuuauuuuugagauggagucuuccucuugucacccaggcuggagugcaguggcccaaucucggcucacugcaagcuccgucuccaggguucacgccauuucccugccucagccucccaaguagcagggacuacaggcguccgccaccacgcccagcuacuuuuuuuguauuuuuaguagagacaggguuuuaccauguuagccaggauggucucgaucuccugaccuugugauccaccuaucucggccucccaaagugcugggauuacaggugugagccaccgcgcccagccggucuccacuucuaauagcuuaacaucuuaugauguuuaaaacccauuaaaauauuaaaauaacuuaauuccuuguuuugcagaauauauuagaaaguauuaauuuuuaccauuaacauggauaauauaaauauuuucaguucugaguguggcucauucugauaaugauuuaauaguccccuuucaguuaagauuugauaugccagagaaaugacacucuagaaauauuuauuaauuucaguuuucuggcuccuuggacagauguaugugugcauacauagccauuucaugguguuuauuauugccauguuuuugccauuuaaauuggcaggaaaaaacccacauuaaaauguauuacauuugauugcuaguaaagucaaauaauuguauuucauuugcuucauaaauuuuuauaggauauugaauauguacacaaaaguggacaauaguauagugaauaucuuuguuuaucauuuaccuucuauaauuaucaauuuauggccaaucuugcuauauuuaaaccugcaacuucuuguauauuuuuugaagucccagacaucauaugauuucauccguaaguacuucagugugcaaaugcuuuuucauaugguugugauccaguuauauuaacccuuuugugaacuauuuauccagguccaugguguauuuuuguuuauuuucaguacuuuaauacauuuuuaguauauaaacaauaaauaaauagaaguuuucuguaugggccuuaacuuggaugaaggcaguaaguuuaacuuuggacaucuaaaguuugaaaugcaugugggauauccaaguuuuacaaguuuuuaauaguuuuuuaacagacugccgcuucaucaaaacgugaguggugaaagcuuggugugguuaauguuauuaagggaaauuuugguggagugaaaaguaaaagggguaaauggauguuuauaaaauauuugagggaugggcauagaaaaagacaucuacaaagaaaacugagaaaaauauuuuggggaaaaagaagagucuaggaggugaugucugcgaagggaacaguuuaauaauguuagauguagcagagagaucaaggaagaugauacacagaaauauguguuggguuuuaugacugaccaaaugagaaaguaguuacaaacacuggacacagcaugcuauaguggugcaagacuuggauuugaauuuuggcgccacuuaucuugcuguauuauguuuggaaauauuacugguuauuguauuuuuguuucauauauaaauguaaguguaaacaacaaaauaaaacauacaugaaauauacguauauaucuguugagacucuuagcuauuuguuucaagaauauucaccagacaucuugaagcauaguuauaauagcuacuuuugucugauaauuccaacaucugugucacauuggguuuauuguuguauauagcuugucuuuugucuugugaguugcugauuuccuuacucuuccuguguugaguaaguuugaauuguauauuagacauuauuucuauuuuugagacaggcucuguugcccaggcuguagugcaggggcacaaucucggcuuacugcaaccucugccugccagguucaagcuauucucacaucucggccucccgaguagcuaaaauuauaggcgagcaccaccaugcccugcuaauuuuuuuuuuucuuuuuuugagauggagucucgcucuguugcccaggauggagugcaguggcaugaucccagcucacugcaaccucugucucccagguucaagugauucuccugccucagccuccugaguagcugggauuacaggcacucaccaccacgccugacuaauuuuuguauuuucaguagagaugggguuucaccauauuggccaggcuggucuugaacuccugaccucaagagucaucuguccgccucggccuuccaaagugccgagauuacaggcaugaaccacugugccuggccaagaugaaucaugggaauuccucccaugcuuguaggaccccuugcaagguuagccacugcugguauuaccacagcugcucccaugcgauugccuggggcaagggcggagaaaaaggaaaggggggaaaaacccagauaauuuucucucccucuauccaaccuuuagaaaugcccucuuuacugugccucagaccaaaaaauauuuuucucuuggagcacuuucugccugcacuuagucugcaguuccggguuuugggcugccuuuaaguccaggcucaggggagcuaccagagggaaacaaaaucaggaaacucacugcuggacuagugugguacugcuaguugugcuuuccuccccaggccaggccaccugcuaccauuuucggaguccucaaauagcugcuucaugcauucuguccagguuuuuaguugcauucagugggagagacagaauggacuuugccuacuaugucuuuaccagaaccagaacacagauauuacuuuaauuuuauuauaaucauauuguuuacuuguuuugguuaagaauuuauugugcaccuaugauuuaguaggcuuugcuauacauuuaccaggaaauggauaaucuuaaugugcuugcaguaggucacagguagugaagggauguggggauggagggagaaaguaaacaauugcauauguauuaguagugaauaauuggguuauuaauuuuagcuuuuaagacguaauuauaagaaauauauauagaauuauaauaacuugaaauaagaaauaauuuauuauuauauacuuguuuuucaggucuuagaaaaauaccccaauacacccaugagucauaaagaaauucuucaaguuauccagagagaaggacuaaaagaaaucaggugaguuauuuaaauauuuuuaguaauaauuauaauacuugaucagaguauuugguaguauauaauaguauacuuuaguccugaagauuaauuacuuaauaauaaaugcuuuguucugaucagaugucagaucuuuggcauuuuuuaagucauuacauaguuuuaaaaccagaaaguuuuaaaccagaagguuuuaaaaccaauucuuagaggguagcuaucuuuaagcccaugcacuuuaauuuuuaggaagaccuggagccaucuucaagccuucaucugucucuuuaggcuuuuugauuuaauaaacuuggucauuagugauaaaaauuacucucauacagggagaguccuagagguagacagauagucccagaagaaauaaugcuggcuaaaaaggauaaaaugaaaaagaacuguaaagcaguauauaugucaaauaauagucuuaacauguucaaauauaauagacuugggccauuaguacaggaucaaagauaacacagacuuuaauuucuaagaaccuuauuauauuacaauagcaggccaggcaugguggcucaugcuugugaucgcagcuguuugggaggcugaggugggaggauugcucaaggccaggaguuugagaccagccuggccaacauagugaaaccucaucucuacgaaaaauuguauuaacuagaugugguggugugcuccuauaguauuucagaggcugaguuggaggauugcuugaguccaggaguucgaggcugcagagugcuaagaaggugcuauuguaccccagccuuggugacagagcaagaagcugucuuguaaaaaaaaaaaaaauuacaguaauacuuaauagucaauguguguguguguuuuuuuuuguuuuguuuuuuuuguuuguuuuuuuuuuugagacggagucugacuuugucacccaggcuggagugcaguggcacgaucuuggcucacugcaacucugccucccggguucaagcauuucuccugccucagccuccugaguagcugggauuacagacacgcaccaccaugccuaauuuuuguacuuuuaguagagacaggguuucaccauuuugcccaggcuguucucagacuccugagcucaggcaaucugccugcuuuguccucccaaagugcuagaauuacaggcaugagucaccaugccuggccaauagucaguguucuuaaucaagacucucuaucaucaagaaauguuaaaauuauauuaaguaugcucuguauauuaagacagaaauuugggagucuauguuagauuuucauuaagauaggaaaaguuugcagugcuuucaaacuacugguuuucaacuauagguggcauuguguaacacucuuggagaaagaguuuagaauuuuggggggcuguuuuugaguaucacagugauugggguaggggaacacaauggcauuuagugggcagguaacaggaaugcuaaauuugcauuguguuggacguugcuucacauugaauaguuuuucaucucaggugccaauaguguucccauugagaaacaguaagcuaugcccaaauauuuguaaauagacaguguauuucuugaugaauagccauugcauguucuagauuuuauuucucauuuuuucuuucuuucuuucuuucuuuuuuuuuuuuuuuuuuaagagauggagucucauuauguugcccagccuugagugcaguggcuguucacagccaugaucaugguguacugcagccuucaacuccuggccuuaagugauucucucaucucugccuccugaagcugggacuaugggcacucauuuucuuuucucugacgugaaauucuaguugaguuuuuuuauuugcucucccuuucuaaagcaguuuaaauucuuuuuugauuuauagucaaacuucaguagguugaaauaaguuagguuugcuucauugguaugaaaaaguaaaauauauuaguuuaccuuacuuuauauaacacaucccugaaaaauugaguguaaacauuuuaaaauuaaaacauuaaaaugcauuugaaggccaggugcaauggcucacgccuguaaucccagcacuuugggaggccgaggcaggccgaucaccugaggucgggaguuugagaccagccugggcaacaugguaaaaccccgucucuauuuuuuuuuuuuuuuuuuugagacgaagucucucugugucgcccaggcuggagugcagcgguuccaucuuggcucacugcaaucuccgccucccagguucaccccauucuccugccuuagccucccgaguagcugggacuacaggcaccugccaccaugccuggcuaauguuuuuuguauuuuuauuagagacgugguuucaccguguuagccaagauggucuugaucuccugaccuugugauccgcccgccuuggccucccaaagugcugggauuacaggcgugagccaccgugcccagccaaaaccccgucucuauuaaaaaaaaaaaaauuagccagguguggugacgcuugcguguaaucccagcuacuuggauggcugaugcaggagaauagcuggaaccugggagguggagguugcagugagcugagauugcaccagugcacuccagccugggcaacagagcgagacucugucucaaaaaacaaacaaacaaacaaaaaaaacauauauauauauauauauacacacacacacacacacacacacgugcacacacgcacacacauacauacauauauauagauauauacaucuaucuaucuaucuaucuauauauauauauacacacacuugaagaauuagcuuuuaaaaguaccuuuugugggcugggcgcaguggcucaugccuguaaucccagcacuuugggaggccgaggcaggcagaucacuugaggccaggaggucuuaaugucaguaucauccagcuguaacauaguaaggcucugggacuuuaaacuuaccaugaucauuuccagggagcaagcaggaauaguaaauaaauaaagauuauuaaaaacaaacaaaaacagcaggaaaaaauggaagaguuuuuuuucaaaagguaguaaagugugaaucaucagauagcuucugguuuacauagugacaauugaaaguagcuuuuccugguuaaacuauauugugguaaugcaguuacagcacaacaaagcaguacaugcugaccacccuuagcagggaaugugcuuucgcucaccuauuggacaguuaagucuuuuaggucuccauuuggauaccucuuuuucagagacaauuuugguugacuuacuggucuugaucauaucuucuuauuuuaguuuguuguaguguucuguguucuuuucuuuuuuuuuuuucuuuuuuuuuugagacagaguuuugcucuugucgcccaggcuggagugcaguggcgcgaucucagcucauugcaaccucuuucucccggguucaagugauuuuccugccucagccucccgaguagcugggucuauaggcacgugccaccaugccuggcuaauuuuuuuuuuuuuuuugagacagagucucgcucuguccuccaggcuggagugcagugacgccaucucagcucacugcaagcucugccucccggguucaugccauucuccugccucagccucccgaguagcugggacuacaggugccugccaccacaccuggcuaauuuuuuguauuuguaguagagaugggguuucacuguguuagccaggauggucucgaucuccugaccucgugauccacccuccucggucucccaaagcuaauuuuuguauuuuuaguagagacaggguuucaccaaguuggccaggcuggucucgaacuccugaccucaaaugaucugcccuccucggccucccaaaguacagggauuacaggcaugagcuaccgugccuggcauguucuguguucuuuauagcacuaagguuugaaauuauauauguuuguggugguaaaaaaacauacaauuucucuguaccuuacguuaagguagcuccagaggcagugacauuaucuuuccccacuccucagcauaugaugcauaacaaguauuuaaaaccuacuuguuaaugaauauaugagguauuauuaguuggaagaucauauucauauauaauuauagauuauucucucgcugccgugaugugucaaauggcacuuuuuucucugaggcagggucucacucuguaacccaggcuggagugcaguggugcaaucucagcuuaaugcagccuuguccuuuugggaucaagcagucccaugaccucagccuccuaaguagcuggguugagaggugcaugugccaccaugcccagcuaauuuucguauuuuuuguagaggcaaggguuucgccauccaggccggucucaaacucuuggacucaggugauccuccugccuuggccucccaaagugcugggauaacaggcgugagccaccaugccuggcugguagucuuauacucuuaaaaguuuuuagaaagauuacagaaugaaacacguacuaugcuucuuaaaggugugugacuacuuacuguuuuauuuucauuccucggaccuuaauacaugacuuugagcucuacucccuuuauauuuuuccuuuggcucccagauuuugaagaauuuugccuagauucaauaccauuuuuguuugauuuuaaaauuuauuaaagugguaacaacugaaauauuuaugaacagauuaaugaauaaacaaaauaagguauaugcauacaauggaauauuauucagucuuaagaagauauaaaauucugauacaugcuacaguauggaugaaccuugaaaacauuaugcuaagugaaguaagccagacccaaaaagacaaauauaugacuccaguuacaugagauaccuaaaauagguaaguucauagagagaaaguagaauagagguuaccacagacuggaguaguggggaauagugaguuucuauuaaaugaguacagaauuucuguuagagacguugaaaacguucuaaagauggaugauggugacaguugcacagcauugugaauguacuuaaugccacugauuaaaaacgguuaaaaugguaacuuuuauguuauguggguuuuaccgcaaccaaccaauaaaauauuuaaaaagaagugguuggcuccuagcugcgaaagauucagguacuagccccuuuaagaaguuaggugguaagauuggaaaucauuuauccaaaguauggaacucugagaauuaauuagaaacgugaauuccuuuuuuauuuuuuuauaaaagcauuacaauauuuaaauuaaaugccuguuuauaacuauaaagcauagcagcauuuuagaaaauaagaaaaagguccuuaaauuuuuccccucacgaggaucugugacuuuuuguauuccauuauguuguuuuuaugcauuaaugcacuaauuuuaaagauaguuuaagcugggcaugguggcucaugccuguaaccgcaacacuuugggaagcugagacgagaggauuacuugaggccugggguuugagaccagcgugaacaagauagcgagaccuugucuuuacaaaaaaaagaaaaaaaaaaaaaagaaaacaugguagugcaagccuauagucccaugaauauauguccuaugaauauaugagguauuauuaguaccucguauauuaauaauaaucaccucaggaagugucagaggugauucaaacuccagccucccaaauaugcugggaggcugaggcaggaggaucacuugagcccaggaggucaaggcugcaaugagccgugaucgugccacugcacuccagcccugggcaacaaagcaagacccugccucuuaaaaaaaaaaaaaaaaaaaaaaagauagaauuucccauaggaguaauagggaagaaaaaagacagaaguuuggauguuucaggugaaaugggaggacaugacuuaggccaggagagguuaagaacuguuucuguuacacuuaguagucagagucaauagcaaaggcauuguggaguucuuuaaauuagcuuaguucuuuuuguaacaguuaaaacaagaagacaugaaaaguuauacuauagauaaaugcuguagcugugauaucuggucauuuguaaguagagaagaguuaauucccauacuguuuaccaauaaacaguuauuucauaaaaucaaaaauaguaaaaagaauuuuguugagagaugucucaccuccuuguucaauuuucuguggcuaaaauauaaccuaauuucuguuuguuacauaaauaccaaugauaauguggcagugguuuccuaggguugagcucuucaacacagaauugcuuguuccaaauuugaaguacuguuagaaccuuuaaaacaauuuuguaagcuuuuacucauuuguuuuucuguagacaguuugcuuuuuaaaaaucuauauuauucauuggguagagauuuuguuuauuggguuuguuuaaggaaccccuauucucauuauuacagcucauguguugauucuggauuauacugugcauuuguaugaaucuaaauauugaaggaaugguuagguauuuuguuucccuccugagacacuggaaauaaaaccaaagauucagagagauguguccauuuuuguguacauuuugacgguauacuucaguuacuaagggaaacgauucagaauuuuauuuuaccuugaaucaaaguaacaguuauggcaaaaugguugucauuagccaucaguauauaaaauagccuuuuuaaaaaagcgcuuuccuuuuugucugaugaugcugauuuuacaguuugcagagaaacaaagagcaccuagugccccaguuuaaguuucucccgacuugugcccauauuucuucuugucauuacaaacuauuugucaggagugucagaggugauucaaacuccagccucccaaauaugcucacauggcuacucccacacagcuuaauggaacuguuucugggauuuugggcauugauaaguuaagaguucuguguaagucucugagcuauacacuucuauaguucuuauggucugaucagaagaccagaaaguacacaguaauuugaacaggaaaguuauuaacuggaacuuauuaacagauuaaccagggauuaacuauucaaagguaaaaagaaagcagggcucuaguucaguggauggcaaaguucauuggugcugcagccugagguggccacaggaaacugccuacuagguacuaaaagagcuuagcugaaaagcccucugcuggggaaucugucccaccuuuuggggaauaaauauuagcuacuacauauuuauguaauacauaaaaauauacagguacagcugaacacaugagugaauguaacuucuuucuuuuucuuucuuucuuuuugagauagucucacugucacccagacuggagugcaguggcacgaucauggcucaccgcagccuugacuuccuaaguagcugggaccacaggcgugcgccaccgugcuuggcuaauuuuuuguguuuuuuuuuuuuuuuuuuuguagagacaggguuuugccauguugcucaggcuggucuugaacuccuggacucaaguggucugccugcuucggccucccaaagugcuggguuuacaggcaugagccacugcaccuggccgccucuugguuuuguuuuauuuuguuuuuuaaucacggcucacugcagccucaaccucccagccucaagugauucucccaccucagccucccuaguagcuggaaccacaggcacacaccaccaugccuggcuaauuuuuaaauuuuuuguagagacaaggucucuguguugcacgggcuggucucaaacuccugggcuuaagggauccucccaccuuggccucccaaacugcugggauuacagaugugagccacaguaccuggccugaagacgcuuuuuuaaaauauaaauuuuuacuuuucgaaaauuguaaaaacaaaaggauacauccuccaucauaaacuauaaauaguauuuacacccugggcuguucugaaauaaauugcagucauuuuaucacaugaauaugucacuuuauaucuaacagauaagaacuugagacuaguuguaugcaauuuggauauucuggcuuacaaaaaauagaacaauuaaaucuacacauuaagccuacacacuguugacagaauacacgcccugaauauucuuugaaaccaugccuauuaauucuuuacuguaacuacucauuacuacuucugugcuuaggcuagauauacaauagguuuuucccuuccaucagcuguggcugccauuaguguuuacagaugugcuuuuauagcauuaagugucggacuuaaugccuuccuucugaaguagcuauugccuuuagugcuucccacgccccccccccccaccccccuuuggaguuuccuuaaccugcuuugcucgucuuauuaacuguaauaucuugacucuucuaucagcuaauagagaaauagaguuuuuaggaaagaagagaaaaauaguaaaauauucaguucuugagacccuauucucugacuaguuuuucuugucuuuccauucaugaauagaagaggggaaauaaauuaggaagauuauuuguucgugaauuuauuguccacaaauuuggcauuuuaugaauuagaccauucaugagugaucccaaggguucaugauauauaauuaguaauuguggugaguuugaaucuuucacacuauaagauuaguauaggugaguaaguuauauagcuaaugaaugaguguggccaacugccuagauuguaaagaacucugggaaccacccagcaaagauuaugcucaauaaacauuuuagagacugagauuuuaccucugucugggggaguccuaaugacaucugauuaguacuaauuuguuuaugaagaaaauaaucucuuucauacaguauuuaagguuauauguuuuagcuuacuuuauacuaaaaaccaaucagagcaccuauuuuuuuucccauaucucuccacaugcaaaaguguauauagcaagggaaauaaagucaauauucucuacuacuuuucagcagaaauccuuaucccugcagaguagaucauuugauuauuugccaagcugaauugccuugaagugauuucauuagaaagagcuuaguuuuagaaugaagaacauuauuuguauugauaauauaucuaagguuggaggauuccuuugugguuaagccugcaucuuccuccucuuuuucuuuuuaaacauuuuaaaaauauuuuuuguagagaugaggucucacuauguugcucaggcucaucuugaauucuugggcucaagcaauccugcuuuggccucggcaugaggcacugugcccagccaucuucccuaucuguuaguugcaaucugcuuucaagcccacaaaccugguagggaugucaagaaggauuaguaaugaaaaaaaugacaacaaaaugcuuggauauugacagaaaagaguauucuuauccauuguaauucagauccauaagagcuccauuauguaucacagggaagcuaauaaaccuuaaguccacagcugauggcguuaugauggcuccuugaaauugaaaugcaugggaagaauauuaaagaaugggaaguauucauuguauccacauuuaaaugcccuaacaguuuuacucuguuacauaaucaaauuacugcaacuguuuucugaaguaguuuagacuguuuagcuaaauuuguuuaucuuuagacauuuugauaugauauuuuuggcuaauuuauaaauuuuaaugaagaaauuaaugaggggguuacuaauuuggggaauuguggauauugcugggaugggaagggacaguuuaauuuuugguuuuauuguugcuuuguaagaaaaauuaaaagcuuuuuuuuuccuucuuucauuuuccugcacugcauuccaacuccagaagguaagaaguauuacuuuauucuaaagaaguauuaugcaauuauaaagcacacuuuuauaaauuuaauugaacuuaccuuuggaugcaugaguuuuacuuuauaaaacuaaauaauuaguccagaaacuaaguaauaucgauauuauuauguuaguguuuauucguuaagugugcuuuguuugguucuugcaguuuguaauuauuguuugaucauaaguuuagaaauccgaucuacauuaagguuuauuaaaaucaacauuugacuuauaaaagcguugggaugccaaguauucugcagaguaauaaugaaaguauuuaguagacuggaaacauguauauuaacauuugcuuuauggcuguaagauugaaaauguauguuugugcucuuaauuuagauaaaauauugguaaaucggcugggcaugguggcucacaccugguaaucccagcacuuugagaggccgagguggguggaucacuugaggucaggaguucgagacuagccugaccaauauggugaaacugcaucucuacuaaaaaauccaaaaauuagcugggugugguggccggcgcccguaaucccagcuacucgggaggcugagacaggagaauugcuugaacccacaagguggagguugcagugagccgagaucaugccacugcacucuagccugggcaacacagcaagacuccgucuaaaaaaaaaaaaauugguaaauccuuuaggggcaugauacuuaaaaccagggcagaauggguuaaaaaucagucuggauccuuuacugaauugacuuuuugugugugggcauggccuuuuagauucaccuccacuauagcaguucccguguuacacgccugugagaccugagggcaacagucguauugccugugagacuugagggcaacagucaugcccauguauuuucauguuacuuggacauggcaugcuuggguuauaauuagagcguaguuagucuuuuuaacucuaguuauauuuguaguccauuaaguucauuuguaagaaccuguuuauuguaagcaagaguuuguggaugaaagcuuaauuaaggucuuacaaaguuaaaauuauaauuaaaaaauaaaauagguauauuuuguuuuguguuauguuuguuugaagggagcauguauuugauuuguucuuauuuauuuauuuauuuuuuuggagacagagucucacucugucacccaagcuggaguggaguggcauggucucggcucacugcaaccucugccucccagguucaagugauucuucuguuucagccucccuuguagcugggauuacaggugccugccaccaaccccggcuacuuuuuguauuuuuaguagagacgggguuuuaccaugcuggccaggcuggucuugacuuccugaccucaagugaucugcccgccuuggccucccaaagugcugggauuacaagcgugagccacugcgccuggucauugauuggguucuuuaagugcaaaugauaggaaccaaaugugaauaacuuaagcaaaacaagauuuauuuaaagaauaugggagcagaggcaagacucagacucaaaggcaagaaacgggcucugaaauuaggagaaggaaggcagcuucagagaucagguagauagaacuaaugcauagucucaucaagacacugcagcugggcuaaauuagucauugucuacucugcucaagguuaaacuuuaagggaagagugaacuugguuggcccagugcccagggauggugagauaucuugauggacagucuuaccaagacuauuuccaguaggggagggcauaguuccccaaagcaaaauuaagcuuuuuuuuuuuugagacagggucuugcucuguugcccaggcuggagugcaguggugcaaucucagcucacugcaaccucugccuccugaguucaaacaauuuuccugccucagccaccugaguaacugagauuacaggcgcacgcuaccacgcccagcuaauuuuuuguauuuuuaauagagaugggguuucacuguguuggucaggccgaucucaaacuccuggccucaagugaucugcccaccucagccuuccaaagugcugggauuacaggcaugagccaccaugcccagccaaaauugagcauucuuugcagaagaagagggaauggauauuggccaggaauaaacaacagcuguccauugcucacuauagaaaauuaaaguacaacagaaaaauguaagccauaagcaguuguaggaaguaaccuuuuaugcagauucuccuaaugguaacauuguacaaaaccauagugcagugucacagcgagaauauuguuucugauauaauccaccugguuuuacugguaccgggguguguguauguguguauagggugcuaugugguuuuaucacguguauagauucauguaccuaccaccacacaagauacagaauacuuucaacaaauaucccuuguguuccccuuuuaaaaccacauguacuucccuaguaccccuugccccccuuccuuauacuaguccguccuacauuucuauaauuuugucauuucaaguguuuaauggaaucauagaguauguaaccaucugggauuggcuccccccgcagcccccauucauuguaugucucuggagaguccuccaaguuauuguguucauaguucauucuuuuuuauugccgaguaguauucuuugacauggacgugcgaccguuucuaacuguuuauccguugcaugauaucugaauuguuuccaggcuuuggcuauuaaaaauaaaacuucuaugaacauuuguguaaauguuuuuguaugggcauacauuuuccauucucugggauaaauguacagaaagugcuguugcuggguugugugguaagugcauguuuaauuuuaaagacaccuugaaacuguaaaugaauuucuuguaaacugcauaguuuagaauuuuuuuuuuuuuggcccaugcugccaauccuugccuuuuaauuuguguguuuacaccauuuauauuuaaaguaauuguugauaggugaguuugccuuuuuguuuuuuuguuuucuguuuccucuauuucucauuccucuguuucucuuuucuugacuuccucauggaucauauuuuaggauucugucuugauuuauuuauaguauuguauuucuuuguaugucuuuacaugcuuuucuuaacuguuucaacuggguauuacaauauauacacgugauuuaucacagucugcugauaaucauuuuaccacucuaagugaaguguggaaaccguacuuccauuuagauucuugaguaugagaugguauuaacauuuguguuccagucaugaaaugugauuuauaaaauuuaugagaagcauagucugugguauauaccuauuccuguucuuucuguuuuuucuuccuggugcuacaggauugcuucuuuuaucauuuccauucuauugaaugacuuccuuuagucauucuuuaagaauaguucuacuucucuuaguaaacuacuuuuaguuuuacuuagucugaagcuguuucaucagauauagaauucacaauugacaguucuuuucauucagcacuagugaaaugucaugccacuuccuucuggccuaugugguuuuaggcgagaaaucuauugucauuugaauugguguuucccuguaguaauguguuguuucucucugcuuucaggacuuuuucuuuggauuuaguuuucagaaguuuaauuaugauguaucuugguggacuuauuuagauuuauccuauuuagauucacugaguuucuugaaucuguagguuuauuucuucauuuuucuuuauuacuuuuucuuuuucuuuuuaaauccuguuacaucuucagguuuuuuguuuuuugagacagggucucauuuuguugcccaggcuggagugcaguggugcgaucucagcucacugcagcaucagccuccugggcucaagcaauccucccaccuuagccuccugaguagcugggaccacaggugugcaccaccaugccuaucuaauuuuugcauuuuuuguagaggcaggguuucaucauguugcccagcgcaauaccugagcucaaacaguuugccugccuugcccucccaaagugcugggauuacaggccugugccauugugccuggccuguguuuauuucuuuaaccaaauaagagaaguuuucagcuguuaauucuuugaauacucuuuuuuuuuuuuuuuuugagacggagucucacugugucaccuaggcuggagugcagugaugugaucucugcucacugcaaccucugccucccaggauccagcaauucuccugccucccgaguagcugggauuacaggugugugccaccaagccagcuaauuuaguagagacaggguuucacugcauuggccaggcuggucucgaacuccugaccucaagugauucacccaccuuggccuuccagagugcugggauuacaaaugugagcuaccgugccuggccaauucuuugaauacucuuucuccccuacucucuuucucuuuucuuucuggaaugcugaugauaugaauguugaaucuucuguuguuaucucacaaugccuugagauucuguuaauuuuuuugguguuauuuuuuccgucucuucacauugaguaaauuguauugaccuguucuuaagcucacugauucuguccucuguugucuccacucucuuacugauuucaucuggugaguuuuuaaauuucuuaauguauuuuuuauuuuuauauuucuauuugauuucuuuuuaaaaguucugucuuugcugauauuuucuauauguuuguuucaaaagaauuuuaaguaguucuugaagcauuuuuaugagagcuauuccaauuuuuauuuauuuauuaauuuuuuuuuuuuuuuuugaggcagagucuugcuccgucgcccaggcuggagagcagugaugcgaucucggcucacugcauccuccacuuccuggguucaagcaauuauccugccucagccucccaaguagcugggacuacaggcaugcgccaccaugcccagcuacuuuuuguacuagagacgggguuucaccauacuggucaggcuggccucaaacuccugaccucaggugauauaccugucucggccucccaaagugcugggauuacaggcgugagccgcugcauucggccuacucugaaauuuuucuuacaauuuucacaucugucucaguguugguguccucuaauugucuucuuugauucagauagcgauuuuccauugaacccuggauauuuuggcuaucauguuaggggauguccagucuuauuuaagcuggcauucacugugcuuacuuagguuuaccaugcagguccuggacuguuuuaguggauugugguuccaauaacaguuuaauuuucagauccuuugcagugguauuugggucugcuuguuuuaucuggugccacagaggcucccauugaccucugcugcuucuuauugaucucuguugcuucuguuugaggcggugggaauuuucacaggcuggguugccugaugccuguagauguggacaaaagggagucuucagccuguggggacagacaggcuuccuggcaggauccccuuugcuugagcuacuuggcugcucagcaucuugugagagcgggagguguuguagucucaggcccacaaggacaaagaggcuuccugggcuggacuauuuuugugaucuucucccacuugcuugugccauuuggccuccccuagucuagucuuuauuuuugagacuugagggaacauaaacuugcaacgaaagucauuuaauaaucuccuaagaucuaccauaacuaaguuacuucucuuaguugggaaaugccaggaauugguaaaauuaaugggucaaccaacuacuucaaaacucugaaucucaauauaaauggcuacaucaggacugguaacucugguucaaaguagaaaauaauuguaauaaguaguguuagcuguuuagauauccaagcucuguuugcuaaaucaacaagaauaccaaguaggacaaagguauaaaauugcgaaauuucugucuuuugguuuacuuaauugaaucuguugauuuuuauucucucucuccagcugaguucuuucagaaccaugcccauaguuuauauucauucauaaguauuuuguuuuccucacuaauacuccuuuuaccucagaugauaaacccucguguguguguguguguguguguguauguguaugugucucccuuucuguguuucugucucugucucucuguuugucucaggcaggagugcaguggugugaucauagcucacugcagccucgaccuucugggcucaggugauucucccaccauagcuucuguaguaggugguauuacagguguacacugccacaucuggccuacuuuuuauuuccuauuccucauaagauugaaaagccugaugcuguaauaaaccaguagugaaauggccuugacuaagaugggaguccauucacauggucuguuuaaucuuuaauaagccuugugagaucauuaucucauagauaaacacauaaaaucagugaaaaauuacauaucuaauuagugauagaacuugaacccacaucugugagucuaaaauauaagugcuguuucugcugcacucaggagauuggacaagguuguuguuuuuuuuuuuuuuuuuuuuuuuugagacacagucucacacuguugccugggcuggagugcaauggugcgaucucagcucacugcaacuucuaccuccaggguucaagcaguucuccucccucagccuccccaguagcugggauuacaggugccugccaccacucccggcuaauuuuuuguauuuuuaguagagaugggguuucacuauguuagccaagcuggucucaaacuccugaccucgugaucugcccaccuuggucucccaaggugcugggauuacaggcgugagcuacugugcccggccuggacaaggaucuuuucuuuuuauuuuuuuuuuuugaaauggaguuuugcucuuuguugcccagggagggagugcaauggugugaucuuggcucacugcaaccuccaucucccagguucaagugagucucuugccucagccucccgaguaacugggauuacaggcaugcgccaccaugccuggcuaauuuuuuguauuuuuaguggagacgggguuucuccauguuggucaggcuggucucgaacuccugacucacgugauccaccugccucggccucccaaagugcugggauuucaggcaugagccaccgcacccagcuggccuggacaaggaucuuaaugagcuguuucuuauuucucuuuaggugaaaaguuagauuguucucuaaggcccuucuauaccaagaguuuguaauuaucuaaucuaaauaauauugaaccuuguuauuucauuuguuuacuuaaaaauagaacauagaauuacuggacuccuuuuuuuuuuucauuugaaacuguuuugcccacuuguuaaugcuaguggacaaagccaugcuuuuuagaagauguuaguggaagacaauaaugggaugauagagugaagguuuauaguuagguguuaacgguaagguaaagcaaacaacaacaaaaaauuuccaaggaaucuuuuauugcuaugaccucccucucuaggcgauuccuagaucacucucauuuguucugugcccaucugcugcucuguugaccuagaaccucucauuuuggggccacaacuagaucuacuuaccccaagcugcuuguuuaaaaguuuuccuacacacccuuucccuuaugucuuuagugcuuuuauucccauuuguuugaugguguauuuuggggaggaaaagaguaugaagaaacaaauugauugaaguguggaugaaucaaauguuuacuuuuuaaaucaaaguuaaaagcuacauuuauauuauuucuuuuuaaaaagcagauuaguuguuaauccgaaugaaucaaucaugguggaauugcagguaaugugaucaagggaaggaaaaauguuuuacugaagauguguaggaauacaaaaauuuaaauuuaaaucuaaaaucaaccaagacuauuuauuaauucaguaauuucuaaauuaccaaacguaauuuagaaauuuccaauguaagugugcuguugaggucaguuuuguucuguguuuucuguuuguaaaggcauguaaguaugccauaaaaucuauuuuuggucuuaaaguuauguaguauuaaauuucgagaguucauaugugaauaaugauuguggguguguguuuacagauauaugucuaaguggauaucaugugaaugaaagauuguagauacaaugacuauaaauuuauuauaucuuuauauuuaaaauugacuuuaggccaggugugguggcuuaugccuguaaucacuuuggguggugaagcgggaggaucgcuugagcccaggaguuugagacuagcuugggcaacauagggagacccuaucucuacccaaaaaaaaaaaaaaaaaaaaauuauuagcuguucguggugaugcagacaugugguucagcuacucaagaggcugaggaggaaggagcauuugagcuuaggaauucaaggcugcaguaugauugagccagccuggguuacagagcaagacccugucucuaaauaaaugaacaaauaaauaaaauaaaaucgacuugaagugagggcauuuaagcaucuggucuagaugacuuuuuuuuuuuuuuuuuuuuuuuuuaccuugaaagucuauuauuuaauccuauugaaguucaagggauugagcuuugaaggauaaauauagauuguguauaguucagccaggaauagggaaaaugauuaaucauuguggccuuaaggccaaguuuugacaacuguauuuuauaggaaggaguacggaaaaaauggacaagagauuggggauuaaaguaggaauuaggcaguaacuuguuauugcaagggagaauaucucuaggaucaaauaaguuggauuagugaugucccuuaaaccuguuuaucaaagguuugaaauggggauaacaaauauuggcagacacugaugaauuuuaaggauggacgguacaagcuuaauguauuaaagauucuuuggauugggugcagcauggaaugccagugaggagaccaaaaauaaucuggaaaggaguagacuucaggauuucaugaagucuuaaaauacuuaaacaacugucauuggaaugauaaagaaauaaugucaaacuuuuccagcccacuuucaaagauaauuuguugcaaaaucaguuucaaaauucaaacauugcagaggaaaacaaagagccccccagauuuucccagcauuauacuacugauuuccaucauaaagguagacuuauaaauagacuuauaggaagaguauuuagcuuagcuuaagaaggaauuugugaauaauuggaaaugcuugaggacauagugcccgcccaccacguuguaugcuuguauaagacauugggugauuaccuguuuagauaccuuagacgggguacaaguaccuguagguaaauggucuaggucaccuauggagcucccuugucaaccgauaucuuaucugauuuuuguuaguagguguugaaaacagagagagaguuguguaaacugagaauuaaguaaagaaugaucaaaaguuguaggauuuuauuuuacccagcaauuccucuuuugccuguauacgcaaaagaaucgaaagcagagacuuaacagauaguuuuaacacuaguguucauagcagcgugauucacaguagccaaagggaagaaacaacccaaauauccauugauggguggauggauggcugaacaaaauguagcauauauauucaauggaauauucagcuuuaaaaagaaaggaaaaugacaccugcugcagcauggaugaaucuugaagacauugugcuaagugaaauaagccagacaaaaaauaaaaaauacuguacgauuccacuuauaugagauaccuagaguagucagauucauagagacaaagagaauggugguugccaggagcuggugggcaggggaagaugguugcuguuuaguggguguagaguuuccguuuuguaagaugaaaagguugcucaacagggugacuguacuuaacacuacugaaccuguacacuuagguaagaugguaaauuuuauguauauuuuaccacaauaaaaaaguucuaggauuuugcauuuauuugaauggggcacaauuuaaucuaauguaggagaaacagccaucuuguuauauuaguaggaaauagagaacauuugccuaagguaaagagaaugagcagagguaugccuuuaacuuuuucaggaagguuaauguucauuuuaccuuguuaaauuuaaaaucuagacagugaugggugguuaagaaagugaaggauaagaaugugauuuuuauuaacuucugcucacaaugcaaugauucagaauugguaaaacaaguaaguuuuagaguuuuggcaagagccuuuagaaugagaaggauuauagacaagacaaagcaagcuaaagcugagacuuuuaacuuugaaaguugaugggccauguauacuuaaugaccuuuauucuggacuucauuuacaugugucuuugagccccagaaagaaacuaagaaugaaagaaagaauagugaaaaugucaugaugcucaguggggaaauuagacaucauuaguuaccggaaaaguuaccaguuaauuuugggaagagaucucuuuuuaaaaaaauacauaauuaggaaacauuaagaaucauaauuuugcuacaagugcuacugcauuuacaguugaauauacuguuauuuguaaaccacgggguuggagacugacaaauuagaaaacaagcucuaaaccugaguuucugauuuuguucgauucuugaauugauagcaaaauugcaaauauggcuaacaguuuuuagauaguguacauuuuaaacuucuaucuauuugcugaauuuuucuggaggcaaauuguguguguguguguguguguacgugcacacuaguaaagagacugucauuuggcucagcucagcuccaguucaguuauuuuuacauuaaaauguaagaaugaguacuucuuucuuauggaaacuuccacuucaucuuuuauaccaccugcacauacuaccguguugcuauaugauagguccuuuguaaauauuaaaugaaugagaaaucaagacagcuucuuuuccauauuuuuuuuccugaguuuauggaguuuuaguauuauuauuugauuuuauauuuguauuuuuuucuuuuauauugaaaccuuuaguucaaaacagcauuauaaauguauccuuucaguacauaaacauaguuucaaauuauuaauuucagcauaacuacuaauuauugcuauauauauuuuagaggaggacaacacauuuaguuuuauuucaaucaaaucacaacacuuucuuuuccaauugcugcaaagugcaucuacaauauucuauuacagauccacuuuaaaaagguuuccuaugacauuacagcaagccucuuuuuucaaacagagaaauaaucccaaauuuuuccucaauuaaaaauaaaaacuccauuccaguaagugguaaauacauaaaaauuacaguaagccagacacuuaaaaggacagccaagaagucuuccaacaguuuauuagaaagaauguggacaucaagaaaaauccccacugucaugaacauaaauugagguuuuaagcccugguauaagcugaaaaaaaaaaaaagaaagaaauccaauacuguauuaaacguuuuucacucauuugccauacugacagugcagauacaaaucuggucuaaauguacagacucuuaaacaaacaacaauguacagcuuucuucaucuuccgugcuaagagauguaaaaacaccuaagggucaaacaauaccaaauauacaggcuucaaaaaccaucuaaauuagggcauucucuaguuuuagcuaagauacaugugaauacugacaaguaaucacuuauauagaauaaugugaaguaaauauuuugaaaaauaaacuuggaacaauccugaaggauaacaccagaggaauagcagguuaccaguaaggugucagccaauuuguuccagccauuuuugaauccauguucuauaaucuaaaauuuaguucucuuuccguaagcugagagcuuccuaucaugucaguaucuauguuaugaagaaaaggagacuuagguggugagauguuuuuauuuaucacaacugcugcaucaauugccuaggaccucacucaacagcuucaugaaaaucuaggaaauguucaugcauaagguuauugccuuagcugacuuaaaauugccccauacaaugguacauaucaacccuuagugaagccuuuuaaaaaaacaagcaggcugaaaaaugggucaaaguaggcaaauacagcaucugccuuuagagcugucaacuuaggaauucucucaauugugaaaucuugcagagaaguuauuuuucuuucccaaaauccaggugaugacaguauuccuuacucccgaucuggcauuuuuucaucaucgcugucuugugaaucaucaccugcuccaucuacuucuggucaaucugcauccucuucaccacccauguuguucaucaucucagagaaacgaucaaaauuagaccugucuucaucugaaccaucuucccaguguuuccaauuacugaaguccacacuaagccaauugaguuuugcccuuccuuuuguuaaccuuggcuaugacuggccagauucuccuuuucguaaacaacauacaauugaucuguccguuuuuuuuaugcuuggaaucauuaggaucaauacugugaaaaagaucaacuucauuuaaauacuuaaaauuaucacuuccucugagacaacugaauguuaaguuuggauuuuucaaaauuuacaugaacauccuuacuguguucacagaauucagugaagacauagucccuucgauaguaccacuuugcagaagcaggcugcauugugaacagggcagggggacgggcgaacaggugggcggcccucuggcgucgacugcugcuagggagucgacuucucuccggugacgacucugcguuuucucccggucgcggccucuucucgcuucccucaggcgauggcggcagcggcgggcuccaccucgguccccagaaugcaccgcgcagaaagagcggccccuccggucggggagaagagaaaaguguaggaaaaggggcccgaggacuuacuguuaaauuuuuauguagagaaaaccuugcagaguaaagaguuacuuuuaccuuuuauuaucuacaaguuucuuuuaccuuuuauuaucauuuuugggcuuucaaaauuucugugugaagguggaagaugaauucuucucgccaacucaauuuuuaguauuaauguugauaggcuucuugccagugagauucaguccauuaaaucuuuaguucgccagauaaccugaauuacuugcaacucauugcaucauaagcaggaguuguucuaggagugucaguggcauuauuguacucuuuacaugguagaucaguuugugccauauugaauccauucauuaguguccguccaucauagugcagguccagaaacagcagaaagaugaacacucuaaauaaagcagagagacauaaguugccccaguguuuucauuuucuugcugcuucuuauuugauaaguggauauuuaugguguuuguuuuggaaugguuuucuuuuccuuugguuagucaagugaucaagugcuuuguuuucuggauacauuuuguuuuauuugacccugggacccugggagaauauauacguguucauagaaaauaugggaacaggccaggcaguggcucauguuucaacggugguucaccauguuggucaggcugguuuccaacuccugaccucgagugaucugcucgcuguggccucccaaagugcugggauuauaggcgugagccaccacgcccagccccgcauauuuuuuuaaaaacaacuuuauugagguguaguuuacaugccauaaacuccaaauuccaccucauuuuccuuuuuuuuuuucccuccuuuccuuucccuuuccccuuuuucuuucuuuccugacagggucuugcucugucacccaggcuggagugcagugguacagucauagcucacugcagccuugaacuccugggcacaagggauccucucaucucagcuucuggaguaguugggacuaugggaacacaccaccacaccuggcuauuuauuuauuuuuuugauuuuuucuuuuugagacggagucuugcucuuguugcccagacuggagugcaguggcgcgaucuuggcucacugcaaccuccaucucccggguucaagcuguucuccugccucagccuccugaguagcugggauuaugggcaugugccuccaugcccggcuaauuuuguguuuuuaguagagacgggguuucuccaugggauuucuccauguuggucaggcuggucucgaacuccugaccucaggugauccgcccgccuaggccucccagugugcuaggauuacaggcgugagccaccgcgccuggccugauuucuuaauuuuuacauuuuuuguagagacaaguucuccauauguuucccaggcuggucucaaauuuccgggcucaagcgauccucccaccucagccucccaaaguguuaggauuuugggccagucaccacaccaggccagaaacuccaccuguuuucagugcacaguucaaugguuuuaaguaaauuuacugaguugugcuauuaucaccauaauccgguuuuagaauguuuucaucacuccagugagaucucucauacuggauacggguaaugcuggcuccuccuaacagccuguaaucuacuuucugucucuguaaguuuggccauaucuggacauucauauaaauggaaucauauaauauguaaucauaaacuccaaauuccaucauguuuguagcauugaucaguacuucuuucuuuucauugguccaaauuguuguauagacuuuucucauauacuuacuuuuuuaaaaaucauauacauuuauuuaacuuuauaugguauauugcagacuuagaaaaguugcaaagguaguacaaagaauucuuauauaaacuuuaucuggauucuccagauguuaacaucugucuaauuuguguuucugagaugucugaggauaaauuguagacauaaugccccauucacuuuuaaauacuucagaguaggcuugaugcagugguucacaccuauaaucucagcacuucgggagcugaggugggaggauugcuugagugcaggaguucaagaccaaccugggcaacaaagcgagcccgucucuauacaauaauaaaauaaaauaauuagccagguaucguggugcacacuuguagucccaacuacucuagagguggaggcaggagaauuaaauuugagcccaggaguucaaggcugcagugagcuaugauugcaccacugcacucuagccugggggacagagcaagauccugucuaaaaauaaauaaauaaauaaauaagucagucaagcaagcaaacuucagaauauauuuucuaaaggcaaguacauucuuuaacuacaggguaaaauaguuaauaggaaaucuacauuggcacaauauuaucuaaucagacuuuauccagauuugguaauucucccacugauguccuaauccaggaucacauguuguauuugcauuuaguuuucauguaucuuuacucuucuuuaaucuggaauuguacuucagucuuuaucuuucaugacuagacauuuuuuuuagugcaggccagcuguuuugcagauuguuucucaauuuuuauuucugcuguuuaauuaugauuagauuuaaguugugcaguuuuggcaggagugucacaggaucgauaggacauuuuuaccauaauauaucuggauuccaugauuucaguguaccacaguauuagugaugguaacugugauuacuugguuuaugcaaugucuacuguuucuucacuguaaagauaccauuuuuccccuuuguaauuaguaaguauuuuggggugaagauacucugagacucuguaaacaucuuguuucucauuguaccuuugcccacuaauuuuagcauguuauuaaucuauugcugcuuaacaauauuaucacagauuuagcagcuuaaaacagugcauuuauuaucucaguuucuaugugucaggagucugagcacggcuuuaccugauccucggcaaugcagcagagcguuggucagggcugaguuuuuaccugaagacuugauuggggaaugaucagcuuccaagcucaugugguuguuggaaagauucaauccuuguggguuaucagauugagggucuggauucuuagcuggcauuuggcuagaggcuguccugaguucuguggccuuccccaacauggccacaugcuuccucaaagccagcaaggaagagucaucaagcgaggacacugcagucauaugugaaauagucacuuaugugagacccuuuaccuuuguucuuuuuugauuauuagaagcugauuacaggcccuacccacacuacaggggaaggaauuauguagggccaugaguacacaaagcagggauuacuggaagccuuuuuaggucugucuaccacagcauccacuaaucuuaccugaaacuuccuaucacuguugccgcauauggugauuuucuaauucugucaaucuugguauauauauauauuuuuuguuggaauuuuacugugaggaauucucccccacucguugauuuguucauuuauucuuagcaugaccucauggauucuuauucuuuggguuauuucugcuauagucauuuauugcuuuaggguaaguagcaauuuaauuccuccaagaacagcauuuagagaagucuuuagcauggguuucucuuuuuuugagaugagcucucacucagucgcccaggcuggaguacaguggcaugaucucggcuuacugcaaccucuaccucccagguucaagcaguucuccugccucagccucccgaguagcugggauuacaggugcccgccaccaugcccagcuaaguuuuuuguauuuuuaguagagacgggguuucgccauuuuggccaggcugaucucgaucuccugacaucaagugauccaccugucuuggccucccaaagugcuggaauuacaggcgugagccacugcguggcccagcauggauuuuuaaacaggauuugagguauaguaagucauuggucaaauauacucuaaaugaaagauaaauuuuaacaggugagccauucuaucauagguuugcaaagccuuugaaauucuauuugaaaauauacuuugauguaacagacuuucaaguuaccaucaaaaugcugaaaaugcuuuuauauuaauguguuuuaagugaagagcuaauuuuuccccuaaaaaucauuaccauguaacuuaaaugauuaaaaguuuuggugauaugaucuaaauauacucauucuaaaaccacuaguuuucucagcuucaucuuuggcuugucucuugaucuuugaauguuauguauaggcauccccuucuuuguauuugugggcaucugggguucucacucucugucaguguaucaucuuguacuuggugaacaaguaccuugcuauucagugugucuuuuuaagugaaagucuuucauuuccaucuguaugcaauuuccccucuuaccugcuguucuaguuuuuguuuuguuuuuaauagcaugcccugugacaaagugauuuucaaaaagagcucuauugucuuucagaaguuuccuuguuuuaauaguuuauuuguauauuuccggacuauuuacuucaauauuucuuguagaaaugaugccugauaacccccuacccaaauuaaauuaaucagugaaaaaaauguacacugaagaacauauccugaaaaacuuuuaaguaggaauaaccauuguuuauugcauuuaauugaagagaccaagaaaguuacuaggcuuuaguuucuucacugugagguaauauuaauuccuaaaugaucucugaaguugaggaaaaacaaaauagaaaaauucugaaaguguauugucauuuuaaaaaugaaaguugaaaaaaguagaaaacauuuacguuucuuauauguuaccuaauugcaaauguauuccacuuuuuuccaaaaaauaguuucuccauuccuuguuuacuuuggugcauuucuuuuuggcuggauuucaucaucagcuagaauuuuuacauuuauggaugaucuuuucccugaguucuugcgggcuuaagaauuuuuuuuuuugagacagagucuugcucugccaaccaggcuggagugcagugcaaucuuggcucacugcaaccuccgucuccuggguucaagcaauucucaugccuuagccucccaaauagcugggauuacagaugccuaccaccaugcuuggauaauuuuugcauuuuuaguagagacuggguuucaccauguuggccaggcuggccucgaacaucagaccucaggugauccgccaaccucggccucccaaaguguugggauuacaggcgugagccaccacaccaagccaagaauguuuucuauugccucuuuguuugaaugccaucuaggcuagauauaaaauuuuucauucauacucuuaagaacuuuuuuugcugucuuuuggcagugaguauugcuaagaaagcaaauguuuccuucauuauauagugcuugcuuuauuggucaauauuuugcugcauaaucuuaaaauuucaguggcuuauaacaacaaauacuuuuuuucuuccucaugucuuuagguuaacuggggcuuaguuauuguuagcuagacuuuguuguaggcuguggauuguucucuccuucugcuggaaucuggcucucaugucaaucacaggagucagccaaacaggcaaauuuuagccucugcuuccgucaugucucuuauuucauugaucaaaucaagccuuguggccaagacgaacaucauuguggcagggaaauauauuucacuuacuguaacguacugcaaggucacacgauggugugaaugaugaaauggaaacacuaauucaagcugccacuuuggcuuuuaacgccuggaaccugguuugauucuuucuuuauccuugacgcuuaagauuuaggaaaauauuaacuuuuuuuuuuuuuuugagauggaggcucgcuuugucgcacaggcuggagugcaguggcucacugaaaccuccgccucuuggauucaagugaucagcucaccuuggucuuccaaagugcugggauuacaggugugagccaccgcacccagccaagauuuaggaaaaauuuagauguuucugaguaucugaguacuugggguuagucuguacagauuuggguagcaucuuaccucuuacauuaucauguaauauacauuauugaugcauaaggguaaucuuuucucguuaacagaagagagugguuuaccugugaauauucuccuguguuguuguucuuuucccuuuccuaucucuguaaauuugauugcuuuuauguaggugcuuuguaucuauuaagauacuuccagcuguaaaugacaggaaacacgauguaaacuggcuuaaacauugaaggaaucucaucauuuaaugcaagugaaaaaaacaggcaaaacuuuauccaaguucuccagucaguuucaucaguaucucagcucugcuuccuucaauuuuguuccauucucaguaggcucauccaucauaauugcaagaugacugcucacaggccuuagagcuggauauuuuggguugaauuguagaagagaagaaagauucuacuuuucagagacauuaaaaucacucaucacugagucuggcucgcuuacaguugagucagauuuuuuccuuucaguauauguaguuauaaauauguguuucagagaaguauaggauuuauagaacauagaaguggcuuauuuuagcaagagacauuaaggcuaaaaucugaaaaguugaauuggagguugcuaggagaaaaggaggugaggguuaucauugcaagcagaaguguugggccaaguagucagaagaauuuuaaauuaccaaaugaaaagaaagguagaguaggcuggcagagaggguguguagcagaauggucaaggucagauuauuuuggucaaggucagauuauuuugauaauuuuguacuuuauacuaagaacauuaugauauggaugaauuuuaagcuggacaggagguaguaugaucauauuuauauuuaaaagguuacucuggcuucagaguggagaauaguuguaugugagggugagauuccuaucacuugagauggggaacacuggaacacugccagacuaggguaggauaguaaguugguaaaguaacugcuguaguuacugaaucuugacucugugacauauacuugguauguacauuaucugugaucuguacaaucgaguuacacaguaggcaguauuaccucuauuuugcagaugaguaaauuaaggguguuuaaagugacuugcccaggcuacagucaggucuguauucagauugguaugaaucauuaaaucuggcucuuuaccaugcagugaugacuccuuucauuaauugcuauauuugcuuuaucuaagcaguacaaugauugacuucugcucucuuagcccuacuagcuacugcuagcuuuuauuacagagagaacuaaaaagggccauuggcaauaugaucaaagucacuuuaguucuuugggccuuauguacaaaacauauuaguauguuugcuuacaugcucaccgcauaaaauuauagcacugcacuuguuccuuuccuugacagaaccccuaccucuucaaccccaaucucuugagcauggacaagaaaaauuagaagcugacuuguugugugauaguuacauaaucuuuaaggugguucuuacuacagcugcuucggguguuaguacuuacccuacugaauuuacuugaacuuuuaaguugguauugaucucaguacuaugguuuuaucacccaugcagaugaugucuuauuucuucaagucguucacuuuuauuuaauuauagaauucuggagcucuaccuucccaugaggauauauuccagccaucauggguaguguguccuguuuugcuucucugcuauugcuuuauuauucauaaaaauaaacugcccggauucuuugacuuuuuguauuuuccugagaucaugccuaaauuuuguuuuaaaugguacuguguccuguauaucuuguagguuuuucaaaauuuuguuuccuucaaagaaaauuauauccagauuugcaaggaaaauauuauggcaguuuguaguuauucuuuuuuuuuuauuuuuuauuuuuugagacggagucucgcucugucgcccaggcuggagugcaguggcacgauuuuggcucacugcaaccuccgccuccuggguucacgccauucuccugccucagccucccaaguagcugggacaacaggcgcccgccaucacgcccggcuaauuuuugguauuuuuaguagagucaggguuucaccguguuagccaggauggucucgaucuccugaccucaugauccgccugccuuggccucccaaagugcugggauuacaggcgugagccacugcgcccggccgacaguuuguaguuauucuuaccacaucuuuucaccagaugugugugccauuuacuuucauuuuauagguuucacuuuaaugacuguuuuguuguuauuuguuguuguuacucuucuaagugcuaagccagacuagacugauuuuuuuucucucugacuuaaagcacuuuauguacacacuuuacagucucuuacccauaauuacaguauccgcagugguugaaaaacuaaguuuccucauacauuuagcaccaaacucacuugacaacaacaguucucuugaacugacaugagacuguauauaaucuuuauuuauccaucuuagugugaguauucauauguuucauuguguuugguuaugggaugcugucccuaaucuccauggcagugucauaucauuuauggcauaucauguuaccuuuuuaaaauccaaaaaauucuuaugucugaaacauuuggccuaaguguuuuagaucagggacuguggaccuguguuuauauuaauagcacuggucacagugugguguggcuguuuacucccuugccuaucuucucuauuagauucuaagcuaagaaagcuucccucuguggauccacuaauccuaguuuacugcccuaaacagaguggguacuuaauauuggaacugaauaccauuaauugggguaaauuuaccagguagcuuauugaaaauguuuuuuuucuugguuuuauguccuuuuuaaaguaaucucuuucuaguucuguuucucuuuuccuucuuguuacuggaaucuugacuucaccauuuauugauaauaugaucuugaacagcuuauugaaaacuuauaguuucuucauuuguaaaaacgguguaauaauuuugcucaccucauagauuguugugaggacuaaacaaaaugcuuccuggaacuuagcacucuuuuagcugccaacauggcuguuguugauuucuauccuguugguuacuuuauuaucauagucaacauucucuucuuaauggaguuugaggucauuuuucagugcuuugaugcuuucaaugauggaguaaauccuugcacauuuguccuuaaguccuuuggccuugguuuuguaggacagauucaagugggauuguugcaucaguggucccaaauauauuuaguuuuaauggauauuuccauauuacuuuccuaaggcagaauugaguaaugugggaaaaggcagcaguuuucuguccucucaacagucuguaagagugccuauuugcccauaaccuugucagcaauggauuuuaucaauccauuuuuuguuauuguuguuguuauuuggagauuaauuuucacuguuguugcccaggcuggagugcaauggcgcggucucggcucacugcaacuuccaccucccaguuucaagagauucuccugccucagccuuccgaguagcugggauuacaggcgcccgccaccauacccagcuaauuuuuuauauuuuuaguagaaaugggguuucaccauguuggccaggcuggucuuuaauuccugaccuucagguaauccaccugccucggcucccaaagugcugggauuauagacgcgagccacugcggccagccuuuuuuuuuuuuugaaauaauuauagacucacaggaaauugcaaaaauaguaccuagggucccauguacaguucauccaguuuccuuuaaugguaauaucuuauguaaauauaguacaauaucagaccaggcacaguggcugacaccuguaaucccagcacuuugggaggcugaugcguguggaucacuugaggucaggaggaguucaagaccagccuagccaacauggugaaaccccaucuacuaaaaauacaaaaauuagcugggugugguggugugugccucuaaucccagcuacucaggaggcugaggcaggagaaucgcuugaacccgagaggcagagguuacaguaagccaagaucgcaccacuguacuccagccuugcugacagagugagacuccaucucaaaaaaauauaaauaaauacaaauauaaauauaaauacauauuauaucaaaccaggaaauugacauuggcauaaaacuguuaacuauggcuugggucauuuucuuucuuuccaucugaccaauggcaucuugauuuaauuugccuuuuuauaaccacuauuaaguuugagcuucuuauuauacauuuuauugguaauuuacauuuaugguuuaugaaucauuuguucacguccuuuuuuccauuuuuuucuaaugagcuauuuguuuuccuaaagaauaucuucuuaggacuauuaaucuuuugucugccguauguuuugcaguuaauuauucuagcuucauauauuuucuguaguuuuguugcuuuuauuuuuuuccuguguagaaauuuuuauuuuauacagucaauauguuucuuuggugguuuuuggguuuuucucuuuuguggaaagcuuucucugucuucuagguuauacuguuuucuuuuguuauuuauuuauuuauuuauuuauuuuuuaagccauggucucacucuguugcccaggcuagagugcaguggugugaucauggcucacugcagccucaacuuccugggcucaggugaucuucccgccucagccuccaaaguagcugguacuacaggcgugugccacaaugcauggcugauuuuguguguguguguguguguguguguguguguguguguguguguguauuuuuguauuuuuuguagagacagggguugcucagacuagacucaagagauccacccgccucagccucccaaagugcuuggauuacaggcaugagccacagugcccagaagauuauacuguuuucuuuuaaucuuuuauauuuugccuuuggcuuuuaauucauuuggaauauguuuuuguauauacugugugcacauuccccccagauguaugagauauucuagcacuacuaaacuguuuuauuuaggacuuuuucagcuucuugugacuuaaaucucaacaaaauuccaaagguaguacuggcucaaggcaagacuugauacacuggugagaagcagcugcaacgcugagcagaggaggcaggaucuggagugugagcaguagcugggugggcaccauggcugggaucaccacuauugaggcagugaagcacaauauccagguucugcagcagcaggcagaugaugcagaggagagagcugagcaccuccagcgagaagcugaaggagaaaggcgcgccugggaacaggcugaggcugagguggccuccuugaaccauaggauccagcugguugaagaggagcuggacugugcucaggagcacguggccacugcccugcaaaagccggaagaagcggaaaaagcuacugaucagagugagagagauaugaagguuguuaaaaacuggaccuuaaaagauggaauuccaggaaauccaacucaaagaagcuaaacacacugcagaauaggcagauaggaaguaugaagagguggcucguaaguugguggucauugaaagagacuuggaacucacagaggaacgagcugagcuggcagugucccauugccgagagauggaugagcagaugagacugauggaccauaaccugaagugucugagugaugcugaagaaaaguacucucaaaaagaagacaaacguggaagagaucaagauucuuacugauaaacucaaggagguagagaccugugcugaguuugcugagagaucgguagccaagcuggaaaagacaacugaugacuuggaagauaaacugaaaauguaccaaagaggggcacucuguacaaaggaugcuggaccagacucugcuugaccugaaugagauguagagcaccucagucucacccugcugcugcuccucccucugacccugauuccaucugaggccagccuacccaaagcugaccuuuauaacuggaaggcugcuuucuccuuucgcugcccccaccuccccugugucuuuuucgcuaaacugucucugccucuucccagagauuccagcugggcuagaggcugugcaccuuugggaacaacacuuaagggaaugugaacacaaugcauaaugccuuuaaaagcauguugugauguacacauuuuguaauaccuuuuuuguuguuuuauagcaaccauuuguaaaacauuccaaauaauuccacagcucugaagcagcaaucuauuccuuuuucacuuuuggaaggugacuuuucagcuuaaugcauauugcccuuuccauagagaagaggaaaagguauaggccugccuuacugagagccaaacagagcccagggaaagaauccauuaugggaaauuucacugcucuguaaaaaguaccccccaaaccagaaaggugauuccaggaggaguuagccaaacaacaacaaaaacaaaacaaaaaugugcuuuucagguuuucagcuuuaagauaucuuuggacaauguuauuucuuuuuuuuuuuucauuagaagugaccaaauuaaaaugguaagaccucugaaacuaaauuuuugucccaacucugcccccucucaacugccugcagaauggaucaugugccccuuauguugcagugaccacuuaauugcuauccucccuccuugaaagauuauguuuugccacugauuuagccaugugaaacucaucucauuauccuuuucuggguuugaagcugcucucucuaaaagugcuaucucauuguacuuuguaucagagaaaucuugaauagcuuauguacaaaacuuuuaaaguuuuuuauuauuuugaagcuuugcuucuuuggguuuguggcacccuggccacccugucuggcugugacagccuauacagugugugggcuggcaguuugcugaucuuuuaaaguuucuuucccuacccaauccccauuuucugguaagguuucaaugaggucuguuagguguacauccugcagcuuauuggcuuaaaauguacacuccuuugauguggucucuuuggggccaacugggagaaagacaaaucaauagugcaacucuuuugauaccaaauauugacacaagugucuuuuugaaauaaagaacaggucucuccaaaaaacaaaacaaaaaaggcuugauacaggcaaaaguaauacuacuuuaaaaauuuuggccaggcgcaguggcuaacaccuguaauccgagcacucugggaggcugaggugggcagaucaccugaggucaggaguucgagaccagccuggccaacauggugaaacuccaucucuacugaaaauacaaaaauuaccagggugugguggcaggcaucugcaaucccagcuacaugggaggcugagcaugagaaucucuugaacccaggagaugaagguugcagugagccaagauugcaccauugcacuccagccugggggauagagugagacucugucucaaaaacaaaaacaaauuugcuuccugacuuuucucaguucugcccuuuuugguguuggauuucuccuuacgauucauacugugucacuccucagucugucuuguauguugugccauucuaauuccagauuuuuccuuuguggucacacaaugacugugaauguuuuaggccuugcuuccuaauaccacacaagggaagagaaaggaucccuuucugaagauuccguggagaacaaguuuugguuguuuuuuuucccccccauauacccaaguaaauagcuccauagauuuuuggcccuaagucauguaucuguucuuugggguggagaguguguguguguguguguguguguguguguguguguaaaagcugauuaauuuaaaccaauuaggauuuacccccgggcugggcaugggauucagucccucucaaccacaugacugaaagugagaaaaguuguuucacaggaaauuuuuggguacugucuccaaagaagagggaacagaagccagguagucaaacuacaggggacuauggcaugaccucauguuuuucauacuaaacauaaaugauaccuuuuaaauuauuaucuguuucugcauuuucuguuuucuuccaccaacagucuaugaggguauucauuuggugauuuuuuuucucucggaaacauacuacuucaauaauaguggcuaagaguacauguuaauaucuuuuuaagcaagucucccaucauuuuuuuucuggaaauuucuuggcaauuuuuauauauuuauuugauacaaacuuugggauccugauuggaauuacauuauauacauuuuuaacauggaaauccaaaucagauaaacguagcuauggaaaucaacuuggaaaugcucaauaguuucuucugcaaaaggcuuuucuuuccuuuguuauuauucaccaauguuuuggggggaugaaaaccuucucuguauuuucgacccuggacacuuucacaguaccaagagacaguggacucaugucccagcucuucccagcagauaacuccuuagauagacuaagaauccaacagccucuucuaguaggcuuauuuuugguuauugaguagcaucaacagaaaacugagagggaaaagagcuggaaaugugggguuaaacugccuuaaaccucagguauugugaucaguuuuuaaaaaccauuuaaggaugccacacaucuccagagacuucagaccacgguuuccauuuaauugcuuccauaugaacuauguguuugcuugcuaccuaauuuuuuucuuaugugaaguaugauauuuuaucuaaugauuuuguuauuuuccuuagauguagaaacauugucuucaaguauuauagcacuauuuuaaaauauuugguuggugcaaaauuaacugugguauaauuauuaauuauauuuuauauuuuucuauagauuauuauauaccugaaauucuaguaaagaugauaaauauauauuagaauuaauaaacauuuaaccaaguugcuacauauaaauauucagaagccuacuuaauaacuuuuuaagugaucucaugauagguuugaauacaagagacaauggcaauguguuaguuucacaauuaagauucagucuggugcagcaguauacaauggaauuauuacuguuuauuugaaucuguguguguuuguguucuuuuuucucauuuuaccucuggacauuuguaaagcuugugcuaaauagaauguuuacaaaauauguuuguaauacuucuguauuuuucuugacuuaaauguuagauacuggaucagcauuaaggaauuacuauuuuguagauacauggaaaugauuuuuacauccauuuucuccauggcagccccuuucuauauugguagacuucuuauaguuuauaagauauguuuaagucaaaggaguauugacuaauuaauuuuauuuugaguguuacauaggauauucagagacagaaauuaauuguuguguuccuuaucacaucucuucuuuguuuugcagugggacuucuccucuugcaugccugaaugcaaugcuucacacaaacuccagaggugaagagggcaucuucuauaagguuccagguagaaugggaguauauacuuugaagguaaauauuuuguuggggagucauuuagaaagaaaaaacaggaagugaccacauauaaauauuugacucguagggacagaauucuguucuugaagagcuuauuuucaggaagagguaauauuuugaaaccucuacccaauacauuuuuuaaaaacuaaucuauaacuaacuauagguagaucagagaaguaacuuuauuuuuuauucuugaugauaaucuuaucuagaaagaacgaaauuaaaaugacuuauggccaggcgugguggcucacgccuguaaucccaacauuuuaggaggccgaggugggcaaauugccugagcucaggaguuugcgaccagccugggcaacacagugaaaccccaccucuacuaaaaugcaaaaaauuagccagggcguagcggugugugccuguagucccagccacucaggaggcuaaggcaagagaauugcuugaacccgggaggcggagguugcagugagccaaaaucacgccaccgcacuccagccugggcgacagagugagacuuugucucaaaaaauaaaauaaaauaaaauaaaauaaaaaauaaauaaaaugacuucuaguguuuuaaggagccccacaacauuuguauaauaauuguuucuuuggagcauucugcuuagaugcuuuacauuacauucucauuucauucucucucacaauucacaguuggggugaauaccauuuaauaauuuuuuauugcuguuuguuuuguuagauaaguacaaaaagacaggaaaaagaaauaugauuacaauuaggaaaauguauauuuuucuauagacuauuauauaccugaaauucuaguaaaaaugauaaauauuccauuuuuaugauggagagccccacaacauuuguauaauaauuguuuaagaagccucacaacauuuguauaauaauuguuucuuuggagcauucugccuagaugcuuuacauuacauucucauuuuauucucuaccacaauucacaguugugguuauuauuccguuuuuauaauggagaaagucaaaguucagaagauuggauuuucuugcccaguguugcccauauaguaucagaaccgguauaggaacccagaucugacugaauucccaagcccauauucuuucuaacauaacaagcuugcuaauuucuuucuuuucuuucuuucuuucuuuugacagucucgcucuguugcccaggcuggagugcaguggcacagucuugguucgcuacaaccuccgcuuccuggguucaagcgauucuccugucucagccucucaagaagcugggauuacagaugcccaccaccacgcccagcuaauuuuuguauuuuuaguagagaugggguuucaccauauuggccaggcuggucucaaacuccugaccucagguaauccacccuccucggccucccaaagugcugggauuacaggcgugagccaccgugcccggccuucaagcuugccaauuucaaauuccugcacugagaagagaccuuuacuuaucaauaacuuuucacuuacgaacaggaaaaccaacucaaaugaguuugaguaagacaauuuauuagcuuauguaacugaaaauucuaaggaaacccaggcuggauccaggaacucaguugacaucaucaggguuuggugucuccacuuccuuuugacuucgcucucagucagaguuucuccucaucauauauaacuucagccccaaccugcacucugcaagcuguaaaucugaagagagauaagaacuaaagcaggagccucugacuuuauucugauuuggcuuaauugguuuggcuucgcccacaugaguauaccugaauuaucacacuugucaaaugauuggccaguuguagaugugguugagauuaagcuugcucaagccaggugaauugaggagagaguuuuccccaaaggaaauuuaucagcugaaggggaaugaaugcuugguaggcagugacuguguccaugcauauauguguuaccuuuuagcuuugagcugcagucaucacugugcccaaugguuguguagagccuaacauuagaaagaucuaaccuaccuacccaccugccuccuuuuuauauacuuuguugaauuuccugggguuacagggcucuauucucacauggaacuuucuguauuucuuuuugguuuuagcuguucuagaccuuccauacuguuuaaaaaauuuauuaaaugccuauucuauuguagagauuggggggaaaaaaaaaccaaaguguuuucccuauucucauacaccguuaaguacaauacuucuaacaccagauguguggagguuucuccucacauaccaagcaauucuccagcagacaucagcuggauguccuuuaacaauuagaguuccagucuguggcccguuaggaacccggcugcacagcuggaggugauuggugggcaagcaagcaugacugccugaguucugccuccugucggaucaguggcagcaugagauucuuguaggagugcguacucuauugugaacugcacauuugagggaucuaggucaugcacucuguaugagaaucuaaugccugaugaucugagguggaacaguuucaucugaaaccaucccacucccugacccuucagugaaaaaaauugucuuccacagcaccagucccugaugcagaaagguuggggaccacugcuguaauucaacuccauucugaugcuaucuaucuaucuggagacagugucagauuccacagguugagggcucaguacccucccauccccuucagaugccaacugucgcaagucccagguugugaccuguacuucugacugucugguuauaauugggguucccuccuuggguuugauuaauuugcuagaaugacucacugaacucaggaaaaugcuuuacuuacauuuacccauuuauuauaaaggauauuacaaaagauacagaugaauggccagauggauaagaugcuuagugugagguuuguaggaagguacacagagcuugugugcccucuccaggcuugccacccuccaggaaccuccaugugaucagcuaaaucauucauucauucauucauucauucauucauucauuuugagauggagucucgcucugucgcccaggcuggauugcagcagugcaauuucagcucacugcaaccuccgccucccggguucaagcaguucuccugccucagccuccagaguagcugggauuauaggugcuugccaccucgccuaacuaauuuuuuguauuuuuaguagagacaggguuuuaccauguuggccaggcuggucucgaaccccugaccucaggugaucugccugccuuggccuaccaaagugcugggauugcaggcaugagccaccgcacccagccgugaucagcuaaaucucaaagcucucagaacccaauccauuggguuuuuaugaaagcuucagcacauaugacugauuaaauuauuggccguuggugaucagcuccaccuucagucuccucccucccugagauuggggagugagugaaaguuccaacccucuagucacauaguugguuccccuggaaacuaacccccauccugagacuaugcaguagcucaccaagaggaagaaaagaugcuccuaucacccaggaaauuccaagggacauaggagcugugucagaugcuccuuuuacucaggaaauugcagaggucuuaggagcucuguguuggaagcugggaucaaggaccaaauaauagcaaaagauucuacuaguaacacuauugcuuaggaaauuauaacagcuaaaaagagcucuaggccaggaacuguagucaggaaccaaauauauauuucauacuauaucacaauauuaccucugugcuggacacuauagagacuguaaagaggguuaagcuguggccccugagcucuugaagcucacauuauaguuccuaaaauaauugccugcucucaaaauguucuuugcuuuuaaaaaaugugauaauauagagaaauaagaauuaauuuugaauaaaggaauguagccguuuuuuguuguuguuaacuuguaagauuugagcuggacuuugucagauaaguaguaagaagaagggccuuccaggacauaggaauagcuuaagcaagggcacaguuggaaagauucagaguggacuugaaaguagaguaaauuggagugauuagaccauaaucuuugcguggacuuaagugguaaagauuccagugugguaaacguuagguagagaucaaacauuggaggccuuugaaaaccugacugagcaguuuguguauggguuguugggugguagaugucacagguuuuucaggagaaaagcauaaucaaauccaaguuuaagagaauaacucaaguaggauagauuuaagagugaagcaggaaaauuugucagaaaggugguuaugguuguuuggaagaaauacucagggccugaauuaagagacuaguaaaagagauggagacaaaggacauuagaggaauaaauagaauauguagcauuuggaguggguaaaaggggcugaaaugauucuagaauuuggggcauaggcaguugauccuguacggaucacauauuuuaagaaaagaagauaauuauauuuauauuucagauacuuguugaaccuauaugacaagaugucuggcugacaacuaacucuauaaaagcuguccugcauuuugaaggaaauaauagaaaaauauaggguguguauuuuaagaaaguguauaacauaagagacggcucagagagaaauggcacuaggacauaaauuuaaaugaaaaauaccuaacuuaacuagaucagaguuuauagucuuggcuauaaugucauacggaugucaguuuuauguaggagggucacauuuuugugucugucagaauuauuuuuuaucugauuguuaaaacgaugugggaaaauaaaauauuggagguaaaaagaaccacugauaguuuuauagcuuagaaauaacauucacaggcuaggcgcaguggcacacgccuguaaucccagcacuuugggaggcuaaggcaagaggauugcuuaagcucaggaguucaaauccaggaccagccugggcaacauaguaggaccccagcuuuauaaaaaaauuuaaaaaauuagccggguaugguggcacacaccuguagucccagcugcuccagaggcugaggugggaagauugcuugcgccugggaggucgaggcuacagugagcugugauugcacuacugcacuccagccugggugacagagugagacccugucucccaaaauaacaaaaaaccacaaacacucacuaguguguuuagccauacauguguauuuuuauauauuauguaaacacauaguagcugauauuuuuugaccucuuauguugggcgugauucuaagcauuuuacauuuauuagcucauuuaacuugagcuaauugaagaaugaucuuuuaagguagguacuauuauccccaccuuauagauggggaaacugaagcaugaaagguuaagauuuuaacugcacaauuaggagaggguaaagccaggaagucuuguuuucuagucuuuggucuuggaacuauccuguuauuauaucucucacaugcuaagcugacguaguuauccuuucugauuagcauucucucucagugcagaaaccaaagaguuucauaugauuuguuaaaugauuucuuucuuuuucuuuuuuucugucaggaagaaccuucauuuaaaaaaagauuucuuuuuuauuuaauucuugcuacuuacuaaccaauauucaggaaccaauuagauucaaauaaugcacuaucucuuacugucuagacucuuacucuguaauugaauucagaguacauagugguacuuacauacacacauggacauacauauauuuaaugaaauuauuuuauuuaguuuuuugagacaggaucucacucugucacccauguuggagugcaguaguacgaucacagcucacugcagccucaaacuuccuggguucaggugauccucccaacucagccuccuaaguagcugggaccacaggugcacaccacuauaccuggcuaauuuuuguauuuuuuuuuguagaggugggguuucaccauguugcccagguuggucuugaacuccugggcuuaguccucccaccuuggccucccaaguagcugugacuacaggaguguucguuccaccaugcccagcuaauuuuuuuuuuuuuuuugcauuuuuuuuuuguagagacggguuucaccauguugcccaggcuggucuugaacuccuggucucaaacauucuaacugccuuagccacccaaaguguuagcauuacaggugugaaccaccacgcccagccaauaaaauuauuauguaguuuuuaaaauguaagaguauuuaaucauuuaccuggacucauaucuacccaauuuuugucuaauuuaagccuguguugugccugcauaugaauguuguauauaauuuuuaucuucggauauaguuggaaacauuagcuuauuugccucaaagagaugacaggaauucagaaaauauugcugguucugcuacugaauccuauaguaacaaaaauuagugcaauuaaguugcaacauugcauaucagaaguuuuaauuucuguuugcuuaaaugguaaugauuaauccuaauuggaugccuacauuuucagaaagaugugccggauggggugaaagagcugucagaagguucagaagaaagcagugauggucagucagauucccagaguucugagaacagcagcagcagcagugaugguggcagcaacaaggagggaaaaaagagcagguggaaaaggaaagguaaauccaccugauccuucaauaaaguacuaaaugcuguaggacaaaugcccuuguuaguaguuccucuuuucccagacuccaggucagucagucacuuucccuuacccucuauaacaguccugucaaggagaguuuucugcaaugauggagauguuuauaucuuuacuguccagcacaacacaguagccaguagcuacaugggccuauugaauacuugaaauaugguuauuaugaccaaggaauuuaaaaaauaaaaaugcuuucuuuuuuagagcuguuucagguucacaauaaaauugagaggaagguacagagauuucccauguaccccucccccgccacaugcacagccuuccccacuagccacauucuccaccagagugcuauauuuguuacagcugaugaaccuacauuggcacaucaucacccagaguccaugguuuacguuagaauuuacuguugggagaguacauccuauggcuuugaacaaauguauaacgauguguauucaccauuauaguaucaaacagaauaguuucauugcccucaaaucuucugugcuccagcucuucaucccuuccugccuccuaaccccugacaaccacugacuuuuuuuugagacggaguuccacucuuguggcccuggcuggagugcaauggcgugaucucagcucauugcaacuucugccuccuggguucaagcaauuacccugacucagccuccuaaguagcugggauuacaggugccugccaccaagcccagcuaauuuuuguauuuuuaguagagaugggguuucaccauguuggucaggcuggucucgaaccccugaccucaggugaucuaccugccucggccucccaaaaugcugggauuacaggcgugagcuacugugccuggccugacaaccauugauuuuuuaauguuuccauaguuugaccuuuuccaaaaugucauauaguuggaaccuuuucagauuggcuuuccuuaaguaauaugcauuuaagguuccucugugucuucauggguugauaagucauuucuuucuuuuuuguuugaacuuuuaaguucagggguacaggugcagguuuguuccguaaguaaacuugugccauggguguuuguugugcagacgauuucaucacccaggaauuaagccuaguacccacuaguuauuuuuccugauucucucccuccucccccacaccacccucugaaaggccccaguguguguuguuccccucugugugucauguauucucaucauuuagcucccacuuauaagugagaacaugcgguauuugguuuucuguucugguauucauuugcaauaggucauuucuuuccauugucugggugugccacaguuuguuuauacauucaccuacugaaggacaucuugguugcuuccaaguuuuggcaauuaugaauaaagcugcuuuaaacaucuaugugcagauuuuguaugugcauaaguuuucagcaccuuuggguaaaugcuaaggagugugauugcuggaucauaugauuaagaguauguuugguuuuauagaaacuuccagucuaccaaagugacuguaucauuuugcauuuugcauuugcaccagcaguggaugagaguuccuguugcuucauguccucgucagcauuuagugugguuauuguuguggauuuuggccugauagguguguaguaguaucucguuguuuuaauuugcauuucccuaaugacauauguuguggagcaccuuuucauuuacuuguuugccaucuacauaucuucuuucgugagaugucucaucaguucuuugacuuauuuuaaaaucagguuguguguuuucuuauuguugagcuuuaagaguucuuuguauauuuugaguaacaauccuuuaucauaugucuuuugcaaauauuuucugugucuugucuuuuuuuguuuugagacauagucucacacuguugcccaggcuggaguacaguggagcgaucucggcucacugcaaccuccgccuucuggguucaaaggauucuccugccuuggccucccgaguagcugggauuacaggcgcccgccaccacacccaacuaauuuuuguauuuuuaguagaggugggguuucaccauguuggccaggcuggucuugaacuccugaccucgugauccacccgccuuggccucccaaagugcugggauuacaggugugagccacugcgcccauccagcccgccgcaccugucuugucuuuguauuuucuuggcaguuucuuucucagaucagaaauguuuaaugaagucuaguguaucacauuuuuucuuuugugaacugugucuuuggucuuguaucuaaaagucaucauaaaaccccuagauuuucuucaauguuauguuauguucugggaguuuuagaaauuuucauuuuuguuuaggucugugauccauuuugaguuaauuuuuugugaagcgugugagaccuguaucuggauuucuuuucuuuuugacauguggaguucuaguuaggaauuuaauuuugauuuuauuuuaacuuuaaauagccacaugaggauaguggcuaccacaccagacaacauucuagguuuuaccuggauuuguucuuaaggucuuaagucauccauagccuuuuaggaugcuuuuauuuuacuugccuaaacuuugagcacuuaaugcucuaacaacccuccuuaggaaaagaaugcuuuucauuucuacuagcaaacacugaauuuagucugcuggucuuugcucuuauuccguuuggugucuacuucauaacucaccugaaaagcuuucguuagggaauaaugucuguugcugcagcuucccuggaauggauuuuccaguuaaggauaugaauuauugccuaauuacugcuaauuauucuguagcuucuugucagagucuauucaaagagggcaaaucuuguuuaucccaauauuuauaauuuagcuguacauggcaaggcaaauuuuaaaccaacucuugaugauuccuuuacaaggacugacauguuccagagcaaaacagacauucaagauuuuuucuagcuugaauauccuuuuagauuugagugaugauaggugaguugucuuuggagcuagaagcucagguuauguuggaauacuagacucauucauuuaagucccuucagaaugguuacuaugccuauauuagaaaaauaguuauaauucacuaccaucccucuguuaauguuuuugcuacuccuggagagaauugagauaauugauggccucaucuguucucugcuauagcuacuacauacauaauuugagcgaacuuuguaaucagagaaucuuagcuuuaaguugauaaccacuuagagagcuacccagaccucaauuguuaggaauaaauggaaugaaagcaagacaaagagggugcuucugacuaguuaauuguugaugugugguuuuaaauuaaucccugucaguagugaaaagagguguaguccagggcccuccauucccugggguccacuaagcacguauuuuugaaaaagugaagccaaaaguguaaagggcugucucuauccccugcuucuccucauuuuauuuuuuuuuauuuuaauuuuuucgcuucuuuucacaaguguugauucuccucauuuuaagcuuuuccuuuuaaguuuggaauuguagaucuaagauuaggagccaagccaggucaucaaguaagggaagcaauuagcaagauucauguuuucuggaugggauugggacagggaaaucaauauuaaagaaagucuuguaaaaugggaauauacuuggggcccuugcuuuucaagagccacauaugcugcucuuugaauaguggcuguuguaucuguguuucuuuugcuuauaacuaacgguuauuaauggcugucucuaagaauuugaggugaauguguuaagauguaggaagauccaagaauuaaccauagaacccuauugucaguagccgaauagguagauaugaauaacauaaccuugcuccacacucugcauaauaauagaagacaugaacaauaagguaauaucaaauugaauauuggguccaauuguuuuugagcugcuuuucauuuauuccuuuucuagaaauuauuauaauauugauuauuuguccucaguuuacaguaagaugagaugcucuauaaagcucuuuucugguugcagguagucuauaauaaagccuagaggaaaaugggcggugugugguaucuagaaggugaggugagaggugcgcaugaugucacaugugauucauguuuaagcagcucugauauucucaagaaaugaaugccaagcuaccaauuaugaagaaugauuuagucucucauagaauaugcaucugucuuucaugggucauacaugugauauagauaccauauaauuuguagguauauauuauauauuuguggauguuuuuguaguccagugcaaauuaaagugacagacauguagccagcagugaguauacagcaaagcaguucuaaaucuuaguuaucaauaaagguaaagcaagcuaauugugccuauuacuuuuucuuauuucgggccuuuacucucaaucugacaucacuuuauuucaaaugcauuguaagacaggaagaacacugagauaguaucaaaacccacuuccuuuuauguacaaaaauaaagagcucugacagcaaaacugauacuucuaguugaaaaucgauagaaacuuucuugauauauguauaccuuucagccaaauaggaacagagaauagaacuuugaaauucaguccaauauuaaaacuaguuuauugauuucuguguaaaguggaagacuuaaaaguuuguaguuuugguugcuaguuuucagacaggauacacaauguucagagaagaguuuuauggaauuccaaauaaagguaagguggaauaauaacuucagaaaaaugaauacgaaaaucacuauuuauauugcuuuuuuaugaucauagcuaagugaagucucugccuuuuccccaaaauaaaauauugcauuaugaagcaacuguaggacuauuauuuuuaucuucugauagaaaaaguuuuguuuagauuuuggucugcuuuuaaagugucuuaagaaugaaauuaauuacauaaaguauaccuuuucucuguaaggaaucacuguuuccucuagugugaacuaauguuaauuuuacugcuuguucagaacuacuuuaaaucaggaauuugauauauauugugucuggaguuauuuaaaauaccauaaaccuaucuaccuucuaacauuuacauguguguuaaguuacugaauggguaugauuaugucuccuuuuaaaaguauacuggaggcaaaacuuuuuuuggcaaguuaacuuagauggagagagaccuuuaggagauuuucucuuuuccucugagguuauuauugguggcugaauuggagguuuuagcacuguguuguguuaaagauggcuacacuguuagggcuuuggauaguuagacuacccagaagcaaggaaaguguugagguguggccuuucccauuuaggccaggggacucugaauauaaucaggaaacaccgccugccuaguuuggaguagauugcacuugguguuggaggaagggacuuagaacuaaaaaggauccauuaccucuaaagaaagaccuguuagaauaaaaacucucccucaagagaaacauaacuguuucuaaagaucaaaaucauuucggaaacuucgauuauuaucagugcuucaacaaucaauucuucaacuauauauaguucuuaaguuucaauuuuguuaccaauccuucagugucugaucucucccuaauacuucauaggggcccauuaaaugucuuugggagaaaauaaaaauuuaagucagagauuauuuacuuaagcuuuuaacucaaaugcaucuacuauuaauagucuguaucuuuuugaccuuguucgacauuauaaucauccauugaaauggaaaauucucaaugcuguaauaauguauguauguaccuuuugacuuaaacucagugagcaguauguaaauauccagcaacgagaagcuacugcagugaacuauguaaaacugacugauaagccucaaguuccaaaauuuguuuuguuauauuuauuuuauuuauuuuuugagacagaaacuugcucugucacccaggcuggagugcaguggcaugaucucagaucacugcaaccucgccucccggguucaagcgauucuccugccacagccuccccaguagcugggacuacaggcgugcaccaccauaccaguagagccagaauuucuccauguugggcaggcuggucucaaacuccuggccucaagugaucugcccgccucagcuucccaaagugcugggauuacaggugugagccgccacgcccggccuaaaauuuguuuuaaauguuuuucugaaaacacuuaauauuaagcuuuaaaaaaaaaaauuuaucagccgagugcgguggcucacgccuguaaucccaguacuuugggaagccgaggagggcagaucacgugaguuaaggaguucaagaccagccuggucaacauggugaaaccccuucucuacuaaaaauacaaaaauuagcugggugugguggcgcacaccuguaaucccagcuacucgggaggcugaggcaagagaaucacuugaacccaggaggccucggaggcugcagugagccaagaucacgccacuccacucuagccugggcgacaaagugagacacuguuucaagaaaaaaaaagaaaaaaauuauuuacuagauuacucuuuggguuucuuuuauguaaugauuuuuguuuuuuuguuuuuaaucaaauaauaguaacucgaucuuuugaucagaauuuguuaaucuuuuauuucuauauguuuauguagaagcaagcauuuuuguuucuaauuagacaaaaaaauguguuguuaagaauuguuuuaaucuguugagcaguccacauuggaggauaaaguuauaauccuaaaaaguguuguuuaagccauuaguuuauugauaacaaccaaaguaauaucuccguuuaaacuacuuguuaggcaggcugugguggcucacaccuauaaucccagcacuuugggaggccaaggugggaggaucacuugagcccaggaguuugaggccagccugggcaauauagugagacuccugucucuacaaaaaauaaaaaguaaaauuagccgaaugugguggugugugccuguagucccagcuacuugguagacugaggcaggaggauugcuugagcccgggaguucaaggcuacaguguucuauaaugggaccacugcauuccagccuaggugacagagcgagacccugucucaagaaaugaaugaauaaacaagcaaagaaacuacuuguuacacucaugccuucuccagucuguauuauuugccagguauuugggaaacaaauuugaaugaggugucaaccccacccuuaaaguugucucagcauaucuagagggauagaaaaauaaguagauaauuagcacaugacuucauaaaucacauguguuuauauuuaucauguuaugacagcauuagagaagggauacuaaguuaacuuugccuggguuacuaaguauuagcuauaaaaguucuaagauacuauucuucucuggagaguuuaaucacuagggaagacaggauguguuauggaaagaaaacauauauaaaggcaagaagaugagaauguauauaguguuuucaggaagccguaagaagauaaauguggcugggagaggggauuuguggagggaaagaaauuuggaucauaugguuaaccuuuagugauagucuuauuauuuacaagauauuuguuguacaaaguuccuuuuuuuuuuuuuuugagacggagucuugcucuugucgcccaggcuggagugcaauggcaugaucucggcucacugcaaccuccccaucguggguucaagcuauucuccugccucagccuccugaguagcugggauuauaggcgcccgccaccacaccuggcuaauuuuuauauuuuuaguagagacgggguuuugccauguuggccagacuggucucgaacuccugaccuugugaucugcuugccucgggcucccaaagggcugggauuacagguguaggccuccacgcccggccucacaaaguuucuuaggaaaauuaagguauagauaagagagagaauggagacacugaugacucuuccaaauuuucauagccagacaccaggaagaucaagacuguuuauaggcugggugugguggcucacaccuguaaucccauuacuuugggaggccgaggcaggaguaugacuugagccccguaguucaagaccaccuugggcaacauggugagaccuugucucuaaauaaaaaacagcugguuuugguggugcacacccguagucccagcacuuugggaggccaaggugggaggaucacuuaagccuagaaguuugagaccacagugagcuaugaugaugccacuguauuccagccugagugacagagagagacccugucucaaaaaaaaaaaaaaaaaaaaagacaaaaaacuguuuauugacucuuuuuuuguuuguuucauauuuuuguucauuaaguuucugaguuaauaaacuagcgucuuuuguuuuucugcucacuaguguuuaaguuagcucuguuucucaucacugguauauaagcuaaaauuuauuuuuguuuugcuuuugaaaaccauuuguuguagguagaauacuuccuugguguaggaugacguuaauuggugacauuaauugguuucauuugaaguaaaacugguaauagagaaguauaagggauuauuuuucuauaaguaccacuuugugagaaaagacuauaaacagggucuugauauaguuaaaauaaagcuuuaauuuuuuuccuuuuuuuauguuuuuuuuuaaccaaggucuuauuuuuaauaguucuguuuuuguuuuuuuuuuuaagauguaguccuaggaaaccuugcucaugcgcuucucacaccccccccacccccaccccgcaacugcgacucauaucaccaccaccucaguuagcuaguuuauucucaaauuauucaucaucaaggaccaauuuuuuuccucuaguccauuguggacucagaaugacccagcaaugucaaauuucuaugaaaguaccuaaauguucuugcuuucaugcuuaucuugucacagaccagucuguggacauuugaacagcaauaguuuagaugauuuuucagcuuuacuuuaaaaaagggggagagggugccaaauuuuaucuuuaaaggagaaacuauaugaaaugaucuugucccuuuuuuaaaaaauucagaacagaaaauaacccccaucucccuaguaaauaauuaacuauuacgaugcuucaucagcauugugaaaacauccugucaucuccaaaucgcuacugguccuuucucaaaaguaaccaccguccugauuucugucaguuugggucacuugccuauuuuuaaaauuuuaaauuagauuauaauauauauggaugaaguacuauuucucugaaaugcuuggaaccagaaguguuuuggaguuuggauuuuuucagauuuugaaacauuugcauuauuuggguugggcaucccaaauucagaaaguucaaaauccagaaugcuccaaugaacauuuccuuugagcaucguguuggcacucaaaaauuuucugauuuugggcauuucauguuuucugauuuggaaugaucagcuuguauucauuaaaguacacguaaguauacagcuuguuggauuuucacaaacagaacaguacuaugaacuaucaaccagauuaaggagcaaaauauugcccuaguaucucucccugagcucucuucuggucacacccauugcuccaaaauaaccacucuaacaacuuccaauagcauaaacaagacaugucuagaacagaauaauguccagagaaauuuuuaaacuuacauaaucaagucauacuuaaauaauuuuuugcuauuacauuauuugcauguguguaagaaucauucaccuucugguguguagaaauacaucagauucuuaaaacuauauagagugguuauuuuggggcaauggguaugaccagaagggagcucagaaaaacccauagcauuaauaaaaaaaauugaacugcagaaaaugcaguaauauauuuuuuaaaaagucaguagaacuaaaauggaucuauagauucaauggaauccuaaccaaaaucauaguagguugaugggagaggggacauguggaaacugacaagcugcuucuaaaauuuacaugaagaugagaucaaucagaaaagccaagaaaauauuaaagaacaaaauggaaagaauuaaacuauuaaauaucaggauuaaucauaaagcuagguaauuuucuaaagaaaaaaacauacuggguacauuaagaaguugcauucaucaaaacguaacuuuaagagagugaaaaggcaagccacagagaaguuauuuggaauaaauauaugcaacaaaggaauauaugaggaacuccuacaaguuaguaagaaaaagagaauucauagaaaaaugggcaaagacuagaacaagcauugcacaaagaagauaucaaaaugauuaauaaugaaaaggaguccaauuccguuagugaccacagaaaggcaacuuauaaccacaugcgauacuauuacacacccaccaaaguccaaaauuaaaaagacugaugguaccaacugcuagugaucaugugaaauaacgggauucuuauacacuggugguaagaauuuaaacuaguacaacuaguacaacuacuuuggaaaacugcuugucuguccauaguauagcuaauucuacucugguguauauacccaacagaaaggaguacaaaaagaaauuuuuuuaaaaaguagaauuaauuguaauaggcaaaaaauaaaaauaaccuaaauguucaucaaagauaggauaaaugaauuuggguacugguggauguuuaugcaaugaaaauacuauauacacacagagaggaaacugucuuccuguauaugcaugugcgugugcacauuuuaaugauaacuuuauucuuuuaucuuuuacauuuagaucuauaaaccauguggaauuuuuuuguauuaugugagaugaggaucaucauuuuauuccuuucaccccguagggauaucuuaauuaccuagcacccuuuuuugaagacuucuuucauuuacuuuauugcaguguucucugucauaagucaauugaccauauaguuaugguuugguuucuggacuuugcuuuguucuguuguguuuugucuuuccuuguaacaguaccacccuguuuuaauuacuuuagcuuuauuauuaauccugauaucuaauaguuuaauucuuuccauuuuguucuuuaauauuuucuuggcuuuucugacugaucucaucuucauguaaauuuuagaagcagcuuguuaguuuccacauguccccucuccccucaaccugcuaugauuuugguuaggauugcauugaaucuauagaucaguuuuaguucuauugacuuuuuaaaaacuauauuacugcauuuucugcaguucaguuuuguucauuaaugcuauggauuuuucugucuuacaggucuuugcacacuucuuaucagauuuauuccuugacauuuuuuauucuguugugaauggcuuuaacuuuuuuuacuuuauaauuguguguugcugauauauagaaauacaguuuuuauaaauugacugugucuuugaagugucuaggauuuuaccugauuuguaaguaaacaaagcgauuagccucucauggauuuuaacagaagaaacaagaauccugggucauagaaaaaguacuguauuacccaugauagaguaagcaauauggcuaccagcauacuuuucgugucagcuuucccuuaccccaagacucacaggugaugagauacaggcccagguguauccuauuccugcaguggguuugcaucucagccaagaaacauuaguuugagggauucacugcuuuuagcagaagcaagcauauuuugccugggaagagacauugccucaucucaugguugcucugcaacugcaaacauaacccugaaagauggcucagguaaagaguguucugggacuuaaaacauuguuugcauuccucguguguauacacaacagcacucggggccugugguggauuuccucucugaauauugacacuggauguaacaacauugcaaaauuaauuuuuaaaauauauuaguuuauacauaguuuuaugauugucuacuuauacaaauauguaauuuaugaauaauggcaauuuucuuuuucuuuuuuuuuuuugccauuuuguaccagccaggacuuacagaaaauaguggaacagacaugguacuaucaauuauccuuuucauucucuaccuuuaagguaaagcuuuuaauauuauaauuuuuguuuguuuguuuuugagacagggucucucucugucaccuaggcuggagugcaguggugugaucucggcucacugcaaccuccaccuccaggguucaagcaaauucucaugccuuggccuccugaguagcugcgauuacaggugugugccaccacacccagcucauuuuuguauuuuuaguagagauaggguuucaccauuuuggucaggcuggucucaaacuccuggccucaagugauccaccugccuuagccucucaaagugcugggauuacaggcgugagccaccaauacccagccuuuuaauauuauaauguuuuaagaaugaugugggccgggcgugguggcucacgccuguauucccagcacuucaggaggccaagacaggcguaucacaaggucaggagaucgagaccauccuggcuaacacggugaaaccacaucucuacuaaaaauacaaaaauuagccgggcgugguggcaugcgccuguagucccagcuaccugggaggcugaggcaggagaaucacuugaaccugggaggcggagguuccagugagccaaaauugcacuacugcacuccagccuggugacagagcaagacuccaucucaaaaaaaaaaaaaaaagaaugauguggaguaguagguuguuuguagauacuuuuuaguagaugaaguuaguuuccuuuuauuuguaauuugcuaagagauuuucuaauacacagauguugaauuuuaucaguugcuuuuccuucauguacauaauuccuguagugaauuauauugauuuuacguauuaaauguuaaaccaaccuuguguuccuuggauaaaccaacuugguugugauauauuauuaaucaucuguaucauagauuuuauuugcucauaguuugcguuuaacucuaagguuugccugcauguuuuccccauauaaugucccuguuaaaauuugguaucauaaaaaaguugguaauugguuuuugguucucugaaauaauuuguauaagauuguuguuuuuguaggccaggugcaguggcugacaccuauaaucccagcacuuugggaggcugagguggguggaucaccuaagguuaugaauuugagacucagccuggccaacauggugaagucccaucucuacuaaaauuacaaaagugagccaggcgugguggugggcaccuguaaucccagcuacuugggaggcugaggcaggagaauugcuugaaccugggagguggagguugcagugagccaagauugcaucauugcacuccagccaggggacggaaugagacucugucucagaaaaaauaaagauuguuuuucuuccuuaaaagguuuggggggugggcacagugacucacuccuguaaucccagcacuuugggaaauggaggugggccaaucacuugaggucaggaguuugagaccagccuggccaccauggugaaaccccaucucuacuaaaaauaaagaaaucggccugacauggaggcgggugccuguaaucccagcuacuccagaggcaaggcacgagaaucacuugaagcugggaggcgcagguugcagugagcugagauugugccacuguccuccagccagggagacagagcgagacucugucucaaaaaauaaacaaacaaacaaauaaauaaauaaguuugggagaauuuccugauagaaaccugggcugaaauguuccuuuuuagggauauuuuacuuuuaauuaaauucaucauaaauaugguaaaacauacagaucacaagucuauaauucaccuacaugaaugggaauaugaguuagaauaaaugagaauacuuauaauuccuugacuuggggaaaaauucuauuagccugggcagcacuauaauagcuuauauucaaugaaugacaguguuaaguucacaccaucuguauagcucuggaaaauaggcuaaauaaaaacaaguguuaugcuucaaauuguguccccuucaaaaagauauauugaaaucauaaccucugguacaccagaaugugugcuuauugggaaacagagcuguuguagaguuaauuaguuaagaugaagucauacuguaguagggugggucauuaguccacuaagacuagugucuuuauaagaugggucauaugaagacauggagacaugaagagagugccgugugacgauggagacgagguugaagugaugcugcuauaacccaaggaaugccaaagauugcuggauguuaccagaaacuaagagaaagggacggaauagcuuaucucacagaaggaaccauccuugcugacacaucaguuuuggauuuucagccuccagaacugugaaggaauaagugucuuguuuuauaccaccuagguuauguacuuuuuaaaaugacaggucuggggaauuaacauagggaguaaaguucauucuucauuauacaauguauucaguauguuauauucccaugaaaucuuuuaaaauauuguauagucaucaucucugcugccauaaucuuucuguuaacauuuuaauuaucuuccuuaagugagacuugcagccaaagcugaaggaggcuuacauauacaaggguuuggugccaccuacuuucuuaauuucuuuuuuuaguugggagacagggucuuacucugucacccaggcuggaggcaguggcgugaucacaacucaagugcagucucaacuucuuaggcucaggucauccuccugccucagccccccaaguagcugggacuacagcacgccaccgcaccuggcuaacuuuauauuuauuuauuuauuuauuuauuuauuuauuuauuuauuuauuuagagauggaguuucacucuuucgcccaggcuggagugcaguggugugaucucagcucacugcaaccuccgccuuccgauuucaagcaauuuuccugccucagccucccaaguagcugggauuacaggcaugugccaccacgcccgacuaauuuuuguauuuguaguagagucgggguuucaccauguuggccaggcuggucuugaacucuugaccucgugauccucccaccucagccccacaaagugcuggcauuacagucgugagccaccgcacccggccauguauuuuuuuuuuacauagacaagauuuugccacguugcccaggcuggucucgaacucaagugaucccacccgcuuuggccucccaaaguacugggauuacaggugugagccacuguguccagucuggaaggcaguuuauaauacugaauaccuccugucaauaaggacaaacuaaaagaagcaaacuacucuaaaaauuagaaaaaaaagaauaauaaaguaaacuaauagauagcugaagaaaauaauuuauaauaaaaaaaaugguggaaauuacuaaauuagaagagaaaaaugguagaaaagguugguuuuuaaaugaaucaauauaauagacaaacuuuguuaaccuccuuuuuuuuuuuuaaaggaaaaaaccaugaguauauaaauucagguugaaauuucaaaacaauuaaaaaaccaucagacuuuuucacaguacuuuguagaugaaaugggauacuuuucuaggaaaauacaguacacaaaaauugaacccaguagagauagaaaguauaaauagaguuucauagaaguagaccuguguuagaacuccccuucaaaagaacacuguacccacauguucagagaaauucaaucauauuuuuauuuuuuaauuuuuauuuauuuauuuauuuugagacagagucucauucugucccccaggcuggagugcagugguacgaucuuggcucacugcagccuccgccuccuggauucaagcgauucuccugccucagccugccgaguggcugggauuacaggugugcaccaccaugcccggcuaauuuuuuguauuuuuaguagauaugggguuucaccauguuggccagguuggucucaagcuccugaccucaagugauccgcccaccuuggcuucccaaagugcugggguuacaggcgugagccaccaugcccagccagaaugcaaccauauguuuaaagauaauaaucuuaauguuuuaaacacuguuacagagcuagaauaaaaaacauaacuucuaugcuugcugaaaaggucuuugaauaaauuuuaugcucaauaaaauugagaauugguggauuucucuuuaacguuauaacugaguugagaaaccagugucuuaagggggaacacuaguggcuuauccuuuagccagaaugagucaagaacaagauguccacuaucuccauucuuauuuaacauuauguuagagguguuuuguuuuguuuuguuuuuucugagauggagucuuccucuguugcccaggcuagagagcaguggcacugucucggcucacugcaaccuccaucuccuggguucaagcaauucuccugccucagcuuccugaguaguugggauuacaggcgcaugucaccacgcccggcuaauuuucuauauuuuuaguagagauggggcuucaccauguuggccuggcuggucugaaacuccugaccucagaugauccacccaucucagccucccaaagugcugggauuacaggcaugagccaccgcgccuggccuagaguuguuuauaucaacacagguaagcaagagaaagcaguuugaguaaccggcgacaagaaucagaaaggauuagguaaaacuacuuuguuuuuucagaugauacgauuuugcgucugacaaacacaaaagaaucaguggagauaaauauugauuaaaaagaacuguuggcccaugcuuguagucccagcacuucgggaggguagggcaggaggaucacuugaggccaggaguuugagaccaaccuggacaaacauagcgagacucugucucuacaaaaaaaaaaaaaaaaaaagaaaaaagcccgggcgguggcucacgccuguuauccuagcacuuugggaggccaaagagggcagaucacgaggucaggaguucaagaacagccuggccgauauggcaaaaccccgucucuacuaaaaauaaauagcugggcaugguggcacgcgccuguagucccagcugcucgggaggcugaagcagaagaaucgcuugaacccaggaggcggaggcugcgugagccgagauagugccacugcacuccagccuaggcaacagagcaaugacucugucucaaaaaaaaaaaaaaaagccagguguguaccuguagucccagcuacuuaggagacagggggauaccuugagcccaggaauucaaggcugggugacagagugagacccugugucuuaaaaaaaaaaaaaaaagaauuugagauuguaaauaaauagauguaaauaaaauuaauauguaauaaucagccaccauguacauaaauaauaaugaaaaagaauauauuugcgguaacaacaucaacaacaaaaaaauucugagcaucacuguuuuuuuucuuuucuuuucuuuuugagacaguuuugcucucguugcccaggcuggagugcaguagcaccaucacggcucacugcaaccucugccucucggguucaaacgauucuccuccugcgaccucccaaaguguugggauuacaggcgugagccaccgugccuggccaagcauuacuuuuuuaagauaugugcaaaauguugaaacaacucaauacccaaaaagauaaaauugcauucauuucucacacuccaggacaaauuccaaagaaauuaaaguuauaauaaauguaaaauaugaaaccaaguacuacaggaaaacaugggugaauuaauuucuuuucuuuuuuuuuuuuuuuuuggagauggagugcaguggcaugaucucggcucacuguaagcuccuccuucuggguucacaccauucuccugccucagcuucccaaguagcugggacuacaggcguccgccaccaccucaggcuauuuuguauuuuuaguagagacgggguuucaccguguuagcuaggauggucucgaucuccugaccucgugauccgcccaccucggccucccaaagugcugggacuacaggcaugagccaccacgcccggccaaacaugggugaauuucuuuuaaaaccugaaaauaaagaauuuuuuuucucugaugcuucuugaaguguacauguuuaucuuuuagucuggcaaacucacuucuaagaauuaaccucagagauaagcugucaaaaauacaaaauggcagagauuaagaacaaugauucucagacucgagcuugcgucagaaucaccuacaggacguauggugcagauuccugggccucacuucagaguaucugauucaguagaucugggcuuccacccaauaauuuucauuucuaauagauuuuuagguaguaaugauguuguucuggguaccacaucuuagaaccacugguuaagauguagucaugagaacaaaagaccagaaacaacccaaaaaaauacccaucaacaaaaucugguggaagaaaucacgaucgauauacacaauggaauucuaugcaacuauuaaaaggaaugcagaagaguuccauguucuguucuaggauauccuccaggaugcauugaguuuuuucacuuaaaucaaaguggcucccgccugggcaacagaguaagaccuugucuuaaaaaaaaaaaaaaaaucaaagugcuagacaguuggugguauaugaucuuuuguuuaaagaaauaaguaaaauuauuaaaaugggccaggcauguuggcucaugccuguaaucccagcaguuuggaaggccagugugggcaaaucaccugagaucaggauggccaacauggugaaaccccaucucuacuaaaaauacaauuagcugggcaugguggugggcaccuguaaucccagcuacucaggaggcugaggcaggagaauugcuugaaccugggaggcagagguugcagcaagccaagaucgugccauugcacuccagccuuggcaacaagaacaaaacugucuuaaaaaggaaaaaaaaaguauuaaaacauauauacuguuguauuuucacaaaaugaaaaauaugaauaaaaaugaaaggacaaacaagaaccuauuaaaaugauuuucuauagaguaauauaguuaaggaagagagcuagacuuauaugaaaguaauauguuuuguaacguuacauaauuuaaaauuuuuaauguacuuccuagaaauaagaaagcaaacaaguaugucaaauuuguggcauaaugacguagacaaguuauugugagauguagcuuagguaugggagacaagacauaaacccuuuuccccccuuuuuacagauguugaaggagacaaaucuuaaacugcauucaguagucuuaauuucaauaauuauauugguaugguuucuuugaaacuauauaguacuaagcaaaucaauaauuauaguaauauuauuaggaaccagaaauguuaggcgggaagaaacgggauaaaaauacaaaaucaggcugggcaugguggcucaugucuguaaucccagcacuuugggaggcugaagcagguggauuacuugagaucuggaguucaagaccagccuggccaacauggcaaaaccucgucucuacuaaaaauacaaaaaauuagguaggcaugguggugggcgccuguaaucccagauacucgggaggcugagacaggagaauugauugaacccaaucaaguggaggcagagguugcagugagccaagaucgcaccacugcacuccagccugagcaacaggaggagacuccaucucaaaaaaaaaaaaaaaaaaaaaaaucagaaaaaagugacagcucugugaucuucaauucaaauuugguauccaagcaugaauuucauuuucucuuucuaaaugaugacuucuuuucuuguucuagccacugaaaaguucuagaacuagugguaaccuauugacagugagcacuccuaguguggugugcacacuguagucuuuuaauaccauuuccaauuuaaauuuaauuuccauuuaauaucauuuccaauuuaaagaugucagagcuuguuggagaaguaguugauccaggucugggccaaaaguuauguaagauuugccugggacaacuuucugugacagguuguaaaaaagcugucacauauggguggagccauguucccaagacaguuuacaacuugaaggagcucccacuaggucaaaaugggacgauuugggugcuaaguauauauuuuuaaaacauuauauguaguuugagguacaguaucaaaucuuugauaauugcauuuuauuuaaauauuucacauauauaaauaucugugagaacuuauugguuuuagguauuguaugaguuuucugaaguugcagguuaucacacagugagcggcuuaagcaaacaaauuuauucucaguucugaaugccagaagucugaaagcaagauguuggcgugucugcacucccuacagaggcucuggggggaaucugcuccuugcuuucucuaaccuuuuucuugcugacuuccuugccuuaugaacacauuacuccagucucugccucugucuucacauugccuucucaucuguaucugucuucccuuaugcaucucuuaugaagagacuugucuuuggcuuuaggauccauuuggauaauccaggaugaucuugucugaagauccuuaacugaguuacaccuaccaaggcucuuuucccaaauaaaguaacauucacagauucuggagcuuacaauguggacauaucuuuuugguugccaccauuaucagccagcuauagguuaccuauucauuacucugaaaaugaaguucaaaucuuggcugugcuccuuacuggcuauauaucuuuuggcaaacuaauuaaauuuccugauauguaaaacuuagauaauaccaucauaauacgcagaugaagauguaucuuugaaauuuauuuuuguauauaaauauauauagccuuaaaaucuuuguauuuuuauuugcauagaaaaauaucauaaggaugccaaucaaacugucuuauuuaguuauuucuagaaguauaauuugaggaguuuagguaggaguagaaagaaaacuacccuaagagagaguaauuaugagaguucaaugaacuccuguuaaaaugaacuaguacaguguuaggcacauagaagauacuugucugcuguuauuaauaauaaaauuauaugucuuugaagguacucaguguagucacuaaaaggaauuauaagacagaaguuucucaacagagauaaguuuaaaucuuuaagucucuuuuuuuuuuuauuaaacgauagggucucauacugucacccccuaggcuggagugcaaccucccaaguagcugggacuacaaguuuaugccaccauguccagcuaauuaaaaaauuuuuuuuucuagagacaggguuucauuauguugccuaggcuggugucgaacuccuggccucaagugauccucccaccucagacucccaaaaugccgggauuauaggugugagccaugugccaggccuguguuuaagucuuauuugcugcuuguaauacugagucuuuaaaaguuagaacaagccuggacaacauagcaagaccccaucuuuuaaaaaaaaaacuuaaaaauuaccuggaugugauaacacauaccuguggucccagcuacucaggaggcgaagguaggagauugcuugagccucggaggucaaggcugcaguggggugcgaucaugucacugcacuccagccugggcaacagagugagacccugucucaaaaauaacauauaauaauuuuaaaaguuagaguaguaguuaaguuucauagagcaguacuuagcauuaagucaacucugggaaauguuuauacugguggguccuguaauuuucaugauuuauuuugguuggcuuaguuaaaugcugugguuuaauuuguuaaaaaggguguuuggcuuaaagguaaacauucuaagcaguuuguccugguaauugcagauagcuuuauugucacuuuucugggcugcagaguagaauuauuauauuuucuaguggaguuauucuggcuuuuuguuuucuguuuguaaucaggcaguauuugggguaggcgaggaaauguauagucuugagauuucugcaagacguuguuaagaaaauauuaauaguuuuaacuuuuacuuuugucucuuuaaaaacauuggccaaguaaaaaagacagacaauaauaagcauuggcaaggauauaaagaaaguggccuuguacauuccugguggaauuguaaaaauagugcauccauuuuggaaaacagcuuggcaauuccucaaguuaaacauagaguuacaguaagacccagcaauuccacucauaggaaugaacccaagagacuaaaagcacauacauaaaacaucugcacacaaauguucuucauaacauuguucauaauagccagaaaguagaaacaauccaaauguucaucagcugaucuauagacaaaacgugacauaagcaugcaauggaauauuauuuuacgauaaagaauaaaguauuuauacauauugaaacauggaugagccuucaaaaguaagcacuuuguugaaaaagucauucacaaacgagcacuaauguaugauuucauuauaugaaauaucccuaagaggcaaauuuauagagacaaaaaguagauuacugguuaccuaggaccacggacauagaugggguaaaagaugaguaacgguuaacauguaugguguuuuuugaggggugaugauuguacaacuuggugaauauacugaaagccauugaauuuuaugcuuuuuuccccaacauuuucaaaauaaauuuaauuuuguuagcuuacuagggaaaauuaaaucacuagucacacaacaaauugacucugaauggauugcaaaaccaaaguuuaaaccuaaauccugaugcuuuuaaaagaaaacagagaauaacaucuuuguggucuuaagauagagaaugauuccuuaaauaaaacaaaagauauuuaauauaguggggaaauaacaaaugagauuauuuaaauauauuuuaaguauuucucagacagaaagaggaggagacugagagaggguguauuagguuguuuucacacugcuauaaauaccugagacuggguaauuuauaaaggaaaaagguuuaguugacucauaguuaguuccacauggcuggggaggccucaggaaacaacaaucauggcagaaggcgaaggggaagcaaccaacuucacaugguggcaggagagagaagcgagaaagagcagggaaaacugccuuuaaaaaccaucagaucucaugagaacucacuaucacgagaacaacgugggggaagcugcccccaugauccagucaccuuccuacuucaacaagcgggugauuacaggucacuccgcugacacguggggauuacaauucaagaugagauuuggggcccagcgaaguggcucgugccuguaaucccagcacuuugggaggcugagguggguggaucaccugaggucaggaguuugagaccagccuggccaacauggugaaaccccgucucuacuaaaaauacaaaaauuagcugggcgugguggugggcaccuguaauccuagcuacucaggaggcugaggcaggagaaucacuugaaccugagaagcagagguugcagugagcugagauugugccauugcacuccagucugggugacaagagcgaaacuccaucucaaaaaaacaaaaaaaagaugagauuugaguggggacacagagccaaaccauaucagaagacuaacuaaaaaaggacaucuaucuagcauacauaaaaaacuaccacaagucaacaagaaaaagacagcuauuaauaaaaccacgagaagacaggcaaaaugaaauaacagucuucaaaauagagguuauucagugacuaaaaaaauguuaacaaguguucagcuuucuuagcaaucugagaaagccugauauaaacacagcaaccaggagauugaaaugaaaaugacagagaauaccaaguguuggcaaggauguagaaaacuuauacacugcuaguggcuucaaaauuuuguacaaacauuuuggaaaacuggcaguaucaccuaaaacugaagagauguaaacauaaaacacaauuccgcuacuacauauauacccccaaaucuuuauguguuaccaaugcauuuucuagaauuuagauacuaguacuauuccuaauauucccagaugaaaaacacucacauguacauaagcaguggaauaauugugugauauuuucacaacagaauucaaugcuauuaaaugauucacaacauggaaaacuacauauaaauucaaaacagccuacagaauguaaaaagacauguacaaaagaguuccugcugcacaauauuuauauaaaguauaaaagagguaaaaguaaccucugcuauuagaugucaauguagugcucauccuugaagauugugaccggcugggaucacaaaaagauagcugugggcuuaaaauauccuuuuuuaaaaaauuuaaauauaaaaagcuucagugugcuacccacuugugaucuguguacauauguuuaaauauuuuaauuuuuuuaacuuuuguuuuagguucgggguacaugugcagguuguuuguauaaguaaauuauaugucaugggggcuugguguacagaauacuuugucacccaggaaauaagcauaguaccuaauagguaguuuuuuuauccucacccuccuuccaccuccacccucaaguaggccucaaauuuuauacuuuaggcaagauguauaguauaugaauuauauauauauauauuauuuuuucuucugugauggagucucacuguguugcccaggcuagaguacaguggcgugaucucagcuuacugcaaccuccgccucccagguucaagugauucuccugccucagccuccugaguagcugugacuacaggugucugccaccacacccagcuaauuuuuguauuuuaguagaggcgggguuucaccauguuggccaggcuggucuugaacuccuaaccucaaguguuccaccugccucggcucccuuugggauuauaggugugagccgccgugcccagcugcauaguauaaauuuuaucuuaagcuauuuuuuaaaaauuggucaguaucaaaguauacugaggcuaugauuuuuguuuuuuuuuuuuugagauggagucucucucugucgcccaggcuggagugcaguggcguaaucucggcucacugcaagcucugccucccagguucaugccauucuccugcuucagucuccugaguagcugggacuacaagcgcccgccaccacacccagcuaauuuuuuuguauuuuuaguagagaugggguuucaccguguuagccaggauggucucaaucuccugaccuugugauccgcccgccuuggccucccaaagugcugggauuacaggcgugagccaccgcgccuggccaaggcuaugauuucuuuuugcagcugaacugucuugaauuauucaacuccauuuuuaaacaucaagcuuuuuguacaucagcucuuuuccauauauaaauuauauacuuuuucauaaagguugggauacagaacuaaacuaaguaugacgauaagucagcaucuuuuuuuuuuuuugagauggacucucgcucugucacccaggcuggagugcaacggugcgaucucggcucacugcaaccuccgccuccaggguucaagggauucuccugcucagccuccugagugccugggauuacaggcaugugccaccacacccggcuaauuuuuguauuuuuaguagagaugggguuucaccauauuggucaggcuggucuugaacuccugacuucagucgauccgccugccucagccucccaaaguacugggauuacaggcguuagccaccacgcccggccaagucaucaucuuaauuguuugaugcuaucuucuuuaaaugcaucugcugugcauuccuuucuuaggacaucuaaguaaauugaaauacuauaguccaaaacuugcauacuccaaugagcuaugcuucuacauuuuuauguccgguagcuagcuacagaacguauguaccuuuuuuuuuuuuuuuuuuuuuuuuuuugagaccaaguuucgcucuuguugcccaggcuggagugcgguggcaugaucuccucaccacaacuuccgccucccagguucaagcgauucucuucccucagccuccugaguagcugggauuacaggcauacaccaccacaccuggcuaauuuuguauuuuuaguagagauaggguuucuccauguuggucaggcuguucuugaacuccgaccucaggucauccacccaccuuggccucccaaagugcugggauuggaggcaugagccaccgcacacggucuuguguguacuuuuaugacaucuuaaagcuuauugcccuuaccaugggauaucauuuugcuauuugggccuuuucaguccaacuacuaugaauaggggaagacuuuaguaaacauucauucuucaagagucaucacuagcaguagugauuauaauuuuuuuuuaauaaggguacugaaucagcaauuucuguauuuaucguaaacacuacucacauauuguuuaauuuuauagaacauaaauaucuacuugcuguuuaagagguauagauucuuaaagaacccuuguucgcauaagacccacucagaucuggcuaaacucugccaggcaauauaaaacagcuagugaugaaguagagagugguuacaucuuaugcaaauucaaauugcuuccauuagagacaucuuaaaaugcccucucacguugguaagccuguaacuguugauuuaaaggaugaaggaauguaaggauuaaaacugugguagaguuuugaggucgaauggccuuaaugucuuuauuuuaaacugccaacccaaggcccuuccacuguaucguguugucauuagauuuacugugagaccauagauacugucuuaaaggcccuagaaucuuuccuaaguuuuaucugauuugaugagucauucuucagucaauucuauugaaaaaguaauaaaugaaaaguaaugaauacuaacacucaucccuucccuauccuaucauccuucauuagaacuuucugaggaaaaaaacugaaaagggaggcuguuugcaguaaaacuccaaaaaguacaucguucccaaaaguguuuggucauaguucuuacuccagguagcagcauaugauuggggaaggaauggugcuugguaucucuguuaacaaaaaucuuuuauugucacuuuuuuuucccuaguaucgucguccuccccgcagucaggcugcccaucacccaccauuccagcagguaaagucauuucuccaucacagaagcacagcaagaaggcacuaaagcagguaagcauugcuagucuguauuuaucaaguagaauuuccuguauuuaaaacgcacaccucuggcagucaucggauauuuuuugaaaauuuuuuacauugggcccuugccaguggaacuuucaugcaguagcccaaugugguuuuaguaauuuaugcaccucuuuguaacacauguuacauacguuuuugguagauacuuuguuuuucugagacagagucucaguugccaggcuggaguacagugggugcaaucucagcucacugcaacgucugcuucccagguucaagcaauucuccugccucagccucccaaguagcugggacuacaggcaccugccaccacgcccagcuaauuuuuguauuuuuaguagagacaggguuucaccauguuggccaggauggucucaaucucuugaccuugugaucugcccaccuuggccucccaaggugcugggauuacaggcgugugccaccgcaccuggccgguagauacucuuuuuaucacauuuuuuaaagugucuaauuuguucguaguuugcucagaaucuuuuguuuguuuguauauguguuuuaaaaucaugaauagguauugaauuuuucagguuuguuuucuuugggauuuauugagaugaucacauagauuuuucucuuuuaaucuacuaacacagagaauuacacacagcuagauuuucuuuucuuucuuuuugucuuuuuugagacggaguuucgcucuuguugccuagugcaaccuccgccucccggguucaagcaauucuccugccucagccuuccaaguagcugggauuacaggcacccaucaccacgccuggcuaauuuuuguguuuuuaguagagacaggguuucaccacguuggucaggcuggucuugaacugcugaccucaagugauucaacugccucgaccuuccaaagugcugagauuacaggcgugagccaccgcaccuggccuagauuuuuuaauauuacacuguacauaacuugguugggugcagugacucacgccuguaauccuagcacuucgggaggccaaggcaggcggaucaccugaggucaggaguucagagaccuccuguaaucccagcuacuuuggaggaugagaugagagaaucauuugaacccaggacguggagauuacagugagccgagaucgugccacugcacuccagccugggcaacagagcaagaccccgucugaaaaaaaaaauuaaauaauaaaaaauaaaugaauguacaugaucacagcagaaauagaugcaaucaagugguucuaauaaauuuuacguuaaccugaaauuacauguguccugugaggagcaaggaaugaauacuggugacugcacuugcaggaauuuaugaacaucuucugaucuaauugcaaagaaugagagaauaagcgauaaucaauggucagucaauacugccauuuuauguacuuugugcuucugccucaccuauuauaaauguaggugaggcuaagcgagacauagagcucucucaguugcuuuucugcauuggcaacuuagagugaggagaucauuuguugccacugugccuauagcauagccagagauacgugugaaauguuaagcaggaggaaacuauugggaaaagaaaauaggaaaccagaaguagccaguuacuccacacuuugcuacaugacagucuuaaaagcuugaaaauggcaaccuagcaaagucaaacuucaguuuuuuuccugaaauuacuuucuucguuucuuuuucuuuuuuuuuuuuuaaagaaaaccuuaaguuaaaaguugccuucauaauguuuuugugauuaaaauuuggguauuucuuguuuuuuucuguucauuuuaaauagcauuaucaaguauauuuuauaaauuaagaaccucauagaaaucaaaauauucugaaguagacagaaggaaccacacuguuguuagaaccaguauugucuagucuucccccucuguuuacugcuuugcuguaaauugcugaaauuugauaauugggacaaaucucauugcugucacccaagacaacugauguaguuauuuacaaacuucuguaaaaauauuguaucucugaagccugcguaaacugaauauuuacauuucuacauagguuugaugcagauagggcucuuuuuguuauaaggcuuagaauuucauuucuagaaaugauugaaaacguacugucucugcuuuacaagacugggaaguuuuuggcuuaccuagugauuuuuuuaaguuccaaaaaaugcuaaugacuuuuucacauuuauauaaaggaaugauacuggcaaaaacuauccaaacucuaagaaucauuuaggccuuguguuuaguuggcuuaauuuaaauugauaagaacagauacuacacuugaucuuagccaaaaggccaagaagcgagaguuagcuuaauuuagguuuuuguuugcuuugauagauuucaaagaaauugaacgaucagcaugcuucuugccauuuaaaaaagaaguaauuuauauuauuacuaaaaaacugauugguuuuguuucuuauagucuguuuuaucuuuauaggcgcuaaagcagcaacagcagaagaagcagcagcagcaaugcaggccaagcauauccaucuccuccaaccagcaucucucacuaaagacugucaaagcagccagugacucuguaccugccaaaccugguaggcaguuugggcaguuuuucaauggaaguuucuuuuuccuaguauuuuuauguugguuuuccugauuuguuuaugacaucauuuauuuuuaaauuauauuuacuuacacaauccuuguacugccaaaacaucaauauaaauccaggauaaaugggaaaaguugugugcaaaauaaucaugcaguuauuaaaaaauaacucagagcccaggaguucaagaccagccugggcaaaauagugagacccugucucaacaacaacacagaaaauuagccgggugugguggggcacaccuguagccccagcuacucgggaagcugaggugggaggauugguugagcucgggaagucaagacugccauuagcccugaucucaccacugcacugcagccugaaugacagagcgagacacuguuuccaaaaaaaaauguuagcacugggauuugcauauaagaaggaaauaaaugacugacuuuaaagauggucuaaucuaauaaauauuuggaaaccucuaaucagcaaccuuaaaaucugauguuuccaagaggcucaaacuaaacucuuagccaguuuucuguaaaaauaacaggguuuccuaagaauacauacaaccuuugaguuucuuuuggacaugucuguaaggccuuuggaucuuuuguugugguugcuuguuuguuucuacucuaaacuuucuagacacagacucuguauuguauuacauaauucaguuugauaccauaagcugauucuaugggccugccagacucaaucugaaucuuacagaacugcauuuuuaugagaaaggaaauuuaccacuagaagcaaauaguaugcugggaggaaaaacaggguuuuauuuuacucuuugacuuuaauuuucaaacucaaaacacauuagggagggucacauugccucauacauaacuucauuuagugaauguugaaugauugauuaauugauucugucuauaaucucagugcuaccagucuuuauacguauuuuuuucuccuagcaacaugggaaggaaagcaaucugauggacagacaggcagcccucaaaacucaaacuccagcuuuucuuccucaguuaaaguggaaaauacuuuacuaggcuuggggaagaagucauuccagagaucugagagacuccauaccaguaaguuugcuuacaaagacuucaguuuucauugccaugauuuaucagcuacauguuugaaauucaucagcuaccuggcuuagguacuuauaacuuagauuugaguuacauagcaaagauuagacauaaguuuuuuuuguugcuaacauaauuacuguuaagaaaugaaaaguaacaggaacggaauugauuuaguaugucuuucuccugcuauccccuguuuaccuuugagcucuugacuauguucauguucuuccugucuuccucuuaacaaacuuuauuucagagaaagaucuauuaucagucauuuugugguuuauuucccuuucugccaauagguugcuuuguccagcauuauucauguuuuauuucuguguaaagaaagauagaagggcguaugauuaaauauauaugacagacugaaauuucuucucucuauuccuuuugaaaucccacugaaaugauaauauagaaauacaaaagaucaaauccauacaggugaagaaaacaaggagaccacagcugggcaagagaugucagcaaauuuugagagaugaaaacuggauagaauuuuucacugagcugaagagcaguugccagggauaaagcagccacauaagguugcagaacaccgggaaggcucaagaauuggagauacaauguauuacagaagagaaggggggaauuuuguuugaaaguuaguaagaagcaguuugaugccuuaccccagcaggagacaggagguuuauuuugaagugaaauuucaaccagagaaacuccacauucagggauaucaaacauagcugggggcagaugaggaggcacuguacugaaaucuggaaaaucaaguaaaauguaaauacuguaaauacugaauagggauucuccuccuuggcuuccaaaaugcuacuaacaaggcauauuucuaacaccacuacuuccuucuuccucccaucguguucgagcuugagauugguggauugguaccuaaagacauugaauagucuuagaaaaaagucugcaggcaaauguauagguucccagauaagcagagaucaucuugauaauguuucaguaaaguugaagaaauuucuuagaaaaaucugucaaaguuaaaaagagguucaguaggagagaaaaaguaagaaacuuggaacaccaaucuaggucguacaaugucucacauaguaggacuaucagaaaggaagaacagagugugauaaaaaacaauauaagaacauuauuuagaauaaaaagccacagaauuccagauuaaaaauguguaauaggcauuaagaaacaugagugaaaagaaaccuaugccaaggcauguuuuuuuuuaaagaucucgaaacauauggggucaugaaaagguaacaaaaagccuccagaaagaagaaaaauacuucacauagaaagauucaagaauugggaguacagauauccuuagcagcaacauggaaacuaaaagugcagcagugcugacacauucugagggaaauuuauucuguauucauuuacauauuccagacugaucuaaugagaacagaauuaacaauaauuuaaacaaugcuuuguaaaaaauaaaaaauaaaaaaaccuuaguuugauucuagaggggauuguacauuuuucuuaauguaguauaucacauauuuaaaccgaaugugcccuuugaucaucaguuucacugcuaagaauaaaaauauuuauuaaauaucuauggaagaaaugcuaauaagccaaacacagauuuagaguccuagggcuaugaugaugaacagagcaauauuucuuccucauggagcgcauauucuacuuaaaaucaguuaaaauugaaaauuuuaguaaauugcaaaagaaauguagagguacaaaauugagaaauuauggaccaggaauuuuuaacuuucauggaaaacuaggaaaaauuaaccauaaaaaaagaaagcaccauuuccguuuauuuaaguuugaccuaauggcugagaaguaagcagaaguccaucuucuuucaagcaaaugagcguaaagggaaauaguguggaaauuuuuguaacauagccacaaugacuauuuucuuuuuuuuuuucuuuuuuugagagggagucgcgcucuguugcccagggagugcaguggcccgaucucggcucacugcaagcucugccucccguguucaugccauucuccugccucagccuccuggguagcugggacgacaggugcccgccaccacgcccggcuaauuuuuuuguauuuucaguagagacgggguuucacuguguuagccaggauggucuugaucuccugaccucgugaucugcccgccuuggccuccuaaagugcugggauuacaggcaugagccaccgcccccagccacacaaugacuauuuucaaaacacguggaagaaguuguguaaaacauaaaugauaaaacuaaauuagcuaauuuauauaaaauacuuucuagcugacauugguaucauuuuuauuaacuucaguaaaauugauaauaaauauuuuuacaucccagauucagucagaagacuaaacauaccucagauuucaaguauaauauaauagauuaagucaaccuaaauugaaaaaacuuggguaagucaucuuuacuaaaauuagaggacuuaaacugaccacuuugaggcacaaaaguaucuucagggaacacaguucagucaguaguagaaaauaauucacaacuacuucccagucuuuuaagaagugaacauuuuaacugaaguuugacugcgaugugcagguacaaugaaugcauaaauaguaaaaauuuuucaaggaagguugacaguccaauuccauuaauuauaugggaaaagcaaacaaagcuguugcuucucaaaaguuuauagaggcauugcaacauuguuuauauuaauacaaauauuguuuauauuaauacaaacauuguuuauauuaaacaaaaaacugguagccaccuaccuuuaucaucagugguauuccauuuaaauucaucaugguauauagcaaguuugcccaacccaccacaggcugcauguggcccaggauggcuuugaaugcugcucaacacaaauuuauaagcuuucuuaaaacauuaugagauuuuuuuuggugauuuuuauuuauuuaucuuuuuguuauagcucauuaguuaguguuaguguauuuuauguguggcccacaacaguucuucuccuuccaauguggcccagggaagccagaaaauuggacaccccugguguauacauuggaaugugaugcagcuuuuuuuaaaagaaagaagaugaauuuguaggugguaauuugaaaaaugucccaagauauuuagugaaauuaaaaaccaaauaugauuaacauguacauugugauuucauguuauccaauuuaaaaugucauuucuggcaggaagguuggguuugaauguagaaaccuuuguuuuuauuuuguaucuuuagguacuauuugaauuuauagacaacauuuaccucuuagacacuguuuuuauuauucacuuugaaaagauuuaaaauuuuauuguaauuuauucuuugucccaggaguuauuuugaaguuuuuuugguuuguuguuguuaauuuccaaauauauagggauuuuuguuuaucuuuuuguuaugaagccucuggucagauaucauggacugugugaugcuuaugccuguguggcauugugaugaacaacagacuugaaaaucaaaucgccuggguuuaaauuccuacaguaacuuaauaaugugacuugggcaaguuauaucugggccucacuuucuucaucugugaaauggggugauaauaguuaccuacuucauaggguugugugaaaaauaaaugagugaauauauguaaaugcuuagaacagugucuggcacuuaggaagcccuauguaaguugcugcugcugcuguugcucuuacugcacuacuauuacucaaaauuuacugagaccuccuuuuuuugaccuaaugauacugaauuuagaaauauacucuaguuguucaacacagaauucugugcuuguuagaucaagcuuguuaaucugaaaucagcuuuuuuuuuuuuuaacauggagucuugaucugucacccaggcuggagugcaguggcgugaucuuggcucacugcaaccuccgccucccagguucaagcgauucuccugccucagccuccugaguagcugggauuacaggcacacgucaccacuccuggcuaauuuuuguauuuuuaguagagacaggguuucaucauguuggucaggcuagucuccaacuccugaccucgugauaccgcccgccucagccuccuaaagugcugagcugggauuacaggcaugagccacugcgcccagccugaaaucagcuuuuuuagugagugauagcuccuucugguuugcuugauuuauuaauaauggagagagauguguugaaaucuccuauccaaaugguggguuuguccaguucucccuguucuuucaguuuuuauuucacauguuuugaaguuucuuuauauuggauguuuucauguuuaaaaucuuucugauggauugaauauuuauuuaccuuaucgaucaucaagucuuuuuacuaaaaguaucuuucauucgauguuaauaaauguauaacagcuccccuaugguuaguuuuugccugguguguaacuucauuucuguguccuugugcuuuacauaaucucucucuaaauagcauauaacuagcugaaauuucuuuguuuugguuucaacccaaugacaggcucccauuugaugaguuuuauuuauuuacauuuacuguguuuguuaauauuuggacuuguuucucagucauaguuuuuuauccuauggcuguuucuuguuuccuucuuauucuuuuuuuuuuuuuuuuuuuuuuuucgagaaagagucucgcucugucacccaggcuggaguacaguggugcgaucucgggucacugcaaccucugccucccagguucaagugauucuucugccucagccuccugaguagcugggauuacagggacccgccaccacgcccggcuaauuuuuuacuuuuaguagaaauggguuuucaccauguuggccaggcugguccugagcuccugcccucaagugguucaccugccuuggccucccaaagugcugggauuauaggcaugggccacgacucccagccucuuucuuacucuucuuuuaaacuucugaaaagguuuuuuggcuuuacugauuuuuuuuuuuuuuuuuuugguguguucauauuaauucucuuguagccuuuuuuuucucucuacugaguuugguaugcacucaauuucucuuuuagugguuagugauuccuuaaaugguaccacacuucuaaaaaauugauauaucauacuucuauauauuuuuuaguuacaugugauaugucuuuaauucuuaaaaguaaccaucuugauuuuccuccagaacaguggaaauacaacaauucagugcuaaucuuuucuaucuagacuuaaauaaauauuauugucuuuuuuuuguauuuuguuuuuaaccucacaaaucagacacuagaauacuauuauuuuauauaaauaauguggacauauauuuaucuacauguuuaccuuucuguauuguauuucaacccauucugcaaugauuuucuuuccugaaguacaauaagaacuguauuuauaucagguuucugaguagugaacgccuucaguuuuuguuuauaaauguccuuuccuguucauuuuugaaggauaguuugguggacaugccuuuauagauuagugguuauuuucugucagcauuuuacagauauuaucuaccuuauuccaaauuucauuuuaagaaguuuacugcuguucuuaaauuccuuuuuuuuuuuuuuuuuuuugagacggagucuggcucuguugcccaggcuggagugcaguggugcgaucucggcucacugcaagcuccgccucccggguucacgccauucuccugccucagccucccgaguagcugggauuacaggcgcgcaccaccaagcccggcugauuuuucuauuuuuaguagagacgauguuucaccguguuagccaggauggucucgaucuccugaccuugugaucugccugccucggccucccagagugcugcgauuacaggcaugagccaccuugcccagccucuuucauuccuuuuuaugugaucguucccuuccucguggaugcuuucaaguuauucucuuugucuuugauaaacacucuuacuaugcugggucuaugcauggauuucuuucuguccucuuuggaauacguuccacuucuagagcuuuaguuuuguaguuuucaucaguugcugcaaauguacaacugucaguucuuugaauauugccuuuuuuccauucucaucauuuucucauucuugagcuucagucagguauuuguuagacccucauucugucauuuauguuuuugcuaaaccucuaaaaauauuuugucuucucucucauauucugagaguauaaauuggguaaauugaggguaaauuguuuggcuauauaguguagacccucuuuaauauugugaaacuacuguuuaaucgauuucaucaauuuuuauucuacauuucuagaugucccauuuucuuaagucuauuaauuccuaauuauuuuguccuuauuuuuguaauuacauuauuuccuuaaacauuuuguacauagcaauucuguauucuguauaucugauagcuucaguacuucuaggucuccaucuguuauuucuagucucuaaugauucucucuuguaguggcauaacuucucauuuguuggguaaucuuucugaaguaguaaugccagauuuuaauuuguaggaauccagugggauuaauuugagggaaauccuuucuuuuuguuuaugcuuccgccaggaggcagaggguguacccacaucaaagauuguauagcuuugugaaagcaauucaaaauguagaauuucuggauccuguaguuuuauguauauuaacauuuugcuagauauuguuagauuuucuaagauuaugcugauucagccccaucagcagcauuugaaagugcuuuuugcuuuuucccccugcauagucccauuaccauauuacaauauuuugccauuuucauagacaaauauguucagugguuuaauuugcauuuuuaaaaauauuaauauuuuagcaucuacuuaagguuaguggacugaauuaccuuuuaauuuccuuugcucauuuuucucuuggugguauuugucuuuuucuuauugauguguaauugcuguuuucauaugaagaagagcaaccuuuugucauggcuuccaaauauuuuuuccagguuggucuuuuauauauauauaaauuuuuauuuacauuuuaauccuuuguguacucaguuuuuugaaagauuguaaccuucugguuguggacagauuuccugaaacugcuaggcuauuaaaucauaauauuuuuagccaauguaaauuaaaaucagugaaaaaaaaagucaugagaagaggcaaaggaagucaguaugauuuguagauuuggguuuucuuucuuagacauucuucauaucauuuaucauaaacuuucucaguuuuuugggggaaauaaucuagucucaaacauaaaaugcaguuuuaguaugguagaagacccauuuuuacagacuuuauucuauuuaugcagagaagguagauacauuguauucuuuuauccucuauaaaugaacaaaacuuguuuuguuagucuuagaagaaaauucuaagaucuuaaguguuaccuucuucguagugugauauuuaaaugcuuacaauuguggauuuuuuauacugcacagaaagcuacaguuuauauagaaacaggacuugugagggaggcccaaacgauucuucucuguuuuuguaggacaaaugaaaagaacuaaaugugcugacauugacguugagacaccggacuccauucugguuaauacaaaucugcgagcacugaucaacaagcacacauuuucaguccuuccuggagauugccagcaacgacugcuuuuacuacucccagagguagaucgacaggugcgucauugaacuccuuaagauuuuaaaaauagcuguuuauguauacuuguaaagugguauuaaugguacuaagugagaaguaagaauauuuuuacauaaguuucuuaauaggcagguuuuuuuaaggcuuaggaaaaaaaaauucuccuaccagaauuucaagaugacagaauuauuuugacuguauuaggauguaagcauccauagaaugaaggugaggaggaagccagacaugguggcucacaccuguaaucccagcacuuugggcagccaaggagggcagaucaccugaggucaggaguucaagaccagccuggccaacauggcaaaacccugucucuacuaaaaauacaaaaauuagccaggcgugguggugggcgccuguaaucccagcuacucgggaggcugagccaggagaaucgcuugaaccugggaggcagagauugcagugagccaagauagugccacuggacgccagccugagugacagagugaaacuccaucucaaaaaaaaaaagaauacauaaacuucaggaggaagaguugucuugguccaguaucaacaggaugugggccagugcuucaguggagugggaaaugucaggaauaagccaaaaacauggguccagauaaauaaauagaucuggaaagacaauacaacaugguaugaacagugguggacuugggaauguuugcaguuugcauucuuuuguuacauuuugcuaagagaaacauuuauuacuuucauaguaaagaacuuaaaacccaauguaaauuauacuuaaaaaaaaaaaaaaacaaaaguagcaaaaagaaaugccaaagguuuggcaagcgucaaggcagggaccagagagcuuuagugauuuaccuuggucaggaauaaagaaaaggucugagacuuuggcuuucaucaaggaaaacaguguacccagucacucccccuucugaucuucuguuuccucccucuguaaaaggaagauagaacaauuacaauuuuuuaagcuuucuucacuucugagauuuuuaaaaaucucagcuguguucuaaguaaugugauaggucuccccaacccccaacuuuuaagaauguuuauuaaaaugaugagagggagauguuuuccuuaguuuacacaguaaaagaacugguuauacucucuuguucguaguaagaggauaacagagaaugaguaagcuacagaauucauuauuagcuaauugacuuacugaaauaaaacuaaaucuuucuaauucugaaaauaaucuuucuacuagacugcauugauaucaguuucauaguguugugaaucagaacaugucaaaggaguucagaguccauuguccagagagcccaaauaaaugagguauucuuacagcaguggggacaaagaaguaaaaccgguccuucuugguaacugcucucccuacauaacucuuggagaaauuauagcuuugaggaugccaguucuugguuagaacaaguuaggagacugaaguuucagcaguuuuaagagaaccucuuggagauugcucucaucuuuuuuuuuuuuuuuuuuuuguuaaagacucaggguuguuaggcugggaauacuaguacaggauguaacugagggccuguuuauggaauucuaaugcugguuccucagaacuaucuuuugacuaauguucuuuaucaaguucuaaaucuggaggauugccacauacaauuuuagaauuaaaagggaucuuagagguuaucuaguucauuuucccauagagugcaauccugggggguauucuuuuuuuuuuuuuuuuuuuuuuuuuuugagauggagucucccucugucgccugagcuggagugcauuggcucgaucucggcucacugcaaccuccgccuccuggguucaaggaauucuccugccucagccuccugaguggcugggauuacaggcgugugccaccaugcccggcuaguuuuuguguguguguguguguuuucuuuuucuuucuuuuuuuuuuuuuuuuaguagagacgggguuucaccauguuagccagggugcuuucgaucuccugaccucgugauccaccugccucggccucccaaagugcugggauuacagaugugagccaccgcgcccagccaggguauucuuaauaggagguuacuuggcuagucuuuuccaguuguuaacaugguuggagcccacaguaaucugaguaacauuguccuuauguguagagaauauagaauuucgauuaaguggaauacaaacuacugucagaugaaauuuagaguguuuaaagaaugaaaaguuggaagccauacuugacuguguggaguauccagcaaugaguagaaaaauauuuagaccagagaaaaacauagguuuggaucaaaacccucuccuucaauauauuagaaggcccaugauauggaagagguauacuuuguuauacagaaagcagauuugggguuaaaaaagcuuuuucacaguuggaggauuaaacugcagaauagauuggcuuauaguggaguaacuugcuuaucacuguaauacucaaguagagacuggauaaacugcucuuauauagaacacuauuacccucguaccaguucucuagaguaugaaucagcagucagcaaacuacagcccacuaggcaauuuccagcugacugccuaauuaauaaaguuuuguugacuuaaagccacuccuguuaguuuucguauuguccguaacuacuuuugugcuacaguggcagaguugaguagcugaaaucaagccauauggccugcaaaguuaaaguauuuguggucuagcccuuuacagaagguuuaccaauuucugcuguagagccagggggaaaugaugucaacccacauacguuuggaaaguaaaguggguuaagaagaguuccucaaucucaaggauguccaaaucauuuucuuaauuuucuucaaaaaacuguuuuugacuuaaaauuuacauuuagauuuuuaguccauccuucuuuuuuuuuuuucuuuuuuuuuucuuuuuuuuuuugucauuaucugaaucugggauucagcuuuauuuucuacuggguggauagccaguuguuccagcacuauaugugugguucugugaguagauuuuuaauuauuagggaauggaugugaauggagagaaaggagugaggagagguaaacaggaaagcaauguuuuagaacaaagugauauuacauuaaauaacagaguuggauaagcacauaguaugagauaguuauauuucuauuaaaauaaauauauauacauucuuuuauaaaaugaaaggaaggucaaauacgacgugauaccuuucacuuucuuuguaagcuuuccuuggcuuauucuuugacccagguugguccagaugguuuaaugaaguuaaauggcucagcccuuaacaaugaauucuucacuucagcagcccaaggcuggaaggaaagacucucagaagguaagugcucuacuuaaugugucucccagguggugugugcacucagagcaccucucuuccucaucagguaauuacgcaguuuuggaagguaaaggacaggauguuuccauaggauagaauuaaccaucauguguggaacacguuguuaaacuuuuaucuagagccuauguuaccagguuaacaccacauggaaucuagcaauauguuucuuuaaugauauaaagcuuccaagaaauuaaaaaauacagauuuuugggcccugcuccuaaagauucugauucagcaauucuacauuaaugccuaggaauugaaauuguauuaggcucccuaauaaaaguauagaauuagucacuuuauggugcucugcaucccaguuugguaagcagugagauaaucuguuuauuacugccuagccucaauaaaacuaacaguaaaagcaaucagugagagcuuuuuaaaagaucacuucauuaagguauauuucauauaauauaaaauucagccauuugaaauggacaguuaauuggcagucagaacauuguaguaaguauggaucaugaccaagaauuacugacugugaucacuggucugccaugugugccaugcuucuagugacugauugugugugggcacugcauauaguaucugucaguacuagcaguucuucaccucuacagcugaaaaacaccugugguguuuuuaaaaauacugaugugcaaacaccagugucaaugauuuuguuuuuauugcucuggguuagugucagagcuuuauugguuuuguuuguuuguuucaaaguuuucccaaacgauucuaauaugcagacauaaguaaaaccacuggcugaauuauuuuuauuacaucuguuuuucaguauacauggaauaaaaaauagcacuugaaaagucguauaccaaagaauagccuaaaacaaguaugagagacuuuaaaauauauacauuuguaaggaacgcauuaggaaugcucuucauuguuuauuuucugucagaucccuaccaguuaaagugaacagcuaauauauaaucuagauuguuucuugaaauuguugacuuuucccauccucuucuuuuagaagaaauucuauguagaagggaucucuugcucugauuacuuuguccuuucucuuuccuacagauauuuuugggcagagaccccuuuuuuuuuuucucagaaagauuaaaacauaccaguucuaccgguaccuuucuuuaagaauaaauugguaaaggauuuacuuccucagcccccacuuuuuuguaacuagguacugucagcaaugauacugcgauuauuauuaucaguguuacuuuuuuuuuuaacaugcaagcaagugacugcuguaccuauagucaugugaucauauuuuaugaacaacaacuuggaacacuguauauaugugaacagaguccaguacauuuuauuccucauuuucagauacacaguagacucaauagcaggaguucuggguuggauucugacagccaaaucucucuuuucccaauccuuugcccacgacugugauguccacgguccucuaacacuuuuccucuccuucuucucacccccaggaggucuuaaacuucaaauucugccauuucuaccucuuauuccuugauguccuggguauuagaguauaaaagagagcagucuaucugagccacaaguuugaagauggccuaccaagcacauucacuguucucugcugauggagugggaaggauugaggugguugguaguauaugcaaauaaauggcauauucagagcagcugggucuuuggcauguugaguaucuucuugcuagagcauuagccugguacaauuuguggaacaauuagaaaacugacaacuccagaauaacucccuaccuuuuuacuggaaucucgaaugcuagggccauagcuuuucuuuaugcaguuagagguaaaaagccuaaaauuaacuugccuuggagaaacugaucuuuaaaauaguaaaaaugcccaguggcauaguuuauugaaagcacaucacuuuuucuuuuaguggaaaauaaauuggaaguucuagguaagagauaaaauaaaucuguauggagugugaugcuuggagcgugaggaagguaccacagggaagcccagcgaaaaggcuuugucagccucagcugaguacugaaagcuaccuggaguggugugcaaacauauuuuuauuucaccuaauggcauuuagguccuccuuuacagugaggagguuugaggaguuucuguuacuuucacaugguaguauuccaauuccugcgugagucuuucaugauuuauaaauaguuacauguugcaaauagcauuuuucuauugaauauccuuuuuuggguacauugcaggugaguuuacaccugagaugcaggugagaauucgacaagagauugagaaggagaaaaaaguggagccauggaaagaacaauucuuugaaagcuacuaugggcagagguaauauuaggacagguucuauaaaccaaauguuaauuccuacauauaagucauguagugcuuuaucucauuaccuucucagaaaaucuaggccccaguuuccuucuguuuuguuuuauuuuguuuuuuuuuuugucucacugauucuucuuuaggaagaaguuuuuuucuuauuaugaaucacggguucacagaauuagauuacucaucauacuuuacccuuaaaacugucauuguaggugaaauggcuucuuuaaaaacaaauuuuuuagcugggcgcaguggcucacacuauaaccccagcacuuugggaggccgaggcgaacuccugaggucaggaguucgagaccagccugaccaacauggugaaaccccgucucuacuuaaaaaaauacaaaauuaguugggcgugguggugcaugccugugaucccagcuacuugggaggcugaggcaggagaaucgcuugaaccugugaggcagagguuguggugagccaagauggugccauugcacuccagccugggcaaaaagagcaaaauuccaucucaaaaaaaaaaaaauacauuucuaaaaaaacuuugaauuaagagucccuuucuuugaaaagauugguuuuucuucugguuacuuuauaagauagaagaauauugaaguucuuuaguucuuuuuuuuuuuuuucuuuuuuugagacagaguuucacucuugucgcccaggcuggaguacaguggcgcaaucucagacucacugcaaccugugccuucugguuucaagcaauucugccucagccuccugaguagcugggauuacaggcguguaccaccacaccuggcaaauuuuguauuuuuaguggaguugggguuucaccauguuggccaggcuggucucgaacuccugacuucaggugaucugcccuccucggccucccaaagugcugggauuacagguaugagccaccacuccgagccagaauacugagguucuguccacuuuuuauaguaguuaauuaucccaaaauguagcuauccagaaucacuaaggaaucuuaggaauuuuguaauguggacuauuagaaccaaccuguaauuaaagagccucuccucuguaaaaggcacucugggagauguacauagcugaaucaagauauaaauucuguuuaaaagaggcuguagccuaaaucaguuuuucccccccaacaaaagauccaacagugaaauuauaaugggacauuuaaauagaugguaauggagauguucuguuugaaauaggauugaacacuuggacuccuacuuguuagucucccuuccuuccuucugcacaccaauggcagcccuuaagaagacccguaaccacagcuugaaaacuaaguucuccuuuuccuugucuccaaguaguauuuauccaucuccuucacagucauuuaggaaauauuccuauugagauuaagaguuccauaaacugcggccaguugcgguggcucacaccuguaaucucagugcuuugggaggcugaggugggcggaucacuugagcccaggaauucgagaccaacuugggcaacauggcaaaaccacaucucuaaaaaaaauaccaaaaaauuagcuggguguaguggugcguaccuguagacccaggcucagguggaagaaucguuuaaaccugggaggcggagguugcagugaccaagauuacgccauugcacuccagccugggcgacgaagugagaccuugucucaaaaaaaaaaagaguucuauaaacugauuuuucuauauuuuugguaugagcauugagcuauagaagugauguuugguacauuuagaccauuauugcagguagcaguaauucuacaaauauuuguucauucccuccuuuuuuuucucuuuuucuuuuuuuuuuuucaaagacagggucccacucugucccucaggcuggagugcaguggcacaaucacgguucacuguagccuuaaucucccgggcuuaggcaguccuuccaccucagccuccugaguagcugggacuccaggugcaugccaccacacccagcuaauuauuguauuuuuuguaggagugggguuuugcccuguugcacaggcugguuucaaaccccugugcucaagcgaucugcccaccucccaaagugcugggauuacaggcaugagccacugugccuggcccauucccuccuucuuaagcagauagaggauuacaacaguucgugggucuuucuauuuucaacuauuacuuuuugucagcuuuuauagaaagacuguuuuugauuauugcccaguuuugucccuaaccauuccaucucagaagcacaguacugacucuuugaagucaccaaagaaggcucauugauuuuacauguuguacaguauucuaaaacauuaagaagagucacuaaugaccuuuacagauuagccuagcuuuuagccaagccacauuauggauaucucaauggaacuauacccucagaauagcuuagagacacucgaucucagaauuuuagagcuaaaccaagugggauuuaaaugggcuuuccaaaacucagcuauaauucucagccucuauagaacauugacagccagcugucuccucagguccucuuagauuuuuugggccuggguuugcacagauauugcagagaagaguugaccacaaucacaggguggaagggucuugggcuuccuucaguucccuugcagguagucugugaugcaugcguccagacaauguggccccucuauaagcagaaguaauaauaacuacuauuacugaacuuucauuauguguuaggcaaguacuuuauauggauuaacuuaauuaucauagcaacacuaugaaguaauuaaaccuaguguacaauugaagaaacugaaguaaagaaggcuagucauuuacuuaauaucacacggacgguagguaucagagccagaauuugaauccaggcacucugacuccagaacuuucacuacuacuaauagugaagauaauacaugaauaccugcugugucagggguucuccuaggcauugucaucuuccauuaucucuauuaaugaaugcuuucgcaacaugggcuauuuuucaacuggaauauuucuuuuuuccccuuuuuaguucuggccugagccuugaagauucuaagaaauugacagcuucucccagugaucccaaaguaaagaaaaccccagcugaacaaccaaaauccaugccugugucagaggccucucuuaucagaauaguuccaguagucucccagucagaguguaaagaagaagcauugcaaaugucaucaccaggcagaaaagaagagugugaaagccaaggugaagugcagccgaacuucuccacaucuucagagccccugcuuuccucagcucucaauacacaugagcuuagcagcauucuucccaucaagugcccaaaggaugaggaucucuuggagcagaagccagucaccucugcugaacaggaaucugagaagaaccaucucaccacagcuucuaauuauaacaaaagugaaagccaagaaucuuuaguuacaucgccaagcaaacccaagaguccugggguugaaaaaccaauagugaagcccacagcaggagcggguccacaggagacuaauaugaaagaaccucuagcaacucuuguugaucagagcccagaaagccucaagaggaagucuucccucacccaagaagaggccccugugagcugggagaagaggccacgugucacugagaaucgccagcaccagcagccauuucaggucucaccacagcccuuucucaauagaggggacagaauccaggugcgaaaaguaccaccucucaagguaagagaauggagagaauuagaaaagcagagaucgucugaacccuauguuuuuggucauaccuacuaaauuucaaguaaauugugguaguucuuaaugcagaagcaguuggauauauuugauaaauauguaacuauggucuuacacaaauaaaaugauagaugggcauuuagaacugcaguccuacauacaggucuuuacugauguuugcauaaggaagguaccugggcaucuaauguaaaccaccccugugcucacuacuugagcucagaggcaccugaucucagacucuuagaccaaauauaauuuaaauggacuuccaaaaacuuaguuauaauucucagccucuguagaacauugacagccaacuguccuacugucuccucaggaccucuuagauuuuuugggccaggguucacgcagauauugcagagaagaguugaucacaaucccaggguggaagagucuugggcuuccuucgguuccccuacagguagucuguaaugcaugcuuccagaccaucaugaaaauuauugacaaaauaagaaaugugagacuaagcaugaggagacuauugguguaaucaaaggauccuaucuuuguaccaagagccaugguauuugaguuuacccuuuucuugcuaccauaacugacuugauguucugugaaucaggaacuaccuuuagcucccuccuauuaaaggaaauauguguagcugucuucugucacuacugguuacuugagggacacuaguaacauggaauagucuugguaagcucugcugcuuagcaugugauuaacuuccaguuagccuuguauugcugcaugucaaaucuuucaaauucuucuagguaguaucuuugacugucuuaauauacaaugccuuuuaaaacccaaacacauuuuuacuucugaucuuaaagguuuauuaauacuugggcuugugcuuaauaucagcuugcaguucauucauuuaauaaauaguguuuauuuuucuuaccaaggaauuuaagaggcaacgcacugaauauuacucauuaggauauaaauggaaaaauaagacuaguaaaaguacuuuuucccccuuuuuauuuaacugaggugaaccaaaauuaguucugucaggaaguauuccuuggaaagauucacuuaccagaacuugacccauucucauuguauuuuuuuuuuuuuuaacggagucucguucuguuguccaggcuggagugcaguggcacaaucuuggcucacugcagucuccaccucccagguucaagcgauucuccugccucagccuccugaguagcugggauuacaggcaugcaccaccauaccuggcuaauuuuuguaauuuuauuuuuuaguagagaugggguuucaccauguuggccaggcuggucccaaacuccugaccucaagucaucugcccuccucugccucccaaagugcugggauuacaggcgugggccaccgucuguacuuccuauuacuuuuuuauucauugcuuguuuuuugccccccaagauggagucuugcacugucguccaggcuggaaugcagugaugcaaucuuggcucacugcagccuccaccucccggauucaagggauucuccugucucagccucccaaguagcuaggauuauaggcauuaagccacgacgccuggcuaauuuuuguauguuuacaaauaauuauuuguaaaggggucucaccguguuggccaggcuggucuugaacuccugacuucaagauccaccugccucggccucccaaagugcuaggguuauaggugugagccaccacgccuggccaauucauugcucuuuaaaauuggugauuuuagcacuuacgaaucuauggggguuuuuucuuauuuuuuuuucuaccauuaacaugcaucgccagagauucugauuuuuauuauaaucacuuuuacuauucuuucuuauaaaaauauuagaaacuuuucuucaaugucauucacagcuuaucuccagaccugagagcugaguaacuguuuagguuuugcuauaaauguugcuaagacccaucauuucuauuuucucaccuguaaacaggcuggguuacaucauauucugucugcuuucugcuaguccaaagggauuacacagaaacuuuaauccacugugaccaaguuaauauaauuuuacuuuuuucaguucuuuuccuuucuucucccucaucucccucaaaaaagacuucuccagaagugucuuuaguaacucucuucucuuagacccuaucucaaauacugcuuucuuagacaaaguuuaauguaauuuauaacagaacaaaaccuuuuaaacaaaauuuaaguagaaaacaaaauucacaauguaguaguagaaaacaaaauucacaauguaguauaaauguuauaacuuaguuacaacuuuuauauauauacaaauguauauaaaaacuauauauacacacaugcacauuauauguuuuacauucccuauacagucagcccucuguaucagcaaguuccacauccucaagguuaaugcaguauuuucaaccaaccaccuaucgcaauauuuggaaaagaaaauuaaauacaaauguaaaaauacaguauaacaauuuauauagcauuuacauuauguuagguguuauaaauaaucuagagaugacuuaaaauauaugggaagauauguggagguuaucugcaaauacuacgccauuuuauauaaaggacuugagcauccucagauuuugauauccucugggguccuagaaccaaucccccauggauaccaagggaugacuguacacuuaaaaagaaaaggauugaaucucucugcucucccgggguagggcuucucaguaaauuaaauuguuaucaaugccuggacagcuuugguuuuguacuuaaaaagaaauaugauuuauuuugcauaaucagguaauagggcuauuuacguaaguaacugaaacuuauuuuuagguaucgaaaccuuucauuuuaaccacuuauaaugguuguucuuauuugauuucaacauguuauuaaugauuguguuauuaugauagauaugauguauuauguuagguauagaguuacucucacgaguauucuuauguaaaguuguuugucccuauauaaauuccccuaaacaccuuucuuguauuuacuuuuuuaguuuuaucuuuuuuuuuuuuuucauuuuuuccccugcaguuucuuucauaugauauaaauaagggacaauaacugcuucuuucuuacuguaggcagccucuaaaaugcuaugugaugaguaaauauacuaucuaggcuuguucgaauuggaugugaaauagauuuagcucuuagagagauuaaauagguuuccugauguaaaauauauacucugugacaccuguuaugaagucccauggcucuaacuucggaauuagagaaucaguuuuugaggacuacugaccuuuugagaaaugaguauugcaaauaaugaaaaauguuuagugacuuuauuauucuuaauuuaaaaacauuaagaaaaauggcaugcauuuucuuaggguuuaguggguuaauuuuuuuuuaauuaaaugcuuuagaacaucuuaacaguuauuugcuccuuuaaacucaaccaguuacuagaagaguccacaucuuguugaauuauuaguaacucuaauagcuuucaaaguauuguucaggacagaaggcagauuuguuucagacaugaugauuuuaugguaugaaaaucauugguuucagccaggcgugguggcucacgccuguaaucccagcacuuugggaggccgagguggguggaucacuugaagucaggaguucgagaccauccuggccaacauggugaaaccccaucuuuacuaaaaauacaaaaaaauuagcugggugugguggcaggcaccuguaaucccagcuacucgggaggcugagccacaagaaucacuugaacccaggaggcagagguuacagugagcugagauucugccacugcacuccagccugggugacagagugagacugucucaaaaaaaaaaaaaaaaaaaaaagaaggaaaucaaugguuucaaaccugauagacaucagaaucucacaaguagcuuuuuagaaacuuuuuuuuuuuuuuuuuuugagcuggaggcucccucuggagucacuguguuggccaggcuuuuucaggcugggugcuguggcucaugccuguaaucccagcacuuugggaggccgaggcagguauaucacaagaggucaggaguucaagacuagccuagccaacauggugaaaccccaucucuacuaaaaauacaaaaguuagccagacguggugacccacaccuguaaucccagcuacucggguggcagacgcacaagaaucacuugaacccaggagacugagguugcagugagccgagaucacaccacuacacuccagccugggagacagagcaagacccuaucuaaaaaaaaaaaaaaagacuuccuagggucuuggggguucugauuuguaauuuuuugggauaggacccagagcauauauauuuuaaaauugcgcaaguaaauauaauaccagccagagaugagaauggcuggcaaacauuauguacauacuccuuuauguguaugggcauggugggggcuccuauagaucacacauugucuuccuuccagugcugucuagaagccuguguaauuugagauaauccagcccaaguguguguguguguguguguguguguguguguguguguguguguggaacagagaagagcaaguauuuuccccuggaccuugguaguaaagcuaagaacuaaaagacaguagugguauggguggcuggcuugcuugcuuuucucuucuuucucaaacauaaauacacuuuuuaaaaaugcaaauaccauagaaaacuuuguaucauaauaagcacuuguaauaguggcauuaggagggaguugagauaggaaaagagguguggggauuuggggugagaguggaagcagucgucuuuggcaccaauagaaaaaguggaugcaaggacccuagagacaaacuaguauugcugucuccaagguuuggccucucggccauagaccacccauguuugucacagguacuguaguguucaucuguuuuuaaaaugugagggcuaaugaaguuuuguuauucuuacaaaugaaaacuaagcucuguuguuuuuuuccccucuacuucuuucagaucccggucuccagaaucucccccaugccguuucauccaucgcaggucucucccagggcucguuuuccagucuccaucacuaguccuaacagaacaggagccagaacucuugcagacaucaaagcaaaagcccaacuggucaaagcacagagggcagcagcugccgcugccgccgcagcugcugcagccgccucaguuggagggaccauuccaggaccuggcccaggggguggacaagguccaggagaggguggugaagggcagacugcuagaggaggcaguccaggcucagacagagucagugaaacuggaaagggccccacacuggaacuggcaggaacuggaagcaggggagguacgagagagcuuuuacccugugguccagagacucagccccagucugagaccaagaccaccccaagccaggcacagccucauagugucucuggagcacaacuacagcaaacccccccagugccuccaacaccugccgucaguggagcaugcacaagugucccaucaccagcccacauagagaaauuggauaaugaaaaacugaaccccaccagagcaacagccacaguggccucugucagccauccacaagggcccaguaguugcagacaggagaaagcaccuucuccaacagguccugcucuaaucucaggugccucaccuguucauugugcagcugauggcacaguugagcucaaagcagguccuaguaagaauauaccuaacccuucagccucaucaaagacagaugcuagugugccaguggcuguaacucccuccccuuuaacaucuuuauugaccacagccacuuuagaaaagcuuccuguaccccaggucagugcaacuacagcaccugcuggaucagcuccacccucgagcacuuugccagcagcuucuagccuuaaaaccccaggaacuucuuuaaacaugaauggacccacuuuaagaccaaccucuaguaucccugcuaauaauccuuuagugacucagcugcuucaaggcaaagauguucccauggagcaaauucugccuaaaccucucaccaaaguugaaaugaaaacgguuccacugacugcaaaagaggaaagggggaugggagcgcucauagcuaccaacacaacagaaaauagcaccagagaggaaguuaaugagagacagucccauccagcuacgcagcagcagcugggcaaaaccuugcaaaguaagcagcucccccagguuccaaggccccuucagcucuuuucagcuaaggagcugagggacuccagcauugacacacaccaauaccacgaaggacuaaguaaagcaacccaagaucagauccuucagacucucauucagaggguucggaggcagaaucuucucucaguugugccgcccucacaguucaacuucgcucacucagguuuccagcuggaagacaucuccacaagccagagguucaugcuggguuuugcuggcagaaggacauccaaaccugcaauggcagggcacuacuuacugaauauuucuaccuacggccggggcucagagagcuuuaggaggacccauucuguaaacccugaagaucguuuuugucuaagcagccccacugaagccuugaaaaugggauauacagacuguaaaaaugcaacaggagagaguagcagcagcaaagaagaugacacugaugaggaaaguacuggugaugagcaggaaucugucacagugaaagaggagccccagguuucccagagugcuggcaagggugacacaaguucaggaccucacagcagggaaacucuaucuaccagugauugcuuagcuagcaagaaugugaaggcugagauaccauugaaugagcaaaccacuuuaaguaaggagaauuaccuguucacuagaggccaaacauuugaugaaaagacccuagccagagauuuaauucaggcagcacagaagcagauggcucaugcagugagagguaaggcaauccguagcagccccgagcuuuucaguucuacuguucuuccucugccugcagacagccccacccaccagccccuacuccuuccaccccugcaaaccccgaaguuguauggaagccccacccagauagggccaagcuauagaggcaugaucaaugucuccaccucaucugacauggaccauaacucugcuguaccagguagccagguaucuagcaauguaggugaugucaugucauuuucagugacugucacuaccaucccugcuagccaagcuaugaaucccagcagccauggccagaccauuccuguucaggcguucuccgaagagaacagcauagagggcacgccuucgaaauguuacugccgcuugaaagccaugaucaugugcaaaggcuguggcgcuuucugccaugaugauugcaucggccccuccaaacugugcgucuccugccuugucguucgguaaugagacuagaaagagauacacuguaaaggagggggaagggaaggguugaccaguuggguuuuuugcguccuuuuggaaucacagaaauaaacaaguagguuucaguugucuucagagacaaauguuacuuaaucaggaauacaaaguacagauuuuuuacauuuuagaggaagagcaccuuguauaguaagucuaagucaagcaagacuuugugaauuugugacaaguuugcacuuacaaaaucauguaaauaugucacauuuuguuuaacauuauuuuuccaaguguuuagguaauaauguauuacuuugaauucagauuaauguucuacuacuugugacugagaaaaguuuaaugccggcaugguaaaaggaagcugucucccuucugacauuuccuaggaagcuaggaaaaggaaagugaaggaauggucuaaagaaaugaccauucacacugauuuugucuggacagucuggccgcagguuauucauagauuauucagccuuugcaggacuuggauucaggguuuuacucagucccuuuaccuuagguggaaucuucuuaaauugaaauuuuugguaaggaauucauuucacagguaguguuucagacucugaaagcccugacuugguucuuggcuucuacuguacuaguuacuaguuacugguacuguugccaagcaaucugcuuggaauuuguggaucccugcuguucccuaaucccacccccugcccugagacagugaauguaguccgugaagggagugccucucugggacccccuguguuguuacaggcugugcagugcaacaauuccagcaaaaauacccuauccccgcacuuagucauucgugguaacuaacaauuuugaaauacucauauaaaaugaacaggaaaguguuagugauugggugauuugagcuacaucuuguugagcaaggggagugaaaccacagaaacuguuaaauugaacguaaauaacuuuggaaaacaguuuugacacuagaacaaggucgcuucucuuuuccucuucucucccaaccuguuaaccuagugcuagauagucagcugcuguugcagguagaaaagcucaccaaugccacauuuguucauucuguucaaccuguuuugaccucccaggcaucugaacaggaugacaucaucuuauuauaucuuacuuuacacauacguguauguacacacacacacacaauacaagacauuuuuccuguuuuagaaaauauagcccuuguuuggauuacugcugucugagcacuagaaauuucuaauggaaagaggccucugaauggcuaagggaacaucuggaaaggaaggaaaaugagcccuaaagguuuuuugguugcuuguuuuuguuucuuuuucuuucuuguuuccuuuuuuguuuuuaaauccuucucuagugacugaagaaauugugaguacauaauauuuaggucaugguuaaggaacauuaaaauaaaccugcaguuuaacagaauuuuguauuaaaugggggagugucaauuugcaucauuugcauauugauuucaagucuccuaauuuggaauggguaaaguacaaauguuaaugcaacauaguacaguuguauuuguccuucauauucaggaugugauauuuacaaaaugcagaacaguuuaaacuuguuaagucacauuccagauuaggagaaaaugggcaauaaucaucucuguuuugcccccauucuacuacccaccacugcccaccccacccccacaucacacacucuucgaugcuuucccacagccccugcuccgcuccucuccguaagaaacucacuucacuguuuuucacuuuucacuucuggcuuuuuuguggcccaaggccaauauaggauuaauaucuguguuccagcuucagccagaacgauaugucuguccaucuuucuccuuucuuccagcacacacagcuaagagauaagaaggcugcaaggauuggggauaaggaguauauuuucaagccaagaaccaguagaaaacagaaauaauggugcucccaaauauucaguaccuugggcaauccaggaaggguuuaaagagaccuguugcugcauagaacucucccugcccuaccccuuaacuccaccuuagugccagggccgagggcuggucugcaugcuggaagagguugagaguuuuggaauugauuccaugcuaaaugucaguuaccaguuuggauugaugaaagugauuuuucugcuuuaccuuuuuccugucagaaagguuuuccucugugcuacccuuaacuuagggaugaacagacuauaacuaggaaaggaggaaagguaucagggauuuuuaaguccguuuagagagcaaaccauauugugccucuucaucuugacccaggcucuuauagauagguccuaaacauugcuguucacuagauuaucuuaacaaauaauacucagcuaaauauuugcauuuaggaauacuccuaaaacagauauugccaacuagauacacugccucaaucuugaccagacaagagaacaguuaaguucucucaguuggguaguaacuugaauaccagucuauuuaucaguugguuucaacacagagguuucaaguggaaagccauucaucuuaaaagcugaacagaaaaauu

SEQ ID NO: 192340 - RNA, 29071 nt, Homo sapiens
gaccugcggcuccgccccagaggccgccaucuuccugaccacccgaaaggccggaccuacuccccggugcaucuugggaucagggcggggcccugagcgccgccaugcuuuuguacggcaggaucgcaaagcacgccgggaccgguugguuugguuuugaagacguggauggcgggaauucucgcuucuggccugggugagcuagaagggagaagguaggggaaagacccauugucggaccggaccguggccaggguggcgggcugaacggccuucuuaaaacuccuuccguggccgggaagcccgcuggaccagaguagccguggccucgggagcgcgccggggccgcgggaugggcgcgggggugggcauggacucugcuggcucggacgaugggagagggcgggcggcucaggaaaggggauccuagccgugacauuugugucauccgcggcccagggguugugccugaguggugugugcccugccgucuggguuugaaugggacuagaugugaugugacuguugccauuuuucuuuuauuagcaaggacauuggagucccuaucaccgguugccuagacaacuucaugggaaggcccuugggaaucugagauggagcaggcgaacccuuuacguccagauggcgaguccaaaggagguauucagagggucgccgccuccuuccugcugcugcccaaagaugacccgcaggcugagagagcccuuuccuccuggaacugacgugggaccuggccuguuugggagcagaauagugaaaggaacuaacauugaagacaaagggacaggcagccaagauuauucgaggaggaaaaauggcuucguuucuaggcucccaccccuuuugaaacggauaaguugcauccaucauaugcucaguguuuauauucugaacugcgguucuagccagggaggucccuuuccucuccccggauuuuuugggccauguaugcauuacucuugagggagggccaguguagggcagugacuuuaguguuggcuagaacugguuuugaguguuggcucugccaugauaaauauugugaccuuaggcaagucacuuuauucucugccucuguuucuucaucuggaaaauggaggugaaaauagcacuguaguugugguuguggaaaaaguauuucuuuugugguggaaaaguauugaacucagacuuuucaagugaagcauuuagcacaugucuaauauauaggaaauauucaaugaaaggcuuaauucuuuacauacuuugugucuuaaaauguagaagguguuuaaagaaugcuuguuagaguugcuuagaauuacgaaacuauuacuuuuacuuaguccuuagucaauccuuuggaaacugagauuugcguuugaauuucuguccaggaguaaguugcuuucuucuuuagugccuaguaauauuuguggacaguucugguuuugugugacuuuauguucuuugcuacuaauacuuuuuagaacuuugaaauacuuacucaagccugaugccuaaauccaaaggguucuacguuaguacuuugggaaagcuugccauaaaaccuaacuuaaauuacaguuuuaaaaagaauuucugagcgcgucagugaauuugguuauccuauuuuucucugggucaucauuaucauugauaacagagaaguaacuauauucagccuaagaugacuuaagcugagacuuuagauaauaaaaguauaugggguaagauuuauuguuacuuuaagacuaaaaauaaguuuggugacuuuauguaguggaaacaugcuacacucaggaguaaccuguucucuaguccaggccuuauuucauuucuguuaaaguaagugaugagguggaaguuuuggauuaucaagagacuuagaccagucuccuuauucucuacccaaaacaauauuuaaacacuuagcuguuacccauacugguuuuaucccucugcuuguuugauuucaguuuuuugcuuauuauuugaauucuccccacucauuugagaaggaaggacauggaguuguaguugcaaccagaugauuuauucaaauaggcagggauuuugacuuuuuuugggacaaagcugacuggcuaggaugagaugcaaucauaacuuccaagguaaagcaggcccagcagauacacucccucuuuucuguaguagcaacgcuaaacaacaacgcuacccccuugguguagagggaaucaggucgguaaagaagcugggcagguuugagagccugagaagagggcuguguggaagugccuagagaaggagcagcaugauacuguuuugaacaccuacuuaucucagaaacuuugggaauauugauaucuacuguuuuaguaauauagaauuuccauaaaguagaauuuggugaggcgucuccucuaccacccuaaauuauucuaugugugcgugcuuuucagaucaccuccugguuggacauuaauuuuuguaagcuccgugaggacagggacuucguuuugccaccacaguaugaauaacuuccagcacgguccuugguccauaguaaauucucaaugcauaguuguuggauaaauagagauuggugaauaaagcaguuaaucacgugcuaauuauuaggacuaauuuauuuaauuagaauuuugguuucucacgauuauuauugcgguaauguggguuuuucuguggacaugagccaagugaauguaaucuccaagagugucaugccugguuguccguguuucgguaaacauuuccggaguguuggccgggcgcgguggcucacaccuguaaucccagcacuuugggaggccaaagcggguggaucacaaggucaggaguucaagaccagucuggcuaacauagugaaaccccaucucuacuaaaaauacaaaaauuagccgggcaucguggugcaugccuguagucccagcuaauugggaggcugaagcaggagaauugcuugaaccugggagguagagguugcagugagcugagaucgcgccacugcacuccagcuugggcaacagagugagauuucgucucagaaaaaaauaaccauuuccggaguguuuaccauguguaaacacuuugugcuaggguuaagggauccaugggugaacacaaaugcacacggucccugauuuuggaacuuuaagguucaguggaaaagauaagcaaaucaaauaaucacacuaaugaauauacaauuaaaacuauaguggccgggugcgguggcucacgccuguaauccuagcacuuugggaagccgaggugggaggaucgcuugagcuuaggaguuugagaccagccugggaaacauagugagaccccaucucuuuauuuaaaaaacaaaaacaaaaaaacuauaguauugucucagaaggaucuuugagagcuuaugagcuggcaccugaccuuguucugaaggugcuacaaagguuucccugaggaaaugcugcuugcauugagugcuaacgagcuagaguagcugcaggugaagguggauaaggggcggcuguggaagagccuuugguguguguguuggggguggggggaucaggucaguaaagacgcugggcggguuugagagccugagaggaggccuguguggaaaugccuagagaaggagcagcaugauacugaugaggguaagagagauccagaggccaguaggccucguaggcagugugaagucaucgaaaggcuuuagccagcuggaugacacgauccaguuuagauuuugaaauauggcuucaguguaugggccaccuaggaaacuuguaauaggccagaaaugguaguagcuugaacuacaaugguggcauugcagauggggaaaauggaaauauuuuagagauacuaggaauguauauucaauaggaucugguaauggauugggacugggucagggagaaggugugaggaagaaaguacugguuuacacagcuauagauggauaaugguuccagucauggagggguuuagaaggggagaugaugaauucagucuuggacauguugauugucagguuccuguaagucuuccaaguagauacacugagaaggcagguggauauucugcuuucucaagaagcaggagagagguauaagcuagagauacauauuuguguggcaucgacauguauggccauuaaggcuguggguacugaugagauuucuucuggaaagaagaggucuuaggacugagcucuggaaaauuucagcauuuaauggucaaggaggagaguaggagccuucaaagcagaaaguggggucagagagguaaaauguaagugucacaaaaacagguugucuguuguucaucacuauguucccagugccugaaauaguacuuggcacaaaauagaugcuuaauaaacaucuguugaacaaggcauaccaacaggccgcuaugcuaagauucagaggaaaagaggguuucgugaagguggugaucaguaggagcauauagugcugggaggugagauaagggagcuugaaaaauguccuuuggguucagcaacauggauaucacuguugaucuuagagugguuuuguaaaauaaugggaacagaagugaguuucaaguggguugagguaugagucacaggcaagaaaauggagaaagugaguacaaguugagcacugaagauccaaaaucugaaauacuccaaaaucugaagcuuuuugagcacugacaugauggucaaaggaaaugcuuauuuccaguuuuggauuuucagauaugggauguucagccaguaaguguaaugcaaauacucccaauuccgaaaucugaaacaccucuagucccaaaacguucggauacucaacuugcauggacaacucuuuuaaguaguuuuccuggaaaggaaaggggagaaaagggagauaguagcugaaggggauuugugggcaagaauaggccugugaguguaugaaauuguguguguguguauguguguguauauauauauauauauaugaguguguguuugaagacaguugagacuugagcguguguggaagggaaaugaacacagcagagaaaaggguaacugaucauuuaggguuucugagaaagcaaggggauaggccucaaugaguaaaauaggauaauucugcauauagugcgugucuguuucuauuugaucucacacaaauuuuuuuuuuuugagacggagucugucaccuaggcuggagugcaguggcacgaucuuggcucacugcaagcuccgccuccuggguucacgccauucuucugccucagccuccugaguagcugggacuacaggugcccgccaccacacccggcuaauuuuuuguguuuuugguagagacgggguuucacuguguuagccaggauggucuugaugucccgaccucgugauccacccgccucggccucccaaagugcugggauuacaggcgugagccaccguacccggcccgaucucacauacuuuuuuuuaaugguuuuauuagccauaaaaaccauaagagguuucuagucuuaauuggauaggugaaugagauaaguuuuuggauuccgucccaaggcaaggagagaagauuaagguuuucauauauguucauccauaugaacccuacaaaauagaugcuggguguacuuaagaagcucgauuaaauaaagucuggggcuuccuuuuuuuuuuuuuuuuuuuuuuuuuuuggagacagucuugcucugucccccaggcuggagugcaauggcacuccaauggagugcagugaucuuggcucacugcaaccuccgccuccuggauucaaacaauucugccucagccucccgaguagcugggauuacaggcaugcgccaccaugcccggcuaauuuuuuguauuuuuaguaaagaugggguuuugccauguuggccaggcuggucucgaacuccugaccucaggugauccacccgccuuggccccccagagugcuaagauuacaagugugagccaccgcccucggcugugagagggcuucucuccggccugugguaaagcuagagaaucauccuuuacacacuagagauguggauuugcgauaaacugcagaccuagauaagacacugcugccuaaucagcgugugauaguucauauccucucucgggcugucuuugaggaggauccuguuuuacaucacucuccaaccuaggagguugaugaucuuugauuucaauuguuagcuccccugguuuuauaaauugacagauaucuaacaauucagcuggccacaaaguucugguaaaaaaaaaaaaagagucaccuguucuucccugagaugcuuccuguugccacagugagaaauccucagcuucuuguaaaauucuccuuuuacucuccuuagguguuuuagcucacuuggaaaggcuagagacccaagugagcagaucccguaaacagucugaagagcugcagagcgugcaggcccaggaaggugcucuuggaaccaagauucauaaacuaaggcgucugcgagaugagcugagggcuguggugcggcaccggcgagccagcgugaguagaagggugguaucagcaguuccuuuagaguauaaugaacaaacgugauuugggaauuggugaauuggccauuuuuuauaauguguuuuacuugugaucuuacuggauugauugcaguccuugaucccucaaaugaucaaaccuguagaguuuggccaggcacgguggcucaugccuguaaucccagcacuuugaaaggcgaggcaggccuaucgccuguggucaggcguuugagaccagccuggccaacauggugaaaccccaucucuaccagaaauacaaaaauuagccaggcauggaggcaggcgccuauaaucccagcuacucaggaggcugaggcacgaauugcaccugggaggcggagguugcagugagcugagaucgagccacugcacuccagccugggaaacagagugagacuccgucucaaaaaaacaaaaauccgguagaguuacagugaauaucaccuaacauuuuuuaauuuuuuuauuauacuuuaaguuuuaggguacaugcgcacaacguguagguuuguuacauauguauacaugugccauguuggugugcugcgcccauuaacucuucauuuaacauuagguguaucuccuaaugcuaucccuccccccuccccccaccccacaacaggccccggugugugauguuccccuuccuguguccauguguucucaguguucaauucccaccuaugagugagaacaugcgguguuugguuuuuuguccuugcgauaguuugcugagaaugaugguuuccagcuucauccauguccccacaaaggaugugaacucauccuuuuuuauggcugcguaauauuccaugguguauaugugccacauuuucuuaauccagucuaucauuguaggacauuuggguugguuccaagucuuugcuauugugaauagugccgcaguaaacauacaugugcaugugucuuuauagcagcauguuuuauaauccuuuggauauauacccaguaaugggauggcugggucaaaugguauuucuaguucuagaucccugaggaaucgccacacugacuuccacaaugguggaacuaguuuacagucccaccaacaguguaaaaguguuccuauuucuccacagccucuccagcaccuguuguuuccugacuuuuuaaugaucgccauucuaacugguaugagaugguaucucauuguggcuuugauuugcaugucucugauggccagugaugaugagcauuuuuucaugugucuuuuggcugcagaaaugucuucuuuugagaagugucuguucauguccuuugcccacuuuuugaugggguuguuuguuuuuuucuuguacauuuguuugaguucauuguagauucuggauauuagcccuuugucagaugaguagauuggaaaaauuuucucccauucuguagguugccuguucacucugaugguaguuucuuuugcugugcagaagcucuuuaguuuaauuagaucccguuugucaauuuuggcuuuuguugccauugcuuuugguguuuuagacaugaaguccuugcccaugccuauguccugaaugguauugccuagguuuucuucuaggauuuguaugguuuuaggucuaacuuuuaagucuuuaauccaucuugaauuaauuuuuguauaagguguaaggaagggauccaguuucagcuuucuacauauggcuagccaguuuucccagcaccauuuauuaaauagggaauccuuccccauuucuuguuuuugucagguuugucaaagaucagauaguuguagauauguggcauuauuucugaggcuucuguucuguuccauuggucuauaucucuguuuugguaccaguaccaugcuguuuugguuacuguagccuuguaguauaguuugaagucagguagggugaugccuccagcuuuguucuuuuggcaugggauugucuuggcaaugggggcucuuuuuugguuccauaugaauuuuaaaguaguuuuuuccaauucugugaagaaagucauugguagcuugauggggauggcauugaauccauaaauuagcuugggcaguauggccauuuucacaauauugauucuuccuauccaugagcauggaauguucucccauuuguuuguguccucuuuuauuucguugauuagugguuuguaguucuccuugaagagguccuucacaucccuuguaaguuggauuccuggguauuuuauucucuuuguagcaauugugagugggaguucacucaugauuuggcucucuguuugucuguuauugguguauaagaaugcuugugauuuuugcacauugauuuuguauccugagacuuugcugaaguugccuaucagcuuaaggagauuuugggcugagacaaugggguuuucuagauauacaaucaugucaucugcaaacagggacaauuugacuuccucuuuuccuaauugaauacccuuuauuuccuucuccugccucauugcccuggccagaacuuccaacacuauguugaauaggaguggugagagagggcaucccugucuugugccaguuuucaaagggaaugcuuccaguuuuugcccauucagugugauauuggcuguggguuugucauagauagcucuuauuauuuugagauacgucccaucaauaacuaauuuauugagaguuuuuagcaugaagcguuguugaauuuugucaaaggccuuuucugcaucuaucgagauaaucaugugguuuuugucuuugguucuguuuauaugcuggauuacguuuauugauuugcauauguugaaccagccuugcaucccagggaugaagcccacuugaucaugguggauaagcuuuuugaugugcugcuggauuuggguugccaguauuuuauugaggauuuuugcaucgacguucaucagggauauuggucuaaaauucucuuuuuugguugugucucugccaggcuuugguaucaggaugaugcuggccucauaaaaugaguuagggaggauucccucuuuuucuauugauuggaauaguuucagaaggaaugguaccagcuccuccuuguaccucugguagaauucggcugugaaucuaucuggucuuggacuuuuuuugguugguaggcuauuaauuauugccucaauuucagagccuguuauuggucuauucagagguucaacuucuuccugguuuagucuugggagaauguauguguccaggaauuuauccauuucuucuagauuuucuaguuuauuugcguagagguguuuauaguauucucugaugguaguuuguauuucugugggaucgguggugauaucccuuuuaucauuuuuuauugcgucuacuugauucuucucucuuuucuucuuuauuagucuugcuagcggucuaucaauuuuguugaucuuuucaaaaaaccagcuccuggauucauugauuuuuugaaggguuuuuugugucucuauuuccuucaguucugcucugaucuuaguuauuucuugccuucugcuagcuuuugaauguguuugcuuuugcuucucuaguucuuuuaauugugauguuagggugucaauuuuagaucuuuccugcuuucucuuguaggcauuuagugcuauaaauuuccgucuacacacugcuuugaaugugucccaaagauucugguauguugugucuuuguucucguugguuucaaagaacaucuuuauuucugccuucauuucguuauguacccaguagucauucaggaacagguuguucaguuuccauguaguugagugguuuugaaugaauuucuuaauccugaguuguaguuugauugcacugucgucugagagacaguuuguuauaauuucuguucuuuuacauuugcugaggaguguuuuacuuccaacuauguggucaauuuuggaauaggugugguguggugcugaaaaaaauguauauucuguugauuugggguggagaguucuguagaugucuauuagguccgcuuggugcagagcugaguucaguuccuggauauccuuguuaacuuucugucucguugaucugucuaauguugauggugggguguuaaagucucccauuauuacugugugggagucuaagucucuuuguaggucucuaaggacuugcuuuaugagucugggugcuccuguauugggugcauauauauuuaggauaguuagcucuucguguugaauugaucccuuuaccauuauguaauggucuucuuugucucuuuugaucuuuguugguugaaagucuguuuuaucagagacuaggauugcaaccccugcuuuuuuuuuguuuuccauuugcuugguagaucuuccuccaucccuuuauuuugagccuaagugugucucugcacaugagaugggucuccugaauacagcacacugaugggucuugacuauccaguuugccagucugugucuuuuaauuggagcauuuagucuauuuacauuuaagguuaauauuguuaugugugaauuugauccugucauuaugauguuagcugguuauuuugcccauuaauucaugcaguuucuucauagcauugcuggucuuuacaauuuggcauguuuuugcaguggcugguaccgguuguuccuuuccacguuuagugcuuccuucaggagcucuuuuagggcaggccugguggugacaaaaucucucagcauuugcuugucuguaaaggauuuuauuucuccuucacuuaugaagcuuaguuuggcuggauaugaaauucugggaugagaauucuuuucuuuaagaauguugaacauuggcccccacucucuucugacuuguagaguuugugccgagagaucagcuguuagucugaugggcuucccuuuguggguagcccgaccuuucucucuggcugcccuuacauuuuuuccuucauuucaacuuuggugaaucugacaauuaugugucuugggguugcucuucucaaggaguaucuuuguggcguucucuguaguuccugaauaugaauauuggccugccuugcuaguuuggggaaguucuccuggauaauauccugcagaguguuuuccaacuugguuccauucuccccaucacuuucagguacaccuaucagacguagauuuggucuuuucacauagucccauauuucuuggaggcuuuguucguuucuuuuuauucuuuuuucucuaaacuucucuucuugcuucauuucauucauuucaucuuccaucacugaugcccuuucuuccaguugaucgaaucggcuacugaggcuugugcauucgucacgugggucucacgccaugguuuucagcuccaucagguccuuuaaggacuucucugcauugguuauucuaguuagccauucguguaauuuuuuucaagguuuuuaacuucuuugccauggguucgaacuuccuccuguagcucggaguaguuugaucgucugaagcugucuucucucaacucgucaaagucauucuccguccagcuuuguuccauugcuggugaggagcugcguuccuuuggaggaggagaggcgcucugauuuuuagaguuuccaguuuuucugcucuguuuuuuccccaucuuugugguuuuaucuaccuuuggucuuugaugauagugacguacagaugggguuuugguguggauguccuuucuguuuguuaguuuuccuucuaacagucgggacccucagcugcaggucuguuggauuuugcuggagguccacuccagacgcuguuugccuggguaucagcagcggagguugcagagcagcgaauguuggugaacagcaaaugcugcugccugaucguuccucuggaaguuuugucucagaggaguacccagcugugugaggugucagucugccucuacugggggaugccucccaguuaggcuacucgggggucagggacccacuugaggaggcagucugucuguucucagaccuccagcugcgugcugggagaaccacuacucucuucaaacuaucagacagggacauuuaagucugcagaguuuucugcugccuuuuguuuugcuaugcccugcccccagagguggagucuacagaggcaggcaggccuccuugagcugcagugggcuccacccaguucgagcuuccaggcugcuuuguuuaccuauccaagccucggcaagggcgggcgccccucccccagccuugcugcugccuugcaguuugaucucagccuguugugcuagcaaugagcaggcucugugggcguaggacccucugagccaggcgcgggauauaaucuccuggugugccguuugcuaagaccguuggaaaagcgcaguauuggggugggagugacccgauuuuccaggugccgucugucaccccuuucuuugacuaggaaagggaacucccugaccccuugcgcuuccugggugaggcgaugccucgcccugcuuuggcucacacucggugugcugcaaccacuguccugcacccacgguccgacacuucccagagagaugaaccugguaccucaguuggaaaugcggaaaucacccgucuucugcguugcucacgcugggagcuguagacuggggcuguuccuauucggccaucuuggcuccacccccucaccuaacauuugucaggcacuacugguaagccaggcaaguucuuccugacagguucuuaaccugcccuaauaaacaccuaaguuuguuaccucaaucauauacauauuggguauaugccugguagaauugcugagucauaggauaugcauauucgguuuaguaaauacugccaguuuuugaaagugauuguacuaguuuuacauucccagcaauaguuguauaagauuucccuuguuuugcauuuuuaccaauacuuaaaguggccugccuugaguuguugauacuugugucauuuuugacaucugucauccagacucaaccuccuagggagcuugacccuucccuuuuuucaguuuucucucuagccuagguucagucagcaagaccuaucagauuuuucuuuuauauugccuuuguccuuccuccauugccacagcucaaauauuagucauauauggaguaaauaucaggugauuuggauaucaggauuaugacaguagucugccaguuggugcaucuucuaguauuucugcuuuuccaauaaauccugcacagccaagaaaaugcuucaugaaacaccgcaccauugcucugcucaaaagccgucaacaacccuucauugcccauuggauaucagccuuccucccccucuuccuuuuccaccuguaccucucuuccuuccucccuucuuccguucuuuuuuuuuaauuaaaguguaauauauaugaagugcacuaugacagagauuaaaguauagagcauuaccaacacccagaagccuccaguuugccucuuccuagucuucucuuaagucuucucuuaagguacccacuauucugauuucugucaccauacauagguuuuaccugauuuugaacuuuauauaaauguuaaaaagcuaauuuauagcuuaaaaaguacaaacucuuaugucuggcuucuuuugcugaauguucugacugugagauucaccuacacucugcuuauagugcucauuuuuuuuauugcugaauagcaauucuauuuuaugaguauacuacauuuauuuacccauucuacugugaugacauuuggguuauugggguuauuucacuuugggacaauuaugaaugcugcugcuguuaacauuuuggguguuucuguccuuugauauaaaaauauacacuuauauauuggguauaugccuaguagaauuguugguucauaggauaugcauguuagguuuaguaaauucuggcaguuuuugaaagugauuguaccaguuuuacauucccagcaauaguguuaaauuccauuguccugcauuuuuaccaauacuugcuauugucaguuuuaaaaauuugucauucuggugggaguguaauaauaugucauuuuggauugaauuugcauuugcuucauaaccagugauggugaaucccuguauugaacauuugaaaaucuucuguugcaaagugugcuuuauucaaggccuuugugaaauuuuuauuagguuguccaucuauuaaauuguagaaaucuuuacauauuuugagugaguucuuuuuuggguaucuguauuagagucuuccuuagacuguggcuuguauuuucacucucuaauggugucuugugaugaaaaucuuuguuuuaaugaaguuugauuuaguaauuaaacuuuauucuuauugcccuuguuucuuguuuaauaaaucuuugucuaacuuaagaucaugcugaucuuuuccagguauuuuauuuuuuuuauuuuuuuuguuuuugagacagagucucacuuuguugcccaggcaggagugcaguggcacgauccggcacccuccaccuccuggguucaagagauucuucugccucagccucccgaguagcugggauuacaggcaugcgcccagcuaauuuuuguauuuuuaguagagacgggguuucucuauuguuggccaggcuagucucgaacuccugaccucagguuauccacccgccucagccucccaaagugcugggauuacaggcgugagccgccgugccuggccagguaauaaaagagccaccuggcucuuuuauuuauaguuugugaagaguuuuaaucaugauauuaugauauuaaauuuucucaaauauuuuuacugcauauauuaagggaaucauauguuuucucccuuauuuuauuaauuugugguauauauugauugcuguuuaaaugauaaauugcccucacauucucauaguaaaccuaauuugguuugauguaucaucuuuuuaauauaaugcuaaaucugacuugcugauauuaguuauuagaacuuuugcaucuaaauucaugagagagacugcccuauuauuuuuuugugguaacuuugucagguuuuggcaucaaguuuuauguugcucucagaaagcagguugagacauuuuccuuuuuuuuuuuucuauucuuugaaagacuuuagauaaaauugguguuauuuuuucuuacauuuugaugaggaauuccccggugaagcucuuugggccuucucugugggaagguuuuaauuuccgauccaauuucuuugaucagcauaagcuguucagauuuccuguuuuuucuugggucacuuuugguauguugcauuuugcaguuuguucauuuuauguaaacucucacauuuaaaguuugaaauuuuuuuaaaacaaccuacugucuugugacuaggauggaucagugaugaugucucauuuuuuauucugauauuggucauuugugcuugcuuucacuccauuucugucuccucgaucagucuugguguguuuuaucacuuuugugccuuuuuucaaagaaccaacuuuuggcuuugcugauuuucucucguucauuuguuuuguauuuucauugauuucugcucauuauuauuuucuuccauuacucucugaauuuuaguuguuccuuuagcuucuugagaugaauacuuuauugauauuuuuuagucuucuuuucucuuaaauacauuuaaaguuaaaaauuuucccucuaaccacagguuuaaaugugucccacaaguuuuucuuuuucuuuuucuuuuuuuguuuguauuuuuucuuuuuuguuuuuuguauuguuuuuuccuuuuauaccccacaaguuuugauauauuuucauuaucauuucaauucaaauauuguuaauuuccauuguguuaucuucuuuggcccguggguuuguuuuauaaguguaccaauuaauuuccaaaaauuugaguauuugguuuuuuuuuuaaguuacuaauuuauagcuuaauuccauauggucagugaaugacucagcauguggucaguuuuuguaaauauuccaugugcauuaaauguggacuuugcauuuguuggcucuuauauucuacauauaucaaauaggccuaguguguucaucauguuguuuaaauaucuuacauccuuagcugagugugguggcacauaccuguaaucccagcuaguugggaggcugaggcaggagaaucacuugaaccugggaggcggggguuacagugagccgagaucaugucacucuacuccagccugggcaacagagugaaacuaugucucaaaaaaaaaaaaaaacuuacauucuuauugauuuacuugucuacuuguuuuauuacugaaauagauuuuuuaaaaucucccacugugauuguagaugaauuuuuccccuuuuauucuauguuucuauauauauuggguggcaacaaauuuaggacuacuguaucuuccugauuuaguugacuuuuuuuuauuaugaaauauuccuuuuaauuuuaauuaaacuucuugccuuaaaaucuauuuugauauuggccgggugugguggcucacgccuguaaucccagccguuugugagacuagggugagaggaucucuugagccuaggaguuugagaucagccugggcagcauagugagagccccucaucuuuaaaacaaaauuaaaaauuaaaaaaaaguuuacuuugaugaauccuaguacaauaguaacuuuuuugguuaacguuugcagguuaagguuuuuuuuuuuuuuuuuuuugagauggaguuuugcucuugucgcccaggcuggagugcaauggugccaucuuggcucacuggaaccucugccucccggguucaagcaauucucgugccucagccucccaaguagcugggacuagaggugcucgccaccaugcucagcuaauuuuuguauuuuuaguagaggugggguuucaccacguuggccaggcuggucucgaacuccugaccucaggugaucugcccaccucggccucccacagugcugggauuacaggugugaaccaccgcacccggccugcaggguaaguuuuuucugucuuucugcuuccaaucuuuaaaugaccuuacguuuaagguauucuucuuguaaauagcauagagcuagauauuuuuaauccaucuugacaauuguugucuauuguuauuauuuauuauuguuauuuuuuuuuugagacagagucucacucugucgcccaggcuggagugcaguggcgagaucucagcucacugcaauuucugccuccuggcuucaagugauucucaugccucagcgucccaaguaggugggauuacagacgugcaccaccacgccuggcuaauuuuuguauuuuuaguagagacaaggguuucaccauguuggccaggcuggucuugaacuccuggccucaagugaucugccgguccuggccugccaaagugcugggauuauaggugugagccacuaugccuggccaauguuugucuuuuaauuggaguauuuaguccaugaacuuuuuuuuuuuuuuuuugagacggagccucgcucugucacccaggcuggagugcaguggcacuaucucagcucacugcaaccuccgccuccugauucaagcgauucuccugccucagccuccugaguagcugggauuacagaugcccgccaccacacccagcuaauuuuuuguuuuuuguuuuuuguuuuuuuuuuugagacggagucucgcucugucgcccaggcuggagugcaguggugcggucucggcucacugcaaguuccaccuccuggguucaugccauucuccugccucagccucccgaguagcugggacuacaggcgcccgccaccacgcccagcuaguuuuuuguauuuuuaguagagacgggguuuuaccacguuagccaggauggucuugaucuccugaccucgugauccaccugccucggccuccuaaaaugcugggauuacaggcgugagccacugcgcccggccaauuuuuuuguauuuuuaguagagacgggguuucaccauguuggccagucuggucuugaacuccugaccucaugaucugcccgcuuuggccucccaaagugcuggaauuacaggugugagccaccgcgccuggcaaguccaugaacuuuuaaugugauuacugaucuauuuggaucucaaucuaccauaguauuuuauugucuuauuugucacguauagucaacauuccuuuaguguuagacacauauuuacccuuuucagugcucuucauuuucacauuuccaucugcgauuauuuucuuucaguuaaguagcuccuuuugguacuucuuuugguaucgcuggcaguaaaaucuccauauuuguuugacugaagacaucuuuauuucacuauguuuuuuauuuuuuaagaguauauuuggugaguauauaauuagauauuagaauuuauuuucuuucaaacuuuauaucauucuguugucuucuagggccauaguaucuugucaggugugaaguuuuggccuuauuagucagguguuaaucuuauguuugugaauauaauaugucuuuuucuucgggcuuaagauuuucuuugucuuugguuuuuagcaauuuuagaucaauguggcuaagcaugauuuuuuuuuuuauccuguuuggugcuuguaaagcuucuuuaauugauguuuuucaucuguuuuacaacauuggccaauaucucuuuaaauagugcaucuucucaguuuuucucuauuucuggggcucccauguauggguguuuuuguuuuuguuuucugugaccuaugucuuaguaauuuucuaaucuuauuuuuuucucuguacuuuaaucuggauauggaaaauaugccuacuuuccacuccacguaagaucuuauuugucuaguuggcuuuuaaaucuauuaaaauucuaauuugaguuacuguauuuuuuugguucuaagauuuccgucucauucuuuucuguauagauuccagcucuuuggucuggguuuccaucuuuuagccuguuuuaauggccaugccccauuauugaaauagcugaaucccuuggcaucuguucuguugucuucuuuuuccucuuggcuuucagucaucuguuucucuuuccugguaugccuguaguuuuuuuuuuuuuuuuuuuuuuaauucaaugaugaguauuguguaugaaaaaauauacggaggucaggugcuguggcucacgccuguaaucccagcacuuugggaggccaaggcggguggaucaucuaacgucaggaguucaagaccagccuggccaacauggugaaacccugucucuacuaaaaauacaaaaauuagcgaggcgugguggcgcacaccuguaaucccagcuacucgggaggcugagggaggagaauggcuugaacccgggaggcggagguugcagugagccgagauugugccauugcacuccagccuggguaacagcaaaacucugucuggaaaaaagaaagaaagaaggaaaaauauauggguucugaguauguuaucuuccuccagaggaaauuuuaguguuuuucuggcaaguagaucguguaugggcacaucaccuuuauucaguugagguggucuauuuccgguuucccuuacuccuagggcuuagcuuuuuuuaggaccuucaguugaaaguuugggaguguguuggagaugggucuauuaaggcuccuguucccuggcaggcccugaaauccacauuuuguucuagcaaaaucucugcuuggcuuuuuccccuuuagcagcuucuuuccguuugguuucucaguccccagucacaccugugcagcuuaggaauuagcaaaugccgggagggaagauugcaagcagaacguugaguuccuguuucuauggaaucuuggcccguagaaagucugcuuugauaccauuaauguccaguguuuguuccggaugagacugcugcggagucuaguuuaugccuuucuauguggcccagugugccuugcauaugaauaaggaaaugcucugaggccagaggcugcagggaagccagcucagagcauuugucaguacucuccaauccuggcuauuuggauccuucuggaaugccuucaaaccauuugcucucuuugcuugcuuguuucuuuuugguauuuuauccagcuugcauaguuguucucagagggcgggucagccugguaccuucugcugggccauagcuagcagcguaagccuuggagcccuggcacuugaaaccccacacuguccaagcacaacuuacccagccuugccucuucacagccaccuguuguguccacccugugcuuagccuagacuuuccacacaaccuuuucuugcugcucucucaguccuguccauucccaucaaaaaucgaauuguucuucagaccuguacagucuccacuucugauuccuggcauugugacccaugagauucuuccucugcagugaauucauagcaauaacugaccggccacuguagcauuucuugauguauuauaucaugugccuuguauuuagcuuucauccaguugggggagggcggggauguuguaguguaccucuuuguaccaagauugauuugcugcauaucuugcaggugaaagcauguauugccaauguagaacccaaccaaacaguggagaucaaugagcaagaagcauuggaagagaaauuggaaaaugugaaagccauucugcaggcauaucauuuuacagguuuuguuuguuuuuuuaaccuaauuuagucugggucugccucuagugaguuaguuugcuagauguguuaucaguccuggaauuauuucauaauuuauaguauuuuacacccucugcccucaucacucacacacacacacacacacagacacacacacagcugacgugcuauuuguaggccuaucuucaccuacaagauugacuggccccuuuguacagcagcucaguugguggcuggcuuauuccacucaucuuaacaguucgucaugugccagaccuuguacuagaacugucuuuacugcuggcuuguuuucugccacuagugaaauaguuugaacuuuccaagucuccguuucaccguaaauagggauuuauucucccaucuaugccacaagauaguugugggaagaacuggggacucugacaaauuacuucacacucagaaauaaagaauagcuauaaauuaaauuuuuggccuugcuuaugccuguaaucccaucacuuugggaggcugaggcaggauuacuugaguccaggaguucgagaccagccugggcaacauagcaagaccucaucucuacuaaaaauuuaaaaaugagccaggugagguggcaugcgcuuguggucccagcuguuugggaggcugagaugggaggaucauuuaagcccaggaaguugagguugcagugagcugagaucgugccaccgcacuccagccugggugacagagugaaacccuaucucaaaaaaaaaaaaaaaaaaauuucucaauaguuugacauuuagguuguuuuuucauuuuuaccauucuuccaugguuuuaacaacucagucucaaagugagccggagccaaggggaagaaugagccuaugauacucauugaacaaacauuuguguacaaaguguacauauucuaggcacuguggaagcuacuggaggcacagaugaguaagacaucaccuuggccugcugucuauugaggugucuucuuguuugccucaggccucagugguaaacugaccagccgaggaguuugugucugcaucaguacugcuuuugaggggaaccuauuggauuccuauuuuguggaccuugucauacagaaaccacuccggauacaucaccauucagucccagucuucauuccccuggaagagauagcugcaaaauauuuacagaccaacauccagcacuuccuguucagucucugcgaguaccugaaugcuuacucugggaggaaguaccaggcagaccggcuucagguaucucucugggauguuauaugccucauccgugggcccaagaucaacuuaaaagggggauguuuuuuguauuuucaguguuuccuaacugugaguuagaaguuugaccguuaccuuuccgaugcuuguuucuuauuuauauaaaagcacuaucccacccucuuuucuuuugaaacucuggauggcguugaagccuggguacugguuaaaggauuaugcaccccugaaugguggucuucaagcuuuuaucguaagauuguacagagugcaguugcuauacuuuugauccaucagggauuuauggcgugccuacuauguaccauaccgagugccuugcugaaccuuggguauagaucucauuagagaagaaagguuucugcagugccauggaacaaugcuguccaucuuccccuaaacucuagccuaccuuuuuggguugcaguugagcuaagguugggugaaaaaaguagauaggaaauuaaugcaaauaggcuguaagugccuccuacaagcuuagcauuucccccucuauggauuuggaguaacucugaagcucucagcuguagauuuaacuuaaauugaaauguggaugcagucaugaagcaucuuagccguguaacgucagugaaguuucugcagaaacagucucuugcgaagcuguaccccuggccauuuaggccuauaggccuuuccaggcugccagugacucuuaguuaucuuaggcaucuuuuucauuaguccuuuuuucagaccuuuuucugucccucauuuauuucucugaaauguaaucgaugggccucuuuuugguugacguaauugaagggucaguaaacaccaccuuuggaacugcagucauccucuacuucguuuuguuccucaccccucuuagagugacuuugcagcccuccugacugggcccuugcagagaaacccacuguguaacuugcugucauuuacuuacaaacuggauccagggggucaguccuucccguucugugcuagauugcuguauaaggaccucacagcaacucuucccacugacgucaccgugacaugucaagguaagaagggugccucagugcagaaauucucauaucccaguuuauuugagugaaacagggaaaauagguagaauccaugaaguagaccucuugagacacuuucucuguuuauauacuguacauuacucagaccgguaagauagaacauucuuguuucuaccagucuuuuccuuccucuuuguaaaugguaaacaugauuguccccauuuucccuucuccuuugcccacccaccucagcaguguucucgcagccuaugauuuguuuucacugggggcccugcuucaggaaagacaccuaaugauaaggcugagucaugggucaguuaugguggauggagccagaagacucauuucacugugaagacaaauggacaugacacgucagcacacacuuacuccucccuacggagcagucucuaaauggaaauccuuccagacuggcugagagagagauuuuuuggugaaccuguuucaguuaaaugugacaugggcaauaaugaaaaauugggugaaauguuuuuaggaggcagaaauuuugaagcugccccagauuucacaccaucggucuuugauuucucugcgcaguuagauuccaguccccagucucuagauugcauugguccaguaaggggcagccuuaguccagaccaaaaaaaaaagcuguauggguccaguggguccagaauaucagugauccagguuccgauucccccagcugcacugagugagauugaaugucagugauccaggcuccgauucccccagcugcacugaaugagauugaauaucagugauccaggcuccgauucccccagcugcacugaaugagauugauggaaucuuucuuuuuaggaguggaaguauuauccacuucaugggaggagcaacgagcaucucaugaaacucuguucuguacgaagcccuugcaucaaguguuugccucauuuacaagaaaaggagaaaaguuggauaugagucuggucuccuaauagauuguuuucacugcacugggagcacaucagagguaaguaaccaguacugaagacaguaccagguggguaguacugucugaugaaggguacaucacccuucugaugaaaacagacaccuaccuguucaucuggauggaagagcagguuugaguauagacacuggcauuuuugaacaauucccaugaucaccuggucccuucuuaaaaugcucaagauguuuuuuaaagguauuaguugaucauacauuuuaguugaaaaucauuuguggggcaauaaaagccauuuuuugaaaaagguguaucacucaagaaguacuuauggaaaaauaucaaauuauugagggcauuaacucugggaaagaccaggcaauuaaguugucacaguaacugcuacuaauuuaaugccaggaauagagaugccaaaaauccuaaaauuuucagaaagggcucucacagaaauguagcacuccacucaaacugcaauagcuugauucuguugagaaacacugaucuaaauaaauggaaaaauaacccacauucacuaaugaagauaauaaggaagacccaauauuuuuuuuuuuuuaaaaggaaaguauuuuuagcuuuuaugaaagcuuuaaguaauuuuuccucauuuuccuguuugaaacuuuugaaaaggaaguucuucaguguuuguuugguuaggcgcaguguauucuaggccacugcuuuauaaauauggugugagaaagcaguaggauaaaauaaucagaguucagugugucucauauuuuguuuccuaaaaguuuaguagagcugugaauguacuaggaaguccccucugaaaaagcacaguuaguuaguuagaaaucugcccauuaacucagggggacucaggcgccccccgggucuucccucuccugcaggcucuccgguuaguguccugauuugccguaaccacgggccucugaccugcuggcaccucugguuccuuggcgugugggucacucacagauaugaaaaccugugucuggcugaccagguucuccuguagcccucccuugcccaggcacagauaggagucaugacuggcccaaggccacguucagacuuaacccugcaauggccacgaaguaaccuccgugugggagagcuccaggaacagugcaggggauuaaagccagcuuggaguacccuuuagaagaaaguuuaagaauaaaagagacagggccaggcagcaggcguuccgggguacagugagcuaugaugagaccuucaagcucuugccuuccaggccugugguggggaccaguggcaugagucagcaaaguaccagcacuccucagauaagugauauuaacagaauuuccacaaucacuuucaaguugaauaaagcuuuuaauaaaacagucuuguucuuuaucaauaccuguaaauucucuuaaagcaguagcaaaggcgacuguagcaagagcucaaaaggcaaggcaauaucggaaaguguauuuaacagaagauuaaaaauauaaauguagaagaucuguuuauauauuuuucuuucagaaauaaauccccccuccccugccaggugaaaggaaauauugcacuuucuguucucaugacuaaggggacaggaguuccagaagaaccuuucaagaugaucaggaacaccaggacgagggccgucucaccucacucggaccacauggagaccucccuucaaaaugggagccauguccugccccaccaagcccugucugaaguggagcuuccccgccugugcucccuccacagucccggaaagcccagcggcaaaggcagcuuugucccagcucugccacccuccugcucacaguggucagggccccucaggggcaaggacggcagggauuggaacgagggcucuggaaggacuguucagcccuaugccuaagaccccuaugcuggggacacuacaggcacacacaggaauagcagggccacccucagagcucacacauccacgaacaaaugaaggcugaggagguuucuaaaccuaaaguccaugagugugcacuucaauccaggaaggucgggacuuccuucaguuucaaaaaauaaauucucccuuccgguuuggacuguugcaggcucgaggccauucaggaguuguccaccaccugguggggcagugugacagaggggccauuggggaagguggcuagcuuaucccgccccuucaagaagaaggucagcagcucccccuuccccuucacaaagauggggccucgccucacaaagcggaagccguacucucggaggaugacuuggguuucuucuaccaccuggagagggagggggagcaagaacguggcguuacggggggagccuagacugagggcgggugggggcuuugggugguuggagccgagcacugauccaugggucccaagcaguacgggacacuccccaaaccucccagggccaagcccuuccacccguggcgagcagcgggugggaaggagaacccuggagugacuggcugggggccuccucucauccagagacuucucuccuaggauggccauggucaccuggguggcagcacuguuaccuggaaacugccacugccugcucuucugucccuuugccccuuucguggagcuuuucugccagacgccacugagacagaucacaagguauuagaagguucauacccaaagguaggccauaugcaucuagaacuucagcccagauuuuguggauggguggaaguguuucuuccugugcugaggcuagcuauugcagagauucuuuuccacuugccccacgucucugccucuggacuuacuguucagggccagggugggaggcaggggcacgugggaaagcacuguuccgguuuuguucucaugccgagucugagcacgugccagcugugccacuggacauaccugaauguugcccaugacccccguggacuccauccugcuggcuacauugacuguauugccccagaugucguagugugguuuccgggcuccgaugaccccagccagaaccccgccuuuguucaugccuaggguagaggcauaaaguucagcacagccacaggccacaccuuguuaugggccucagaagccaucuccucuccagaccuguaccacaaagcuccuaauguaacacaucauuguccucauucaacuuggcuguaugcuauuggaggguggaaaucacaucuccuguuuauccgugugcuuguuaggugucagccgccaccccccccccauaugcagauuuacucggcaugguaguggccagcuucuaacacagcugguauuucaagucuccugggaccucacucaggaaugauacccccucaguagaagcagcaggugaucuuaacuccuuucaaagagcaggccugucugggaagccauguccucagcaggcacagcaaccccucuggaaauggaucacaaacucacuucucagccaggcaggccaagcuucuauuguaacaguaggcacaguauagucggaucaucacaucagcuggguuuuugguuuagucaucuagagucgucuggacuaaaggucuuucaggucuccuugcccugugagugcgugaaccuccccacccgaauugccucaguuguccugagccucaugucucuccugguggugggccaggccccugcaugggaagggagccugcugcggggcaggccagcugggggugcucaccuaugcgcagcaugaaguuauugaaggacugguuguugauguuggugagcguauccuucauggccagcgcgaagucggccaggucagccaggugcugccagcgcucucucucggacuugucuuccugugccaggggaccguggagaaagugucaggggccgcucacugcagcagccugcucugcugccuucccuggcaguguucuggggguggauucccuacaccuagauguucaaggccuuacuuuuccucccacaaaggagucgcagccacgcuagcucugacuugccacugugacaaaguucacguagcaggucuaggcaaagacugggcaauugagcagaggagacggaccugugagucugaccacgaggcggaccccuucaccuuggcugggccugguccugguccuuagguuuugucagguuguccuuguuuggaucccucaacuaggugauaagcacuggagggggaugacccgccuuggacguguuucuuuaaccucauccauauaauagggccgugggaugguuguagagguaaagcaggaugaugguguuuuaagaccagagcuugggaccagggcuccuacaccuaauuuucucuccugguagcugaacaaaggucuaaauuagcuuaacaaaagaacaggcugccgucagccagaguucugaaggccaugcuuucaguuucccuuguugacaauugcucuccaguuccuaugaaagcacagagccuuagggggccuggccacagaacacaaccaucuuaggccugagcugugaacagcaggggguugugugucuguucuguuucucugcuugccgaacuuucucaauaaacccuauuucuuauuuaua

SEQ ID NO: 192341 - RNA, 157663 nt, Homo sapiens
cggccgccauguuguuguggggcugaggcggcgccggcggagcccugagcggcugugacaggcuacgcaacagguucgcgggcggcggccugacgaccaagccagcugcaguggcggcgacggcggcagagcagggucuccccgcgccugcccgcgcccaggcugccggugcugagggacgcggagucgcgcugugacgagcgggaggcgcggcgagggcgccaggugggugaagccgcuagcggggcugcagcaaggcgcggggcaggugcgggcgccgcgcccgcugcccggaggcucugcgggucgggcugaggcggcugugcgcuccgcacgauggggacggguccucgggaguacgggcggcccccgagcuaggccccuggcgggcucggccgugcggggcggaaaccuccggccccggguuccuuccucugcugccgggccgggacagacgccgagggggccugggcugggcugccccuuccuugcggccgagcccgggucccuggccgcggccucgucuggcagguggcggacgccggcgagggucggggguggcguggcccccucgcuuucggggugugagcagaagagagcucugggggcacccgcacgccuccucggggacccauuuuauuuucgcggaguugguuuuccuuccuggcaaggguuggugccgaaugucaggugagccgcaucccggugcgucaaaguagcccgagucacgagaggacagugggcggaugcuuggcgucuaccgcucgcguuccuccggaguuggaaauguuaaauuuaccuucagcguuauugacuuccagaauauacaggaagcaccgagagauguaaucucucaggccagauaaaguuuauuuguguauuuauuuauuuauuuuuaaagacgucugcauaugcauagugaguggguaaaccgaggcugaaacugcagauggcuuuguauucuauagaaagaugcuccguuuggauuuauuaauuaugcgccuugucgcucuagaauuaccaauggcaagugugcuuuauuugaaacuuguguuaauacugaaauaggaauauuuuuugauggagccaaccccuuuacgauaggaauuaagguuagcauagaaaugacuugcuuugcuccaugcuucuaguuugucucacuaguguuugcuugcuuacucagaaauaggcaaggugugacuugaaauuuuacguuguuagugagcucaguuuagguagcauagcucuuguaguuuaaagcuucuuaagcguuucgaaaaauugccucucucccugugcugguuugcuauauuguuaaucagugauaaaaccuaaaagcuaccuagaaacaucgcauaaaacauuuacgcgaauuaauaaugacguccuuccaaauuuaaagauacugacaacucugauguguuuuccuuuagcuuuuuuuggcugugccugugacucucuuguaauuucaaaaguaaauaaaguggauguauuuuauguuuuugaaaacguggaaaaaaugugcauugcugcuauuuugauguaauauuaauaagcaguugaaaagcuugcauuuuuucacccuuccaugcauugauaacuauucccugugcccaccuuuguaaugaaagguaaacucguccaagaaaacuugaccuguacagaauuacuaagcagggaguuaccauuguucgguacaucucaaggcuaaaaucuugaucucuccugaauaugaggagguguguuaggcauguuuuggggauuggauuaauaguguuaaaaaauuuguauuuucacaaaaauagcauguacccaucacccaaacucagcagcuuucaagaagcuuuucuuuuuuucuuucuuauuuuaaaaaauccuuuaaccuuauguaguuaguauaucuuuuuuaaaaaguagaaaaucauguaaccuuaggauuuuuaguuuuaauguagaguuucacaaauuuccaucuuuaguaagacaaaagggucacauauuggcugucuccuucaacuauacuuucuucaguauaaaauauguuuaccaugguugucauuuaucgagcacguaacugcauguuagacucuaugcuaaguguuuuacauaaucauuuaaagcucacuaaggcccuaggaguaauuauuaucuucccaucaaaaagguaagugaaauguuaaccugaaguuugacuacuuuaggucucugagcuaguaaguacaauagccagguuucaaaccaagauccuuuuaacugcagcaccugugccuuaucugguagagucaucuugguucauacauuuaaaaaagaguuaucuaugugccgggugcccuggcucaugccuguaaucccagcacuuugggaggccgaggagggcggaucaccaggucaggaguuugagacugaccaauaaggugaaauccugucucuacuaaaaaauacaaaaaauuagccuggcaugguggcgugcgccuguagucccagguacucaggaggcugaggcaggagaaucguugaacccgggaggcggagguugcagugaaccgagaucgcaccacugcacuccagccuaggcgacagagugagacuccgucucaaacaaaaaaaagaaaaaaaaaguuauaugggcauucaguaaaaaauauguguuuagugaaugagugaaaguacauauuaguccauuaaguagcauuuuuacauauuguauuuacuuguaaaacauuuauauuaacaaguuccagaaaugauucagaauaaacgaguuacauuaccaaaaaugugauauauuuauuaccaucuaacggugcauuuucuuuuucuuuuuuuggauucaaguuuuuuuaguaccuuuuuuauuuauggaaaaaauuugugaaaaaacuguuuuugaagaaaggcagacuuucuugugugccgauuuuuuuuuauuucuuacaaaaaaaacaggauauaugugcagaacguacagguuuguuacauagguauacgugcaccguggugguuugcugcaccuauucacccguccucuaaguccccuucccucauugcccccccacaacagguccugguguguguuguuccccucuguguccauguguucucaauguucaacucccacuuaugagugagaacauaggguguuugauuuucuguuccuguguuaguuugcugaggaugauggcuuccaguuucguccaugucccugcaaaggacaugaucucauuccuuuuuauggcugcauaguauuccaugguguauguauaucacauuuucuuuauccagucuaucauugacgggcauuuggguugguuuggugucuuugcuauuguaaauagugcuguaguaaacauacgugugcaugugucuuuagaguagaaugauuucuauuccuuuggguauauacccauuaaugagauugcugggucaaaugauauuucugguucuagauccuugaggaauugccauacuaucuuccacuaugguugaaccaauuuacauucccagcaacaguguaaaagcguuccauuucgccacagacuugccagcaucuauuguuuuccugacuuuuuaauaaucaccauucugacuggcaugaaaugguaucucauuguguuuuuuuuuuuuugagacggagucucacucuuguugcccagucuggagugcaauggcgcgaucccaacucacugcaaccuccgccuccuggguucaagugauucuucugccucagccuccugaguagcugggauuacagacgccugccaccacgcccugccaauuuuugucuuuuuaguagagacauguuggccaggcuggucuagaacucccaaccucagaugagccacccgccuuggccucccaaagugcugggauuacaggcuugagccacugcacccggccaucauugugguuuugauuugcaguucucugaugaucagugauguugagccuuuuuucauguuuguuggccucaaaaaugucuucuuuugagaagugucuauucauauccuuugcccacuuuuuggugggguuuuuuuuuucuuguagauauguuuaaguuccuuguaaauucuggauauuagaccuuugucagauggauagauugcaaaaauuuucucccguucuguggguugccuguucacucugaugauaguuucuuuuuuucuuucuuuuuuuuuuuuuuuuugagacagggucuugcucugucucccaggcuggagugccguggugccaucuuggcucaccacaaucucugccuaccagguucaccucccaaguagcugggauuauaggcaugugccaccacguccagcuauuuuuuuuuuuuuugagauggagucucgcucuugucccccaggcuggagugcaauggugcgaucuuggcucacugcaaccucagccuccgggguucaagugugauucuccugccucagccuccugaguagcugggauuacaggcgccugccaccaugcccagcuaauuuuuguauuuuuaguagagaugggguuucaccauguccaggcuggucucaaauuccugaccucaggugauccacccgccucggccucccaaagugcugggauuacagaugugagccacuaugccuggccuuuuuguaauuuuuuaaaaauagagacaggguuucaccaugcaggccaggcuggucuggaauuccugaccucaggugauccucccaccucggccuccuauagugcugggauuauaggcaugagccacugcacccagccugaugauaguuucuuuugcugugcagaagcucuuuaguuuaauuagauccuauuugucaauuuuggcuuuuguugcaauugcuuuuggcauuuuugucaugaagucuuugcccaugccuauguccugaaugguauugccuagguuuucuucuaggguuuuaugguuuuggauuuuauauuuaagucuuuaauucaucucaaguuaauuuuuguauaagguguaaggaagugguccaguuucaguuuucugcauauggcuagccaauuuucccagcaccauuuacagaauaggagauccuuuccccauugcuuguuuuugucuuguuuguugaagaucagaugguuguagaugugugguguuauuucugaggucucuguucugcuccauuggcuuauaugucuguuuugguaccagugccaugcuguuuugguuacugugugcugauuuuaaagacaggauuccaagugugaaguagaaaaauaagaauguuuauaauuaauucuguaaguggauagaucuaaaguugaagguacaucagaaauacuguauuuuuuacuugaguucauuuuuuggauuuuguaacauccuacagcuguggagcgcagaaacuaauguuagaguucucuuggguaaagugugaauauagguauucuugaggaggaggaacugaacuggucuuaaaggauaugagagcaaagaggaagugggagaggaagggaggaaacugaacagaauuaggacaguuaauagaucaagaaauauguauuuucacagcuccaagagggcagcauauuucauuugcagaauguauaguauuguuucaaaagguucacuuaaaauauaauuucauagauacaucaggacauuaaaugauuuauuuacuuguggagcuauucagcaguggauuauggcagacauuuaguggauuaggggacuauuaccagacgguaaacauuuguuuuauuuaacuguuucauauuuuuaagaucauuuucuucacgaaugcguauucauuuuagauaaaguauaugugauuuuaauaaaaauuucauuuauuuucaucauaaccauagaggauaagaguacagccucugaaguuagaccugcuuccagcucugacaccaaauaacuguauaaucuugggcaaguuacuuuaauucucuucagcuucuguuuccuuaugugugaaauggggaaauauuagcuaguuccuaguguuguuauauguaauauaaagugcuuagcacagugacuucugcuuaguguaagugccuaauguuaccuguuguuuuaacuugguucagugagaaauuucaaacuaaccuaacauaguucuuauuuuggucuuuguuuuacaccgugacuggaaaggaaauuagccuuuugcccuuaauuuuuaaucuuaccaucggaauaaucuauauaagaaggcugaaaaguaggguaguacagacccacaaucccacugggcucaauuuccaaauuuguuuuuaacauucucaaggggccuaugaaaauguuuagugaagccuucuuuaaagugugguuuaucuugggccagccccacaguuggugauggccuugggccugagacccuuccaggaugggccuggugaugguaucagugauaaugagguaaccaugauaacauguaacaacuuguaguguagggcuuggcacuuaguaaauauugaugauugauggcugcuguuuuaauuuucauaauaaauaugcacauuuauaucaaaauguaaguuuuaaauuguaagaacauaagcaguuuccauguuauuauguggucuaacugaacuugaucacaaaauagcuuuauugagauuuaauucacauaucauaugaauuugauuuuaaguggaagcaugauacuuggcuuaguauauuccuuuauuuuuggacauucauuuuuaguuuuuuucaaugauuacuaaugcugccauaucuuuguaauuaaagcauuucccacauuuacuguuauuuccuuaugacagauucccagaaaugaaauuauugcuuuauaggauaugaauguuggugggacucuugauauauguuuucacagugccuucugaagagugauaccaauacguauucccaugggcuguaccugcaagcacccuauuuaauucaccuuugcuagcccuggguauuggccaguguuuuguuuuguuuugucuuugagacagggucuggcucuguugcccaggcuggagugcaguggcgggaucucagcucacugccaucucagcucacugcaaccuccuucuccugggcucaagccauccucccaccucagccucccgcugggaccaacuaauuuuuuuguaguuuuuauugaggcagguuuacaccauguuucccaggcuggccucaaacuccugaguucagacgauucgcccccacucagccucccaaagugcugggauuacaggcaugagccacuguggguagccucguuuucuuaauuauuagugauguuaacauuuauuaacuacuuuuauuucuucuguuucuucuuucguagauuauuuauuugaggucuuaguguuuucguuaucuauuuuaauagcccuauguacauuaaaaauaucaacugcuuaucauguguugugauuuuuccccauuuaccuuuuaaguuuguuuucaaggaaguuuuaaauauuuguuauauagaugauauagaaucugcuuauucuuucuuuuguuuucuuguauggcuucaaaacuuaaaaguugucuuuguuucaaagaggugauguuuuacuugaaagugaagcaucugucugaauuucuuucccucuguacuuuuuauucaugucaaguaaauaguuuugcuguaauauuuaguucugauaugagacagaugacaauaggcuaaauauuaucagucccccugggaccccuuauaggaaugcaggcugagucacaagcuauucuuagguauuuuuaucccccuuugugugggugaauugucuuguucagaguuguugacuauucuucaaaaauugguuugauuuaaaucuucaauagaauuugaguacuaaccacuucaguauuaguuugcuauuccuguccuuuuaugucuccuggcuuauugguugauuuuuuugaaggcuaaacucaauauuuauaaaaaucugagcuuauaauuuguguuuaaaaaucuaaacugagguugcuaaauugcagaacuagaauuaagaacuaaguuuguauagagaaguuauccucuuugaggcuuuuaggucuuaaugcuuuguauauuugggacccuaagccucuagauagaaaugauaacuuuuuucucaaauauugauuaaagugagaaaaacauguccuuuuauuaauaauuggcacaacucuaauuuguuucaguaaaacaaauuagauuagugauuagugauugugauuacaacuaaaaguugauuagugauuauaauuaaaauaauguugaaauaauuguuguaauaaucauaauuuauggacaccuucuaugugccagauguuuuccagacaugacaucuaagccuuaaaauaaccuggcauuuagguacgauuacaguaguacuuugcuugucugcaaggaauacauuccaaaaccccuagugguugcuugaaaccauggaugguacagaaaccuauauacacuauguuuuuuccuauauauacauaccuaugauaaaguuuaauuuauaaauuaggcacaguaagagauuaauaauaauaaaauugaacaauuauaacaauauacuguuaacaauuucacagauauaagacuuguucuuacuguagaucuuagcaaccucagcauacaauuuuuucccuucuauauuaaguugagaacuuucaccuuuucacuugaaggaaguggcuucuccuuggcauauccgaauugccagccucacuacucuugcacuuuggggucauuauuaaguaaaauaaggguuacuugaacacaagcacugugauacugugacagucggucugauaacugagacagcuacuaagugacuaaugggcaggcagcauagacacaguggauacacccuggacaaagggaugguuuucauccugguugggacagaugcgggcaaugcaggauuuuaccaugcuacucaggauggugcacaauuaaaaauuuaugaauuguuuauuucuggaauuauccauuuuguauuuugagaccaugguugaccacagguaacugaaacuucagaaagugaaacugcagauaagggggucuacuguauccacauuauuugguuaggaaauugaagcuaugucaugugcaaguccacaaagcuaggaaguacuugcacugggauucaaacucaaguugcuggguuugucuucugugcaguugaaagaaugcuaaccugugcuuauuaaagaauauuuuagugccuaccaugugagugacugcugggcacuagguauaugaaguuaaagagccauucaggagcucacagucuaauagaagcggggcaggcgugaaaacaaaaguaacaauacuagcugguauguaguuuaaugagauaauacaagacaaaaugggacuguggcaaaggaagcuauuauuaguagaagugucacucagaaggcagguaguuccacaggugcaaagagaggaggcaugggaauaagaucaaguggagguggagguggggagguugaaauaccugguaggguaggcggaagauagagccuaaaacaccuuguaugucacgugaauagauuuuuuaaaaacagcuuuauugagauacauauuguaaaauucacccuuuuaaaguuuacaguucaguguuuuuuaguauauucacagacuugugcaaccaguaucacuaucuaauuuuagaacauuuucgucguucuuaaaagaaccuccuauacccaauggcagucacuuuccaucucccucaacaccgcuagcucuagguagccacuagucuacuuucugugucuaugaaauugccuauccuagacauuucauauaaauggaauuauacaauauauggucuuuugugacucacuucuuuuacuuaccauaguguuuucaagauucaucaauguuauagcauagaucaguacuucauuccuuuuuauggccaaauaauauuuuauggauuauauggauauaccacauuuuguuuauuguuuauucauucauccaucuguaguugauggacauuugcuuccacucgguugcuucuacuuuuuggcuauugugaauaaugcugcugugagcauuuguguacagguuuugggacauguuuuuauuuaucuuggguucauacugagggguggaauugcugacuuaacaugguaaccuauguuuaacauuuugaggaaauucugaauuguuuuccaaagcaguugaucuauuuuauauucccaccagcaauguauguggguuccaguuuaggagguuaauuuuauacuauuggugagccauuacucagaaucacaguggaaaaauuguugaaaauuauuggcuuagauuaaugcuuccucaguaugguccaagacacucacuagaucagaagcuuuuccuaauggaucaugaaccagaaauacaagccgucuccucaguucucaggggcuauuguuauuccauucccauaaccucugauauuuauguauuagaauaggcuaccuaccaauaaucugaguuacuaaggauuacugaaauuuaguauucacaacuaaaauuagcugguuucuagaacuuaccgagggcucuaguuuaguuuucuucuaagaaaucugucagcuauaccaugcuuuggcagcacuagaaaauuaguacuaugcaugcccacacucagaagauauuuucacuacaucagugguguugucucaaauuggcugugguuccaguugcuguuauuuuuggauuaauacaauuguagaauuaauguuacauuuaaauuuuuguggaccguuuugcucuuguguacuuguuacauugcuacaauucuuccuuagggaguuauuuuugcacuagaaaaugggaggagguagguaggcuggaucucuugucuuacuuaggugggugaugguuagaauaguuugggaaugaggcugcugcucggccuauggaguagccauucuuuuauuccuuuaaaaaaauaguuugggaaugaguggauuacauaauuggaagggucuuucccacuucauuaucuuuuuuuaagaaugaggguuuguguauguuaucauuaaacauuuaagcuauggaacacaugaacugucugaaagucuacaguuggcuuuggaugugugaaaccuucagaauuaugugccauauuuuguacauuuguguuuuuccagggagaacaaccauagguuuuaucagauuaaaauaaaaaagucuaugaccacucaaauuaaauaauucagguugaugaaaagaauuuguaaauuugugguuugaaauauuugggggaagugagaccuugcuuugguuaggugguguugugagugaaggauguuuucuggguaugcuauugguuuuaguguaacaaauuccauguuacaauaucucuauuuuauuuuuuccugguaauuuuuuucccuguuagauuuuggaguuugcuuuaaaaaaauucucauugcauauugaugaugaugauaaugaugaugaugaugaugauuauuguuguuguagagacagaaucucacuauguugcucagacuggucucaaacuccugagcucaagcugucauccugccuuggccuccagcagugcugggauuacaggggugagccacugcaacuggcccacauuuauuauuauuuuauguuugcuuucuuggaugauucuuuugauauuauauucaaaagugcuauuuuuuuugcagcgauaguauacuuuauuuguaguaauugaaguauauugguaauuuuuuaaaaaacuucaaauuggcuugauagcauaggaaaauggacgaaugcuuuucugcccguuagcugcuacuuugaauuucuuuacucuuuuauucuguuagccuuuugguugagaugugaaacuaccaaucacagauaaaaguuauucccaugcaggcccuuaugggguauggcaucagcuuagaugccaggcucugucugccccugcaauaggguguguuuguuguaguguacuuuuccucuguaguuuuuagcacuggauguagcaugacuggauuugagaugaaaugguaauuucaguuaaaugcuuuuaguaaaagagacuuguuauuuauuauuguuuauaauagacugaaaaauagacaagggcugccgggugcuguggcucaugccuguaauccuagcacuuugggaagcugaggcggguggaucacuugaggucaggaguucgagaccagccuggccaacauggugaaacuuugucucuacuaaaaugucucuacaaaaaguacaaaaaauuaguugggcaugguggcaggcaccuguaaucccagcuacuugggaggcugaggcaggagaaucgcuugaacccagaagguggagguugcagugagcugauaucgcgccacugcacuccagcuugggcaaaaaaaaaaaaaaaaaaaaaaaucauaguauuugaaaaacuaguuguaaguuuaccauagccuucucuuuacugaagaguaagaucuuuacugagaucuuaguauuuguuuuucacuuuuaauuuuuauuuauuuuuauagauauagggucucacuguuguccagcuggaguucagucucauguucauagcucacuguaaucucgaacucuuggguucaagugauccucccaccucaguuuccugaguagcuaggacuauagaugcacaccacccaucacacccagcuaauuuuaaaauuauugguagagauggggucucacuauguuccuaggcuggucuugaacucccagccucgaaugauucucccgcguuggccucccaaaagcgcuaggauuacaaacauuagccaccguguuuagccuuaucuguuuuuaauuguuuaacauuuugguauaugugguucauguaagauuaaaaaaaaaagaaaacccaaauuuacauucauauucuacaauuuuuuuuuugagaugacauuucgcucuuauugcucaggguggagugcaauggugcgaucucagcucaccgcaaccuacgccuucuggguucaagcgauuuuccugccucagccuaccgaguagcugggauuacaggcaugugccaccacgcauggcuaauuuuguauuuuuagcagggacgggguuucuccauguuggucaggcuggucucgaacucccgaccucaggugauccaccugcuucagccucccaaagggcugggauuacgggcgugagccccagugccuggccuacaauuuguauuuuuuuuuuaauuacauuauauaauaaacauauccuaucuccuauagccuugaaauugucauuuguaauagguaaauaauauucugagugaauguaacuuuaauuuuuugcuucuuucucuauuuuuggauaaauuagcuuauuuguauuuuuucuaauauugguaaaacuguacuaugcauccuugcaaucuauuuuuguucuuuagauauuuucuuaagauaaauuucugcugguugcgguggcucacgccuguaauccuagcacuuugggaggcugaggucggcagaucacaaggucaggaguucaagaccagccuggccaauauggugaaacccugucucuacuaguacaaaaaaaauuagcugggcgugguggcgggugccuguaguagcagcuacucgggaggcugagguaggagaaucacuugaaaccgggagguggaggucgcagugagccgagaucaugccacugcacuccagccuaggugacagagcgagacuccaucucaaaaaaaaaaaaaaaaaaaaaagauaaauuuccauguggaucaaguggguauuuuguuuuuaaugaauguggucaaaauuagaggcacauauuuaccuauacucuucuacuucugagguauuugcuuuuuauaaaauugauaggcuuauuuuuuaaacaguuuuaaauuuacagaaaaauggagcgaguagaacagaguucccauauaucccuucauguaccccacacauaguuuccacuauuauuaauaucuuauaucaguaugguacauauguuaggaauaaugaacaauacugauuguauuaugauuaacugaagucuaugcauuauuucaguuuccuuaguuuuuauuuaauauccuuguucuguuccaggucaccacauuacauuuagcugucaugucuccuuaggcuccucuuaguugugacaguuccuuagacuuuccuuguuuuugaugacuuugacaguuuugagagguuacuggacagauauuguaggagauauauaaauauauuguaaguauauuggaauuugaugauuugucaugcuuggacuaaguuagugaauuuuuaggaggaagaugacaaaggcaaaaugauacuuucaucuuaucaagagcacauacugucugcaugcuuuaugacuguugauguugaccuugaccagcuggcuaaaguaguguuugucaaguuuuuccucucuacaguuaaucccccacccuccuuucugugcuauacucuacguagccuucugccuuuccaucuuugugggcugggauacagucuuagaggucauagagauaagaaggguagacacugcuagacaucgcaagugguggugguagaaggguagcgcaaacaauuuggacucauauccauuucuucacuccaaaauaaaauccacguagaucaaauauauacauaaaacccuuaaaucauagagguacuagaauaaaauauaggacaauuuucugguauaagaccugguaugagacaggccuuucuuuguaugacaagacacucacuagucauaaaagaaagaccaacaaauuuaaauugguauaaugaaagaugcccuaaaauuaaaagacaaacaagcuagauuaaaagcauuuauagcauauguuacagguaaaagcuuacuauuaauauaauaucuauuauuguaaugcauagaaaaagauccguggauacaggucauguuguuaacagcacuggguauuuucagagacugauggggaaggauggucaaaagaauuggcuuuauuuguauguuuuaaguuuuuacaaugagaguauuaauguauuaugugucuauuaaaaaauaaauuuugaucuacccauccuguugaauauuauguagaaucgaaugugguauuucugauggguauuaucuuagaagaagguuuagacaauguaaaauacauauggguauauauacguuuauauaauauguaaaaauaggcugugagaauguacuucaguggcugauaugguuaucuuggagaugguacugugagugagguaauaaagaaugacugucauguuuugcucuucauaauuguacauuauuugaagccuuugcuuuuaaauuauuuguacaguaaaaauaaaaacauaggggaaaaaaggcugaaaugggggaaaucugagcucucacauauaaagauccuauagaaccacacuaucccauacaguagccuuuaauaugugguuaaucagcacuugaaauguggcuaguucuauauugagaaguacucuaaguguauaauaaguguaaaagcuggaguuugaagacaguacaaaaauguaaaaugucauaagaauuuuuauacugaucauauguugaggugauaauauuuagauaugaacuaauuaaaauauauuaauacagauuuuacccguuuauuuuuacuuuuuauuuauuuuuuugaaauguagucucacucuauuauccaggcuggaaugcacuggcgcaaucugggcucacugcaaccucugccucucagauucaagcgauuguccugccuuagcuuccugcguagcugagauuacaggugcccgccaccacgcccagcuaauuuuuauauuuuuaguagagauggaguuuuaccauguuggacaggcuggucuugaacuccugaccucaggugauccaccugccucagcuucccaaagugcugggauuacaggcgugagccacugcaccuggccuaauuuuacuuuuuaaaauguggcuacuagaacauuuaaaauuacauuauguaguuuguguugcauuuccauugaacagcaugcuauagaaaaugggcaaaauaaaugaauaggcaauucauaggagaaauauacaugauagauauaugaaaaaugcugaguucccuaaugaucagagaaaugaaaauuuagaaaaaauuugccucucagguuggcaauacauaaaauaauuguucauaccaaauauuggcaagauuauacagaaacaaguauguuuacacaccaaugggaauauaaaaugguacuauuaauaaauuuuggaaagcaacuugauacccauuaauucuacuucuagaaguauuguccuaccuaaauacucaguauauauaugaggaugaggauguucaaaguaguaugguuuguuaggcaaaaaacuggaaaccgucuuaauguccaccaguggaagauagcuuaauuucugguauauccauauaauaaaaugcuguacaccuauuuaaaaggauaugauugauguauuauauauugcuauggaaggauaucuguaauauguguaaugaaaauaauagaauauuaauuggcuagcauaauuuuauuuggguuugaaaaauaacauguuuguuuauauaugcauaaaauaaaucuggaaaaacaaauaccaaacuguuaacugugguaaucaggacugggucuucagguucaccccuccuccccugucuguggaguccgcuuaguaaguuuuucauguuugagauuuuuguggagcaugugcuuauaaauuacauuuauuuggagaggaaagcuuaguuaagggaaauaauguuuguggaaaauugcuuagaggaaauggaguauauuacugguauagguacucuaaaaugucuuuugaauuaagucagaguuagaggguugugucucuaaaccgcaucuuauugguauuaugcuaucagccuguauugagagacuuuauagguaaaguccaauuuaggcuguuugguauuaucuauuaaaauuagaauguucaugcucucuaaccugcuacuuccacuucuagaauuuaucuuuggaagcacauaucuguccacagaccuauauuuacacacauguaugaagaauguuuauuguagcauuaauuguaacauuuguuaaaaugaacaugaagggaaacauucuaggcagugguuacaguacaagcaaaagcagaguaacuaguguggucuggaaaaauagaagauuacuuauucacugugaaaaauugguaacaugaaaaaagcagaacaaugaaguaugacuucauuuguguaaaagugguauuugcuaguguauaaauaggaaauaucuggaacaaucuauucaaaacugcuaaugauuguuuucuugguaauggacuuucacuuucuauuauauauauauuuuuuaauguuuaauuuuucagguuguuuuaaggaucuuaugcuaauugacauuuguaucagcuaggcauuaacauuguacuuauuuuuguaucuauuguuaugguuccuugcauuguuguuagccuuucacuuuuuuuuuuuuuuuugagauggggucucacucuguuacucaggcuggaguacaguggcacgaucuugacucacugcaacccccaucuuacagacucaagcaguccucccuccucagccuccugaguacuugggaccacaggcacaugccaccucgccuggcugauuuuuuuuauuuuugguagagagggguuucacuguguugcccaggcuggucuugaacuccugagcucaaggugauccacuugccucggccucccaagugcuaggauuacaggcaugagccacugugccaggccagcccuucacuauuucaugugaguaaguaaucuucuauuuuuccagaccacacuaguuacucugcuuuugcagaguaaccucugccuagaauguuuuccuucacauucauucauuuuaacaaauguuuugauguguagggccuaagcugauuugaaugcaagcugaaaugcacauaucugguugagucaugggaacugauuugcaugugucuuucucuuuuauggcuugaagaggagagaaauuugugcuuagacacuugagggccuacgagaucaaggagucuguccuuagcucugcccuuuggacuguugucugagccuaaagaagagagacaaagaaagcuugcauugggaggcugaggugggaggaucacuugagcuuaggaguuugagaccagccugggcaacauagggagacugcaccucuauaagaaauuuuaaaaauuagccgggcuuggcagcgugcucuuguggucccagccgcuugaaaagcugaggugggagaaucacgugagccugggaggucgaggcugcagugcaccgugauuaugccacugcacuccagccuuggcaacauugacugucucaaaaagauuauauaucucuaaaagaaaaaaaaaugguagaagaaaaucuguaccuucucaaucgcucuuucuucugcuucuaaacuuauguaugccuuuguucauucuuacuccccuuccugaacuucauucuuagagacagaaauaucugucccagguucuaacuucguguucuagagcugucuacuacuucuuuuucuggcccuaacuuccauuagguaacuucucucccaucuccuuuuuguaaauuaaaucuuuauuucuuuuuuuugucuaaaaauaguuuuguucugucaccuaaaaacuaaagccuuauaauaacucugccucccuuucuuaaaucuuaccuuuuuuccuauguauuuuuugagaggaaaucuugcucugucgcccaggcuggagggcaguggugcgaucuuggcucccugcaaccuccaccucccagguucaagcuauucucccgccucacaggcacucaccaccaugcccggcgcauuuuuguauuuuuaauagagacaggguuucaccauguugaccgugagaccggucuccugacuucaugucaucugccugccucagccucccaaagugcuuggauuauaggugugaggcaccacacccaggcucuuccccuuauuuuaaacauuuauugccuaaucuacuucaauuuggcuucuauagccaucacugugcuagaacuacacucacuccagauugccaacacuaauagcugagucuuaacuucugugacaauaccauuuucuccuugaaacucuuaacucuguaucccgauuucucguguuucugaaccucuguuucugacuauucuugucucuuuuuucuuauacaugauuucccuggauaaugucauucacccacaugauuacaacuacucccaaucccuaaugacuacgaaaucuggguuucuagauagaguguucacuauaucuuggacacuuccaucuagaugucuuuguagguggaucagauuaggugugcucaaaauugaacauuuuguuguucaucccucaaaucuaauaucuagauuccuacuuucuuagagcuucuaucuugguuaauauuacugcucuacagucacccaagauagaaacccaucugugaugcuccucuuucaucuuccacauuuagcugaccagaaaauccugucuauucuaccuuugaaauaccucuucuccauugcucaaguucaaguucucaccaccuggacuaugccagucacuucauaauugguguguuugucucaagacucaaaauccaguuuguuccuauacugcuugucagaguugucuuccucuccucuuaaaagaccagucuucuuauauauuuuuuuauauguacuuucccuggauaauguaauucacugacauuacaaguauucccaaucucugauaacuaccaaaugugggucucuaacuagaacauauacuauauguguguguguguguguguuuuuuuuccuuuuuugagaacacaggaucuauaaugacacaacuuauagaccaaaugcugaacaaaagagacacaacgggcuacauaauuccauucauaugaaguaccuuagcagacagaacgaaucuaugguauuagaaguugggaucauguuucccuggugggacagaggcuggaagggagcaugaggggacuuuggggacugcgacgauuuugacuuucuucaucuugaugcuggguaaacaaguacauucaacuuuuuuuuuuuuuugagauggaguuucguucugucacccaggcuggagugcagugacgugaucucaguucgcuguaaccuccaccccccggguucaagcgauucuccugccucagccucccaaguagcugggacuacaagcgugugccaccaugccuggcuaauuuuuguauuuuuaguagagaugggguuauaccaucuuggccaggguggucucaaacuccugaccucagguaaucugccgccucggccucccaaaguguugggauuucaggcgugagccaccgcgcccugccaaguacauucaacuuuauacuguguuuuaaauacuggcucuccaugacuugcacagcaauguccaaaaucaauagcaugacuuacuguuugucuuaaauugugugaucuugguuacuuaaucucuuuggcuucuacuuguuuuuuuuuacauuauuuuauuuuagagacacugucucacuuuguuacccaagcuggagugcagugacauaaucauagcucauuguaaccuugaacucccgggcucaaaugauccuuucaccuccugaguagcuacuuccugaguagcuagaacuacaggugugugccaccaugcccaacuaaguuuuuaauuuuuuguagagaaagagucucccuguguugcccaggcuagucuugagcuccuaggcucaagugauccucccacuguggccucccaaagugcugggauugcaggcaugagccgugaaccacaccugaccuauuuaguuguuucugaaaugaagaggauggaauucaguguguugucauuuaucuuuaagaaaaaaucaggugaaaucuuacagagaagcuucaauauauaaaacacaaaaacagagcuagucucacugaaguugguaucccuuccaaccuucccucuuuccucccuaccccaccucuguuguaccuccuugaaacuuuuagaacuccaaggagcguaauuugaagacuacuggguuucuaaagguuuaacucuuuuuuuuuuuuuuuuugagacggcgucucacucugucgcucaggcuggagugcaguggcgcaaucucaggucacugcaaccuucgccuuccaaguucaagugacccucccaccucagcuuccugaguagcugggacuacaggcaugcaccgccacacccggcuaauuuuuguguuuuuuguagagauggaguuuccuuguguagcccaggacucaaaugaucugccugccuuggccuccuaaagugcugggauuacaggugugagcuaccacaccuggccucuuguaccucuuaagaugaagugacuucuuugaaauuacaucacucucaaaucgcacaguuuuugaauacgaguaggagugguuuugguguuacacuggcucuugugcuuuccuucuuuuaacuaguccuucucucaggcucagaaacuuccuuucuuuauaacagagccuaucugcacacuauacaaugucauucacuccaaggacacuuggaguucacucaguuugccaccgaccucauguuagauaauucuuacacaaauauuaccuccuugauuacauguaccuuacuuugauuuaccucucaaguaguguucguucuguucucuggguucucuuggcauuccccaaaucccuuuauuauuuauuauuauuuuuguagaguuggggucuugcuguguugccugggcuggucuugaacuucuggccucaucaauccuccugccuuagucucuugaguuguugggauuacaggugugagccacugcaccuggccaagucccuuuauuauaaugaccauucauguuugaugaauaaaugaaugguagaaugaaagaaugaaugaaugcauagguggagaauauauguauucuguaaauuucaucuuacugcagaaacuauaaaguagcagguaauuuugcuccagcucuucucaugucgaugaaaagaaccaaacucucuaaaauauaugaagagauuuauucugagccaaauaugagugaccauggcccaugacacagccuucaggagguccugagaacaugugcccaagguggucagggugcagcuugguuuuauacauuuuagggagacaagagacuucaaucaaauacauuuaagaaauacauugguuccauccagaaaggugggacaacucgaaggggagggugggauuccaguuuauagguagauuuaaaaauuuucugguugacaauagcuugaguuuaucuaaagaccugggaucaauagaaaggaaaagacuggguuauguugauaagagguuauaaacacuaaaguuuuaucaugcagaugaagccucuggguggcaggcuucugagaggauagauguaaaugcuucuuaucagacuaagucuguguugauguuaaggccagugaggguuuaaugaguaugucugaaccccacuucccaucacggccugaaccagccucagguuaaauuuuaacagugcccuggaugagaaggaaguccauucagaagguuggggggccuuagaauuuuauuuuugguuuacauucauagagaacugaccuugaucuccuugggaacuaaaugagacaggaacacuuuucucaacugaucagcaaguauaguuuggaaguuggcuguguguaccuagcacaugcugggaguggcagagacacuagagaaaguuuuauaaaauauaccugcaggaagcugggcauaguggugcacacuuguaguccuagcuauucgagaggcugaggcagcaggaggaucucuugagaucaggaguuugagucuagccuggguaauguagcaagaccaugucucuagaaaaaaaaaaaaaaaaaaaagccaggcgugguggcucacgccuguaaucccagcacucugggaggcugagguaggcagaucacaaggucaggaguucaagaccagccuggccaacauggugaaaccccgucuuuacuaaaaauacaaaaaauuagcugggcaugguggugcgcgccuguaaucccagcuacuugggaggcugaggcaggagaaucacuugaacccaggaggcugagguugcagugagccgagaucaugccacugcacuccagccugggugauagagcgagacucugucuuaaaaaaaaaaauuacauauauauauauauauauauauauauauauauauauauuuuguguauacacacacacacacacacacacauacauacauauagacacacacgccugcaggaacaugaugauugaugauugugcuuuugaaugucagaccauucgucaaauuuauuuaaucaaaaugauucaaaauauugaaucaugaaguaauuaaaaaaccugagccgccuuccucacucucgauaaaaaaccuucagaagucaaugggaaauaaaccuuucuuuaaaaguauacucaaaaaaaaaaaaagaaaagccaaguuacaggagagccauguugcacaacucugauuucugcaggguuuaauggaaguagguuggagccuguucugcuuccugcugguuuccuuucuguauauucaguucaucguugccucucccugcuugcuuuauucacaucuuuuuugguaucucaaccauauuauuuacccaauucauuuguucagcaaauguuuaucgaguguuuucuuuggaagaucugguuuagaaaccaggcauauggagguaaauaaaaauggucucuccccaggacaugugaaacaggcaaucaugaaauuaaaauagugugauaaaugagguuauugugguguaaacaaguguauggacacacauaggagauagugacuaacuaccugggaggauagaagucuuucaaagacaagaugacauuugaauugggaaucaaagaaggagaagaaagugugaugaccaugacaaagggagcaccucuuuaugaaggaguagaggagagaacaaaaguuacuguuucaaaaaagauugguauacuuaggacauauggaaauggaaaguaccuggaguaugugauacagugagauacugaagagggccguauuucauacuaagaaguuuggacuuuaacuuguaaucaguggaagauuuucuaagcaggaaaggggcauuaaugagugcuuuaagaaaaaacuaguagcuguguggaagggucucaagccaauaacauuuauuuagguucuauucauaauguacaguuaguaaauaucccaggugauaugagugggcaaguugggaaacuuuuuuuuuuuuuuuuuuuuugagacagagucucgcucuguggcccaggcuggagugcaguggcuccaucucggcucacugcaagcuccgccuccuggguucaugccauucuccugcuucagccucccaaguagcugggacuacaggugcccgccaccaugccuggcuaauuuuuuuguauuuuuaguagagacgggguuccaccauguuagccaggauggucucgaucuccugaccucgugauccaccugccucggccucccaaagugcugggauuacaggcuugagccaccaugcccggccaagggaaacuuuuaagaacagagcacugggcugggcgugguugcucacgccuguaaucccagcacuuugggaggcgggcagaucaccugaggucaggaguuugagaccagccuggccaacauggcgaaaccccgucccuacuaaaaauacaaaaauuagcugggcaugguggcaggcaccuuaaucccagcuacucgggaggcugaggcaugagaaucacuugaaccagggaggcggagguugcagugagccaagauggcgcacugcacuccagccugggggauagagugagacucugucucaaaaacaaacaaacagcccuggaaggcugggugcaguggcuuucgcuuguaaucccagcacuuugggaggccaaggugggagguucacuugagcccaggaguuggagaccagccugggaaauguagugaggccgcaucucuacaaaaaaauuuaaaaauuagcugagcauggugguacacgccuguaguccuagcuccucaggaggcugaggugggcggauugcucaagcccagguggcagagguugcagugagcugagaucaugucucugcauuccagccugcguggcagggugauacuuugucuuaaaaaaccagagcacuggacauguacaucagagauguaguuucugggaccuuugcuacuaacuugugaucuuuuacaaguuucuuaguuuucccaccuugaaaauugaggguuuuggacuaaaugauaauuguaauuauuauuuuuuuaacauaaacucaagauuuuauugucuuuauaauaaaagaaaagaugacacuuagaacugggucacuuggcccuuucucuuaucucuucccaguucaaaaugcuugcaucuuuuuuuuuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccuuguuagccaggauggucucgaucuccugaccucgugauccgcccgccucggccucccaaagugcugggauuacaggcgugagccaccgcgcccggccaaugcuugcaucuuuuaauagccaacauucucuuagaucugcaguugggcucaacgcacucaagccuuagcacaaucuucuuuguaguuuuagccuuuuucuggaaaaucagcuuaguuugcccaccauaaccacucugcuuccuguauaacaccacuuucccugggcauacagagaauucuugcccuucuuguacugugucacuuugcaggguuggugcuugccacacuucuuacagaaaguccugcggguuuuaggaauguucaccauguuugcaugagcgcuauuggcacggaaaguaauuguaauucuuucuguaacugugcuucuuaacaaacaaaaacuuuaaccuuggcugggccaagggguuugggguuuggccaagauggugaaaccccaucucuacuaaaaauacaaaaaucaggcugggcacaguggcugaugccuguaaucgcaacacuuugggaagccgaggcgggcggaucacgugaggucaggaguucaaaaccagccuggccaacauggcgaaaccuccucucuacuaauaauacaaaaauuagcugggcgcggugcugggcaccuguaaucccagcuacuugggaggcugaggcaggaaaauugcuugaaccugggaggcggagguugcagugagcugagaucgcacaauugcacuccagccugggugacagagggagacuccaucucaaaaaaaagaaaaaaaaaaauuagccaggugugguggcgugcgcuuguaguccccgcuacuuaagaggcugaggcaggagaaucacuugaacccaggaaguggagguugcagugagccgagauugugccacugcacuccagucugagugacagaaugagacucugucucaaaaaacaaaacaaaaaaaccccuaaaccuuaauuaagcgacuuuucacuuauaauggcugugacuuuuucugagucuuacugaccguuuguaaaagcaggauuuccugcuuuuguucuagcauuucuacuuuuuucugucuuagugugaguauauuuucuacauugucuaaaguacguuuggcaauuacuccaaauggcaacugaauuauauuaaauugaagcaguguucuuugccuuaugccuacuauuuacccaauauauuuucuugguuucuacaaagggaacaaugccaguucugcauuaauuuuuaaugagcaggaaaaucauaugaacauucuaaaaaccauacauaacuaacaguauucaaaauacaugaugacugcaaauuugccaaaauugccugucacuacauuucauccccugugaagaguagaaagggguguuuguuggaugcugacuucaguugcacuugccugaaacaggcgccagucauguaccuggggagaugcugguuacccuuuucuuccuuucagagaguuauaccaagagauaagaaacaauuagcacucccuaauuuauguaugugauugaugcuguccaguguguugggagucaucucuggcuuguuuuucuucuccuggacaaaugugcuaacaguaaguucuccugcuguuuguaggaaccugugacgcauuaucuccauuuaagagaggaagaggcagauaaagcccaugggaaguucaugggcuuaagaauuagacaggcuugggauugcauucuggcuucaugacauacugaauuugggcaaguaauuuaaccucuucaguuucuucugugaaaugaguacaguaucaucugccuuguggggauauugugagaggaguauccauauuaucaaaggugccuagcaguaucuggcaccugguagauaagucuacaagcuugucagugucugaagcuccuucugcagaaccugaaacauuggauucucaaugaauacucagcaugacacaguacaucuacugugaucaacagaaguguauugaauuaaugguaaacaguaaauguuaauuuauuaauugcuuuuugaaaaauguaaaacaaaguuuuugguaucuguugcauuuucaaaauuucaauuauaauuguuaaguacuacucugcaaauagacuaguagaauuguuaagcauuagguaauuauuccacaguggggcagagagaauagaaauguaauagauaugaaaugauauguuuuaaaagcuuauugguuccaacaaaauauacucccauauuuagauguuaccacaguuaaucagauguuacauacaauauaaauguuacauauaauaugguaccuaugugcauggguggcuaaauuccacauaccagaugauaaagauucuguaauacuaguaccuucagcuuuacccaagggauuugcccuuauugccaguaauauuauuaauauuuaguucauucucagguuuuauuucagaauuaugccugugauuacugagcaucuacuauuuggcauucuuuuuuuuuuucccaagccaaacuguauccagcuuuauuaaagauacuuuccguaaacaaucaugguauuucaggcaggacaugggcagacaaucauugaguauacaacaauuuuccuuuuuuuuugagacggaguuuugcccuuguugcccaugcuggagugcaauggccugaucuuggcucacugcaaccuccaccuccuggguucaagcgauucuccugccgcagccacccaaguagcugggauuacaggcaugugccccacgccuggcuaauuuuguauuuuuaguagagaugggguuucaccauguuggucaggcuggucuugaacuccugacuucaggugaucugccugccuuggccucccaaagugcugggauuacaggcaugaaccacugcgccuggccacaacaacuuucaaacucccuucuugaaagccacucuaaaacccaaugaagucuucaucugaugcugugaacagggaaaguuuagagugaggguugacauuucacauuuagcauauuguuuaacaacuuuucccagccgacccugacuuucaggaagugaaaugaaaauggcagaauuuaucugaagaaccacugcucuuuugacaggugccgucucaguggcaucacuggaaaguccagauugccugacacacugguaacuaaugauuggggggucaggucucaacagaugucuggguuuaagggaguuaagucucugcugaaggacggaaagggagaagaggacauaaaaacaaauuuguuuuccauaccacaaggcuuuugugccaagguggccauguguguuaaagucagggaaucccuccuccugggagccaagaggaacucucucaaaacuagaagggaaagguguuuccuccacauuaguccagcuucggagacauucuauuagugacauauggcccuucccccaaaaacaacaaugaaguguucugugugcuaacaacauagcuuaaaaaaaaaaaaaguaggcugggcacaguggcucaugccuguaaucccagcacuuugggaggcugaggcagguggaucaccugaggucaggaguucaagaccagccuggcuaacauagugaaaccccauuucuacuaaaaauacaaaaaauuagccgggcgugaugaugcgcaacuguaaucccagcuacuugggaagcugaggcaggagaauugcuugaaccugggaggcggagguugcagucagccaagaucgcgccauugcauuccagcuugagcaacaagagcgaaacucugccuuaaaaaaaaaaaaaaaaaaaaguggccgggugcaguggcucaugccuauaaucucagcacuuugggaggcugaggcagguggaucaccugaggucaggaguucgagacaagccugaccaacauggugaaacgccaucucugcuaaaaauacaaaaauuagccaggugugguggcgccugccuguaaucccagcuacucaggaggcugaggcaggagaaucgcgugaacccacgagguggagguugcagugagccaagaucacgccacugcacuccagccugggcgauagagcgagaauucaucuaaaaaaaaaaaaaaguaaaaugaaauucugcauuuuuuauaaaacuugauaaaaaauaguauuucaaacuacugucaccagaaguacacaguuauaaaaaauacacacacuucacuuggcaucuccagcacuuucagcuuucugugccccgucuguuuuagcaucuccauuuucugcaagguuauuccccuccuugccagcauaagcuuuucccuuuuucccuuuggguaccuucucucccuucuuugcaggggccuuuucaggcuugggcucuggcguuggaggagcagguuuagcagacaaccucaugggucuucucugugguucguucuucaccuuggcuuuaucuccuuuagcauccccuucacccuuucucuugggcauggugguggcaacgguggcaggagguaagcacuuggcacaggaugcaguggcaugcaggcuuuggucaguccgggguucguucucgcgucuucuucuucacguugcucucuauuuggcauucuuuuguauucacagaauacgugaugacgaacaaaugguucuagacagaugauuuguaaguuuuagaccuagaucccaacugauuaaggccuuguguccaugggaucccauuccucguugguuuuucuguuguuagagccaucuuuauaauucacaugcuauuaugcagaguuagaaaaugcauuauuugcaauaguggguuuucucccauguuuuaaaauggucucagccacagaaaacuaaugaauaagggcccuugcuacugcauaucuguuaaguagauaguuuguuuuuagccauguagcuuauuuuggguuaacauuacuuaugauuuaaaauugaagaaguaaaaauguuauauuuguuugcaguauuucuguauuugaggaaguugcagucauaacuugauugaugggacuuccuucuguguucauuuuuuaagcuagcuauaaaauggugagaaacguugaccacgauguauguacuacuuaaugccuucuuuguuuaaaauggcugugcaaauauuuuucuuaggcuucuaaaaauauuaauauuuaaaugauuuggguaaauagaugagauacggcaugaucuuuuaauauaguaguguuuuccugcaauauuaugauccaugguuuuaauuacuaagugcauugcuauaaauuugcuaggccuucacuuccuaacugguccuacucucaaaauucauggaacgggcaggacacaguggccuguaaucccagcacuuuggguggcugagggaagcaaaucacuugagcucaggaguucaagacuagccuggccaacaugguaaaaccucgucucuacuaaaacaaacaaacaaacaaacaaaaauuagccgggcauggugaugugcgccuguagacccagcuacucaggaggcugaggcuggagaaucgcuugaacccgggaggugagguugcagugagccaagacugcgccacugcacuccagccugggcgacagagcgagacuccgucucaagaaaacaaaacaaacaaaaaaaaaaacagacccacaaaaagauucauggaacaauuuuugaauuuauugacagcugaauaaugaauucaggguucaaaaugauacugcacucuccuuuucugguuguuugcaaaauagcagccauuuguugaacacccuauguggcaggcaguuuacuggauuauguuuaacacuuuaaaaaauacuucugcaaaguauuuuuuauagaugaguaaucugagucucaaaaaagguuaaauaacuuuuccauggucacagcugggagaauagcagagcuggguuugaacccagagcugugaauuuccaaagucccuucucuuagagugcuugcccagcacauuuaguuauguuauauauguauuuuaauaauuuuguguguuuuaauaauuacuuuuagacuauuuuauaaaccccuugagcucauuuaaacagcugcgcuacauuuauuuugaauauuuuucuuguuugggaguuuuuaaaaaaugauacuaugggcugggugcaguggcuaacgccuguaaucucagcacuuugggaggcugacgugggcaggucacuugaggccaggaauuugagaccauucuggucaacauggcaaaacccugucccuacuaaaaacacaaaaauuagccaggugugguggagcauuccuguagucccagcuacucagguggccaagguaugagaauugcuugaacccaggaggcagagguugcagugagcugagauugcaccacugcacuccagccugggugacagagugagacucuauuuaaaaaaaaaaaaaaguauggauuuccauguuauucuuauauacuuaauuuauacaguugauuuauuuuuuucucuuccaaauuaauuucuacaagaauguugguucaugccaaggguuucuuuauucaguaucuacuauuaaauaugugacuguuuuucuguauuaaggcagcacgauuacccaacaaaaucucuuacccuuccucaaauguaaauucugccuguucagcagcagcagaagcucugcauuguuuucuguuggaagugugagcugaaggggacagacauuccuacugcuuagcgggugcacuaaacugugauuugcccuuguuguauuaucaacggcacaauauuuuuauguugcagauggcugagagcuagcaaggaaaacucaggaccaugauggcucaguuucccacagcuaugaaugguaagcagcuuugugcuuguggcaagaugagguuauggauuuuuuuuuuuuuugguagagguuuaaaauauucauguagauaauuuuccuuaaguguauaaauacaaaacuugaaguauucuuggaaaauauuuuggaacacugcauaugucuucuguaagaauauuauguuguaaaucccaugacuauauucuggaacguguguuugccauugagcaguuaggaauaaccaaaagguauauuguguuugaugcauaaaacuggaugacaaauagcagagugcuauaaggugacuauuaaagguauuuugauaacauaacaugauuguaaaccgaugaagccaauaaagauuaauuuaguaauauuuauguaagauuauguuuucccuuuagauaagauuauguaugccugcauacauaauuguuuaauaucaaacauuuuaaaagaaagugcuggccgggugugguggcucaugccuguaauuacagcacuuugugaggcugaggagggagaucacuugaggucaggaguucgagaccagccuggucaacauggugaaacccaaucucuacuaaaaauacaaaaacuagccgaguguggucaugggcaccuguaaucccagcugcuugggagguugaggcaggagaaucacuugaacuacccgggagguggugguugcaguguaccgagauagggccacuacacuccagccugggaaagagugagacuccauuuaaaaaaaaaagaaaaagaaaaagaaaaagaaaaugcuuagguaauuugaauaaugaaaaguuuuuaaaguuuuguucugauuguagcuuuaauucuuuucccaaauacuaauuaacuacccuuaguagguauuaaguuacuguguuugucauuuauaauuaauugaaaaacaugcauuauauuuuuaaaucgcuaaagaaaucuagauucugaauucuuaauuuuauguuaaauuguauuagcuaauuguagauaaauaucaggaaauagagaauaaacucaauaauucuuuauuauuuaaauugaaaacaguaauauuaaagagcauuuaaaaaaaggagggaagaaucaccauucuaccaucuucacaaagcaauucuguuuugauauuaccgucuaguguuaaucaguuguuuuuuaaacuuguuuucagacauaggaccaaaucauuacauuguuaauaacgaaaauacauguuguauaucuaaaguuuuaugucucaggauuuaggaaaaucuuggagaagugaauuauuuguauaaaaaguaaaaucaaauucuguguggugaggucaugugucauuuaaggauagacuugaaguaaagauuuuguuguuucguguuuuaccuuuucagaaccuauuauuuaaggauuaaugugaguauugcuccuauugggaaaauggugugggauuauaaacauugaugccacagacaauuuuuaauaauuaaauaauuuuuccauaaugagugauacauguaaguuuaaaauuagggcagugauuguaguaguaacaugcucuacucaaguuugaggauuuuuaugccccauacaaaggaauuugcauuaaacaguugaauuguaaacuucagccaacauguuaaucaguuuuauaagcaaaaugaacauaaagcaguacagucccgguccuucuuuauucugcuucuuccauuccauaaacauuuauauaucuacuuugcaguucauugcauuauauauaaaauauaacauugagaacaaauggacuauucaauaacaaaagaaugauuaugugaauaaucaucuaaaauguuggaaaaugcauuuagaagugcuauauaggcauacagauaguaauuuuuuuuaaacuucugaagaauuaauugcauauguagacugugguaccuuccuacuuagaagauugacgauaacuuagacauaucuaauuuaaguucaauucaggguuuaagauguuacugagagcagcauucauguauaguacaaaacuuugcuccucuaguaauccugacauagauuguuaaauuguuuugaugcccauugcuauugggacuugucuguaaguaugccugugugugaauguguauguguguguguauguguguguguguauguauauacguguguguguaaaaaccgagaugagacuacuuacugaaugagaucuagccuauaguagauguucuguaaaugugaaaauuuuuuucuucacugacuauaagaacuuguuugaaagagccagcaagugagaugagaauaagcaacagaaauguuuaugaaaaucccauauuuucaauaucagugaugaguuaggggaagcggauagaauuuuaauguauuucuaacacgauuauuacauauuguaaaaguuuguuagcuuuuuagggaaauauuagacaucaaccccuaaacuuagauuuuucugccucuucgauaaggcuuacagauaaauauagacuaagauugggagauuuuuacuugaaguucaaaguaacaaacuuuugccuuuucaaaggguucuguuaguugauauauuuaaauaagaaagccaggacugaauuaacuauuuuaaaauuggcuuugaauuacacguauugcccaguuuucuuauugcaguguuuuguuuuuugagacagggucuccacucuguugcccagguuggaguguagugguaugaacacagcucacugcagccucgacuugcuagauucaagcaauccuccugccucugcuuccugaguagcugggaccacaggugugagccaccacacccagcuaauuuuuagauuuuuuguagacaugggggucucacuaucuuguccaagcuggucuugaacucuugggcucaagaaguccuccaccuuagccucccaaagugcuuggauuacaggcaugagccaucacaccugaccaguguuaucuuuuuguuccuagaaaauucuuggugcauuaauacuuuauguuuuaauaugauuaauuuuuuaaaagguuauuugaacacuacuuaaaaauuauuccuuguuaaaaugccuuagaacauuuuuauucucuugguuacauuaaucaugauaauauguaaccgugauuguugugugugauuuucuuggcugguagagucucuuuaaaauauuagagucugugaguucuuuuaagguguucauuuuuuuuuuuuuuuuuuuuuuuuuugagacagggucuuacucugucaacccagccuggaguacaguggcaugaacauugcucacugcaaucucaaccuccaggcucaagcaauuccuucugccucagccuccagaguaacugggacuacagacaugugccaccaagaccagcuacuuaaaagaauuuuuuuuuuagagauaggggucucacuauguugaccaggcuggucucaacuccugggcucaagugauccuccugcccuagccuucugaagugcugggcugugcccaggcaagugguucauuuuauucaucuuuguaccccauaaacauuuacugaaugaaugaauaugaaggugucaagauuacugauuggagacaugaggaacuaagcaguaaacaaacagauggguugaguuuagccccugugaaaacacauagccaaggaaaugucaggagauaguaauauauauaagaaagcaucauacugugaugagcauuggugcaucaaucuugaugcagcagaacucucuuuugucuuaggauagcaguagaguccaucacugcccggggguauauauacccauguauguuagagcagcuuuuuaaaaaaaauuuaauuuaauuuaauuuaauuuaauuuuuuugagacggagucucgcucugucucccaggcuggagugcaguggcaugaucucugcucacugcaagcuccgccuacuggguucacgccguucuccugccucagccucccgaguagcugggacuacaggcgcucaccaccacgccuagcuaaguuuuuguauuuuuaguagagaugggguuucaccacguuagccaggauggucuccaucuccugaccucgugauccacccgccuuggccucccaaagugcugggauuacaggugugagccaccaugccuggccgagcagcuuuuaagccuucuuaaccaaacucuucagacuuaaaauagucuuaagguuucuaacuaaagagccuuaguuucaggcuauucccugagaaagauuugaaugcucugacuucuuuuuaauuauauuguucccugggauuggguugaauaaggaaacuaauuuauugaggacuccuaauauggcaggcauguauuagaugcuuuauauuuuuguuuuaguuuauuuuaaaguuggguuuauuggggguauaauucacccuuuuaaaguauacgguucgaugaguuucuaaaacuauauauagucauauaaauuaggauauaaaacauuugcaucaccuaaaaaguucucuguacccuuauaccuccaccuuuagccauguauuauuggcaaccacuaaucagauuucuguccuuacaguucugccuuuuccagaaugucauauaaauggaauacacaauauguagccuuuggugucuggcuucugugacuuagcaaaauaucuuugugauucagucauaauguugcaugcauuucuccuguuuacugcugaauaguaguccauuguauaaauguguaccacaauuuauuuauccauucagccguucaggugcagaacauuuggguuauuuccagguuuuagugauuaugacuaaaucugcuauaaccaucagagaacagguuuuuauguggaaauaggucuucguuucucuuggguauuuacccaagagucuuuuguuaauacucagucuauuguugggucauguggaaauauauauuuaacuucauaagaaauucccaaacuguuuuccaaagugacugucacauuugcuuucccaccagcauauaugaguugcgguuguuuggcaucuuuaucagcacuccguguuguuuuuuuuuuuaauuuucagacaugcuaauagacaugcagugauaccuuuuugugauuuuaauuuacauuucccugaugauagugauauugagcaucuugucacgugcuuauuugccaucuguauaucuuugaugugucuguucaaaucuuuuguuccuuuuuuuugaggggggggauuauuuucuaauuuuugaguugaauaguucuguauauaugcugaccuauauuuauugaauauguuuugcaaauguuuucucucagccuguaguuugucuuuuccuuuucuuaagaguguccuuuaagagaguggaaauuuuagauuuuuauaaaguccaguuugucaaaauauuuuaaugauuuuugccuuuuguguuccaaaaagucauugcauaauccaaaaucacaaacauuuucuuccauauuuucuucaggaaguuuuaucuuauaucuaguucugugauucauugagaguuaauucauguauaugcuggaagguugagguucuuuuguuguuuuuucauauggauauccaguucuuucagcaccauuugaugaaaggacuguuuuccaccuugaauuaucuccacauguuguuggaaaucaauggacaauauauuugugaguguauuuauguuuaauuaccaacaagacagauaguuuaagacucuuaauuaagccugaguagacgcuagucuugccuucaacacuuaccaauuuuauuaccuugggcaaauuauuuaauaucucuguaccacuguuuccuucucugauaaacagugauagcaauaguuaccucaugggauucuuaugagacuuacuugaagcaauacauguaaagcucuuagaaaaguaccugacacagggugaguuucauuaaguguuagcuauaauggagguauauuacauguaaucuuuacaacaggccuguggaguuauauaauauuccuaguuuauagagguggcaucugaauuagaaggaacaugagcaucuuacccauauauguugguacauaguuagugcugaguucaauauggaggcuuuggagucaggcuacccagguucuaaucucagcucugucacuuacuguaugaccuugagcaaguuacuuuauuaccauggguuuucaguuuccuuaccuauaaaaugagaauaauaauaguacuuuaauuuauagguuaaugcugggggcucagugaguugcugcauauaaagucccugacaauagucaggguucaauaaaggugagcugcuuccaucuuugucauccuuuguuguugucauuuuuguuguuuuuaaaaucagcaucauaauuuuucugaagucauauaauagaaaaucaguucuguggcuauacuacuugccuuccuagugacaggaauccugacagguuuauuuauuuauuuucugauaaacugauaacccaaguaggauuuuuacuacauaugugguauuucuuuauuuagaaaguguguagguuuagcuauuuuagguccuuaguucuucaguacaucuguuucuuuauuuuuaacuauaaucuuaaaacuucucuuuaagagaggauauuuauagauuuuuuaauccagucauuuaggacuaagaauaauuuguuaaauccauauuaguguuaaaaauuacagugagcaccuacuuuucaaugauauacguuccuggaaaauugucuuuguaaggcagauuuuuauacaauacaagcaggaauuauguaugaguuuauauaccuaaacguauuugauuccuuauuggcagaaauggaauaaauuguaaagguagucagaaguauagauggugauuagucauguugaaugugcagagcuuuacaaaaaccucagagagcuggcggacaacaaaaagcuaaucccaagcucgggaagaaaccccuguauuugcaaugcagacauccucagagauagucuggaacaaaagcuaucaauccuuugcuuuagaagauguacagaaacaugagaaacucauggagaauugucucccaaggguuccucucccuuguuucuccauugucuugacuucuagcaaauuuucucaugaguguacauaccacuaaguuggccacuccgauuaaucugacaaaacgggcugggacuaagucugauuuauuuuaugcagcauuugauuaagacuaaucaacaggacuccaagcagcagguuggucucagcuugcaguguucucagcugugcucugcagggucccagcuaaacaaauccuauaaaucaucagugucucccuuagaaagccagguggcuuucuccuuaaaaaacaauguuuuuuuguuuuuuuuuuuuuuggugguuguuguuguuguuuguuuuuuguugagacagggucuuguucuguaacccagacaguggugugaucagugcucccugcagccuugaucuccugggcucaagcaauccuucuaccucagccucccaaguagcugggauuacaggugugagccaccaccacuggcuaauuuuuuuuuuuuuuuuuuuuuuuuuuuuuuuuuuuuuuuugagacggagucucgcucugucgcccaggccggacugcggacugcaguggcgcaaucucggcucacugcaagcuccgcuuccuggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccuccucggccucccaaagugcugggauuacaggcgugagccaccgcgcccagccuggcuaauuuuuuuaaguuuuuuuguagagauggggucucacuauguugcccaggcuggucucaaacuccugagcucaagggauccuccugccucagccucccaaaauacugggauuaggugugcaccaccauguccggccucuccuuaaguuuuauuuuaacuuuucuaccuggccugaaucaguaaucuggguacagcagaguguauucauaauugcacacacuuuaucuuagccugcaaaaaaagaaaaucuaggauaaaucucugacaacccuagccagugaguugaggcugaccugaaugccuuccaggacugaggaaguguuuuuuuaaacacuugaagaucucuucauguacauuacuguguuuuuggagggaggcaaguuaaugcaugguuuccacagaagaaguagaagaucaagggugugcauggguuaugcuuggaaagaaaauguuuacaguuauucccccugcaaccccuacugccgugggaccuacaucagaagaggggcacagguugauagugccucuaacauagccuccuggaugacuggcaagucugaggguuuccaguggaguuugaguaauugagucuaguccuuguuuuuggagggauugcccaaauuagucccacuuguuuuguuuguccucgccaccagcuggguggaauucauccauuacugagauugggggugggggaagaccucuggaagugauauggacaggagauacauuuucuggggucauuccugauguuccugauagacucuugauaaggcuccugaugggggauggcagacucauaaggugcuuccaacaauuuaggagagccauaccaaggcauuuuucuugcagaagaaggcuacaggggcaguucuacaagagaaaauaucauuaauuccucucuuaauaccauaccuccuggggucuaaggcguuucuuccucaggugccuucuuguugcucuacugccauuaaaccuggguuucucauuucagagccauaacuuuaccauuuccuagugauccagaagaguuagauguaagagggacauuuucauaaacccuaaccagaauuaacuuugaauccucuagaucacugguccccaaccuuuuuggcaccagggaccaguuucauggaagacaauuuuuccacagauuugugguaggguggugggaggggguugguuuuaggaugaaacugcuccacugcagaucaucaggcauuagauucucauaaggagcaugcaacccagaucccucacacacacaguucacaauaggguuugugcuccuaugagaaucuaaugcugccacugaucugacaggaggugccgcucaggugguagugcucacuugcccaccgcucaccuucugugcggccagguuccuaacaggccacagaccagugccaguccguggccuggggguugggaauuccugcucuagauccccuuuuaccucaguggcccagcuggaggguuuaugaaccaagccugccuacaguugcuguuaggggcuagaaagaugcaucauguccaggaguggucagaguagaauccugaauuuucacaauaggucuguauaucuccugugauaccccacccuuuagcccugaucauuagggaggaagcagcuaauaagcaaugaauccuuucuggagacagcuacagucagugaccacacuaucuuacuuuaaaguauguggaccaggaggaggugauggaaauagagucaggcugucagugcauuguugaauggcuuuuaugauaaaagugcauccaugucagaaugcauaugguccagaaaaccaaaaacaugacacagauuaugggaggucaaggcaggaggaucacuugagcccaggaguucgagaccagccuuggcagcauagugagaccccgucucuacaaaaaauacaaaaauuagccagcuguagucgcacguaccuguagucccagcuacucaggcggcugaggugggagaaucacuugagccugggaugucaaggcugcagugagccaagggucacucuguacuccagccugggcaacagagugagacccugucucuaaauuuuuuaaaaaagaaacaugacacagauuaguuucaagggccaugacagugugggcaucgugggcugauugguaaccuaaaaaagugucaacaggggaauguuuuaaugggagggacuaugugucagugggguggaagguauaggagaaauguuuguaccuucugcucaaucuugccgugaaccuaaaacugcucuaaaaagucuaugugaaaaacaaaaaaauacugucaauaguuugaggcaccacugauagccugagagagggaacaaagguccaauauagucagucugccaggagucaaagggaacaaugccaccugcaaugagaccucccccaccauccccaagucacaguuuggcaugcagugguauccucugcacauuagucauacuugauuucagucuaaaucagaggcugggcccauacuguaggugucuacauaggugacacagacaauucaauuagcaguugagauuuguuuucaauuuguagccccaggagggugucuuuaaucugucaaucuguaauuuuccaaguggcaaaccaaacagcugggucauuggcagcagcccaagaauccagguucugcccaugucuccuuucaguucagcauagcugccucugaggcugaauagccacugcagcccagugaacaccagcaacuugcagcuucucugaucugagccuucauugauccaguagcuuuacuauaagcaguggaaugugcauaaagguuucccucagagggauaguugccgcuuuuuuuuuuuuuuugagauugcgucuugcccuugucggcgcaggcuggagugcuauggcgugaucucagcucacugcaaccuccaccucccggguucaaaugauccucuugccucagccuccugaguagcugggacuacaggcacccaccaucacacccagcuaauuuguuuuguauuuuuaguagagaugagguuucgccauguugaccagguuggucuugaacuccugaccucaggugauccgcccgccucggccucccaaagugcugggauuacaggcgugagccaccgcgcccggccacugccacuuuuuaacguaaagccaaaauacuguuggggccagugucuauaucuucuuugauauaccauuucuauuugacaaacaaggcuuuucagguuauucccaccuuguggaauucaaguugacccuccccaaaaugggacuaucaggcuagagaaucacuaggccuucgugggucaagcuuucugaucccaaggauuaucucuaggugaaggcuacuuccuuuugcuagaggcuccgaugggcagaaucaucagucacagugccuugugcugucuucacuacccagaguuuaauucuguuggaguuuaccagccaccacugcagguggagguauuaauuuagccaguaguuauauaccagacuguuaaugucuuuguuuugacaaauguacuaugguugugucaguuguuaacauaguagaaauugggugaaagguauauaggagccauguacuaucuuugugaauuuucuguaaaucuaaaauuauuccaaauuaaaagcuuauuuaaaaacugucugggcgugguggcuuacgccuguaaucccagcacuuugggaggccgagguggguggaucaugaggucaggagaucaagaccauccuggccaacauggugaaacccugucucuacuaauaauacaaaaauuagccgggugugugguggcgcaugccuguagucccagcuacuugggaggcugaggcaggagaauugcuugaacccaggaggcggaggcugcagugagccgagaucacucugcugcucuccagccuggugacagagcaagacuuugucucaaaauaaauaaauaaauaaauaauaaaauaauaaaaacuacuagauggcucucuauaacuuccaggguauggggucaggcucuugaggaugguauuuaagaccuuuuuacaguuaauuccacccuaccuguuuauuauuacuaacucuaguuauuagucugcucagugcacuuaacagcaccuugcacaugccuugacuucucaugcugugcccuuauggugugaaauguucuuaucccuccucuucacguggcaaaauucaaaccaagcuucaaggcucugccucaguguuaccuuuccuguuaucucauccuuggugcuucuaacucagaauuggcacagcuguuuugguaucuguauuagucuguuuucacacugcuauaaagaacuagcugagacugaguaauuuaugaaaaaaaggguuuaauugacucacaguuccacauggcuggagaggccucaggaaacuuaagguguaaggcgaaggggaugcaaagcacaucuuaacguggcagcaggagagagagaagcagcaaggggggaagugccacacuuuaaaaccaucagcuauugugaggaacucacucauuaucacaaaaacaacaagggagaaaucaacucccaugauccagucaucucccaccaggccccuccucugacacguggggauuacaguucgaaaugagguucugguggggacacagggcuaaacuauggcaguauauaguucugcuuaggauuuuucacaggugaauacuguaaguacuguuguuuucuagagcaugaauuccuugagggugggaauauuuucuucaucuuuuuauugccaguauuuagcuugaugcccauuuccagugagugugauauagcacuuguucaauagacguuaauugagccaaugagugaaaagccuuagggcugugcuauguaugguuaugauagagcucuacucuuugugucacucaaauauuaaauacugucauacaaugaacacuugugauuucuauuuacauuuuagaauuguauuuuaagcauucucauguauacacuauaguuucuuccacuuauguuucaggagggccaaacaugugggcuauuaccucugaagaacguacuaagcaugacaggcaguuugauaaccucaaaccuucaggagguuacauaacagguuuguauuuauaauuaguuuuauuagugaauuaugguccuuaugugauaucuaagaauuaguuuuaauuugacugccaucaaauuuguguuaauaaacgauaaaauucauaucaaucagaauucuagaaauuaaagaaaugcuaacuuuauuuuuccuggaacugucuuaauuuguuguuuuaaauuugggauauggaagauuuuuccugaauccuaaaugauagucaagaauuucuguguaauugucugguuucacauuuuaacauuauaucuagaaaguuuucaguuuauuucuuagauucauuucauggaaaaucuagacuuuuuuuuucuggaaucuguuuuccuaaugcuagcccucugucuuugaggcuacaccaagcacugauuguugaugcuagcccuuguuuugcagaaagaccaccagagccaaaaugggauuaauuuaggugugccuuugaaauuuuuuucuauuaauuaaacuuuuuucugugccaaaguagcuuagugcuuuacauacaauaauaguaacuaugagaacaaugauauuuauugaauuuuuacuauauaccagaugcuaugcuaagugcauuauuuuauuuaaccuuuacaacaacccuguaaaguaggcacuguuguugucuauauuuacaaauagugaaacugagacuaagagacguuauguaacugccuaagguuacaaagaugguuaguguuaaucugggcuuugaaaccauuugggcugauuuuggaauccaucuacuuaaccauguuauuuguacugcuaugauaguaauuaccuuaccugguaucaggauuugauuacccugcuuacagguuaauaacuuuguccauuacggguggaagacccaagauuccugagucagagacaaagaaccuuaugacuaacagcauaacuagcaaaaugagcauuggcaucuaucuuucuguuuccuuuaguguucccuaagucccacagagacaaugcagagagcccaggagaauaguacacaugcuaugauuguguuacaggagaggaacacugaauuuggggaacccacccuuuuguagcaagcaguaaagcaaguuugucccuugucucagugggaaacguuaccggauucguuaagauugcucauuacaaacccaauucugagaagugacccaggcagagagcaauuagggucuuacauuauugguauacagagcaagacacauaggagugugaagaaacucauggaggacucucucuccuaacaccugguacuuuuuauauugaaacucuuuuagggaauaguguuuuuaaauauaaauuuuacuaaguggaaguauuuuuaaggaagaccccaauuguggaaaaacugagaugaaucaucuuucaucacugauuaauauacaauagaagugcagaugugacuuuuguuuuaaaauaucugucuuauuaaaguuauguaaauaauuuuuauguguuucuauuucacuuauucuuuaaugauugguauuaaaauuauaauaaaucauuaacauauacccauuauuauucagaagcauuggaauaauuucauuuacuaaugugcugcuuggguuuuguuuuuauuaccuccaggugaucaagcacguaauuuuuuccuacaaucaggucugccggccccuguuuuagcugaaauaugguaaaguguuuuguagaugaaccuaauuuucugauaguauuuuguuuuuuuguaauauaguguuaacauaaaauuguuuuuaguugcauucuauugguuauuaagaauauuucugccagcacuuugggagucugagguaggaggauugcuugaggccaggcugggcaacauagugagaacccugucucuacagaaaauuaaaaaaaaaauuagcugggugugguggccacaccucuagucccagcuacucagggaggccaagauggaaggauugcuugagcccaggaauucagugcugcagugaacuaugauugugucacugcacccuagccuggaugacagaaugagacucucuuuagaaaaaaaaaaaaaaaaaagguauuucuucaguuuuuuggaaaauaaauuuuauugagcaaauuauugaaaauaauucagguuuaguucucuaggacaaauuucuaauuucauuagaauuuucuaaggaaagauauauacauuaucauugagaaaaauuuccuuauaauuuggcagaaucucaaaauccucuuucuguuauuuuguaguuucauuuauuucauaaucuauaaaccccaaauuaguccucgcuuccccugcuccuucuuuaaagaaacuauucucuauaauaucuguuuuuuuaaaaacguuuacaauaaguaacaaccccugucccaucuuuccacuuggaauauucucaugccugguagaguacgaggcacauagcaaguauucaguaaauauuuggacagaugaauaaauuaaauuuagaaguauuauaaucuugaauuuuuuucuaccuaaacugguggaauucagcccaaaggucucuagauucuguuuugacaggcaguguuuuauuaguuauuaucucuggucaguauuucuuaaaguguagguuuuaucuuuuuguuauuauauauuuuacauguuagauauuuuaaauuuagugaugauguacacgugaaugccauaucaucauuuuuacuuugucaauccccaaaauaacguuaguuuucccaccaccacaccacauagcaaucuaccuaccucaugcuccuuuuagggcuuuaucagaccuaaacaaggaugggaagauggaucagcaagaguucuccauagcuaugaaacucaucaaacugaagcuucaaggccaacaguugccugugguucucccuccuauuaugaagcaacccccuauguuuucuccauuaauuucugcucguuuugguaaguauguauuaauuuaaauaccuguauuugcuacuuaaacuuuaucccuaggcauauuugaguauuagaaaaggauuuguuagcacaaaaugacaguccccagauuccaaguuaauuuucauguuagagauaauaaauauuaaauucacugucacagguaggggauccauguguucugguuuucuagggacaguucugauuuaugccuuuuguccuggcaucugguccaguuagugucuccuuuuacaacuccuaguugcgugaugaauuauauggucucccuagguauagccaaucccaaauacuauucuuaguuuccucucucucuauauauaugugaguaauacagaaaaaauuuugagcaguuuuaaacucacuugaaaugguucgauuugggagauaauuuaaaauuuuauguaaguugaauuuuuuuaaagguuaauuagccagcuaaauuuagggccaaaaguugcagacuuugggcuaauaaguucacguauucaucagcgauaaccgguugguauguuuucuguuaauuuugaucaggcaauuucuuauaauuauaugugagaagcacucauuuugaauggaacauucaauuagguaugucuauguaucugaaacauguuccuucacuacagaucuuagaauauagaauucuagagcugguuauaggggugugugccuguaguucuggcugcuugggaggcuauggguaggauugcuugaguccaggaguuugagguuguacugugcuaugaucgcaccugugaauagccacuucauucuagucggggcaacauagugagacccccaucucaaacaaacaacagacuccacaaaauuauuucacuauuuuagugaauucuaaagauaaauacuaaaucauugugugaccauauuuauaaguauucugcaguuaauaaaugaauaaaagucaucacuuuguuccuuuuaagaacucguccuugaauucauaggaauguuacuuacaagaaaaguaaaauaugugacacacuuucuugcaaauaaugcauaugcauaaauggaucucauaaaguaucuacuacuuagaaccuuuuuguuuggggggaguaugugagagagagagagaagaagaauguguguguguguguguguguguguauuagucaaguaacuuaguagcacuguauuauccuuucacaaaaaccucauuugaucugguaauguauucuuuccuugaggagacucauauucaauuggaaaaggcugcuuaguuuuauucaugaugagagaggagaauauuuaacucuuugcuagguguuuucuuaguucauacagaucagaguauuaguauuaagagcagcaguuuaccucccucacugcugggucaaaguagugaguuuuuuaaggauaauucaucuguguguuuugguaaacauagagucugcccacuguacuguaaacuuguuuuuugcauguguuuuauaauugauuuucuagcacuggaaaaaauguuuucuuuugacuuuaggaaugggaagcaugcccaaucuguccauuccucagccauugccuccagcugcaccuauaacaucauugucuucugcgacuucagggaccaaccuuccucccuuaaugaugcccacuccccuagugccuucuguuagcacaucaucauuaccaaauggaaccgccagucucauucagccuuuacccauuccuuauucuucuucaagugaguacuuuguuucuaaagagucauuauuucauguaaagaaagaaacuauuuguguuugaacagauacaaauuucuuucauacuuuuccuucuuuuucuuuuuuagcauugccucaugggucaucuuauagucugaugaugggaggauuuggaggugcuaguauacagaaagcgcagucucugauugauuuaggaucuaguagguaugaauagcuaacucugacaacuuuuuaugcuuucaguaagaagucuuuauuuaacaaaugauuuuuuuaaagcuuugagcuuaccuaaguuuuacuuuauaauggccaaguacaaauacuuaagguaaauuuacuacuuacaacucacauaaaauaaauuuuuuauuuuuagaauuauuaagugucuguggcauuuuacuuuugaaaaaauaauucauguaaacuaaaaauauucuauauuuuaauuuuuucuuugccuaaagcuguguacuuuuccuuuaaaaaauguguauauuucccaagaugucucauacucauuguacauuguuaauuucuuucuugagcagauucuacuaauuggauaucuuuuaaauuuuacaaagcacaaaugcaucaguauucauuacauuaaucacccuucauauaaaucacuauuauacucuucaggguaguguacggagaguguuagauuugacccagaagaacaacauucauauccuagcuugaacacucacugauucuguggccuuguuuuuucuuaacaucgcugagccauaguuuacccaucuaaaagauggggacuguaguauuuuuuaaguuuguugggaggauuagaaauauuuguaaaggccuuaguacaauauaaggucuggcacagagcagguucuuuauaugcgguagucucauggaguucuauacuucuuauggucuuugcuuuacuaagaauagugauaauugcuuaaaauuuaaaaaaauguaaaaugcaaaagcagucaccauuggccaggcacaguggcucacgccuguaaucccagcacuuugggaggcugaggugggcggauugccugagcucaggaguucgagaccagccuggggcaacauggugaaacccugucucuacuaaaaaugcgcacaaaaaaauuagccgggcgugguggcaugugacuguagucccagcuacuugagaggcugaggcaggagaauugcuugaacccgggagguggagguugcagugauccaggauugugccacugcacuccaggcuggcaacagagcgagacucugucuccuccccagaaaaagagaaaaggcagucaccauuauaguauguaacagcgauccucaaccuuuuugguaccagggacugguuucauagaagacaguuuuuucacagacuugaagcaaugguuuuaggaugaaacuguuacaucucagaucaucaggcauuagauucucaaagggagcauccaaccuaggucccucacaugugccauucacaauaggguuugcacucuuaugagaaucuaaugccacugcucacuggacaggagcuggagcucagguaguagugcucacucaccugccacucaccgagccccgcuguccagcccgguuccuaacaggucgguggcccggggguucaggaccccugguauauaagauucuuaaugccuuggucuuauaaaauuuaauuaaauauauuuuauuuaguaacauaaaaauuuuaaauaaauuuuuuuauagcucaacuuccucgacugcuucacucucagggaacucacccaagacugggaccucagagugggcaguuccucagccuacaagauuaaaauaucggcaaaaauuuaauacucuugacaaaaguaugaguggauaucucucagguaagcagcauacagugcugaagagcaugaaaaagggucuuuuauguggacuuccacugaagaacugucauuugaauuuguauuguguagcucaucugacauuuuaacauccaaaaaauuuagcaggcauuugauaaauacaaauaccugaaguuguauaaggauucaaagauggauucaacuugauugcuuucuucaaaguucuuacugucaagucgggcaccagauauacccccaacuuuuuggcaaaagaccugucccuuaagaucagaccucauccucuaagcuuugcagugaauggagagccacgggucacaagagagaguguguggaacuuagccucagcucacuuuuccugagaauccuccucugcauugggcuuuuucucuguuuauauaaccucaagugagcauugcucacccuuuaaugcucuaacccaaaugugacuguaaaacuuggccuuaguucacuguaaaacauuugaguccaggccagaacaucaucugaacuguacuaauugagaacagcaaaggagacauaaacagaggguaauaggcaaguagaguucccaccuucuaacuuucccacucccucuucacucagcaagaaauuaugauuuaggaccgaguaaaauaaguguuuaaaaauaauagagcuuuaagugcuaaggaacauagaaugagauauauugaagcugaagaguucagaugagguaucuuuuaggaagggagcauuuaagcuccaugaaaaaguuaggauuucgacagagauugaacgugggggcauuugauggugacaaaggagaaauuaagagcaaaaaauacauggccuauuuggagaaugaaaaguagucugugaaauaggaguccagggucuguaguuaugcagagaggcaagggaacgagcaguaagacuuuuggaaucgauuggacaagcaaaaauauacaguauuuuauuuaaagauacauaccuaugugauaacuauuuuuuaaagcaagggaauuaugcauacaaaauucaggauagugguuaccucuuguggaagcauggggauaagucaaggaacacggauagauucaaggcauuuaguaguaaucuaguucuuaagaugggugguagguucacgggugaccuauuauacuucuuagcuuacauauauacuuuguauuuuuacauguauuucauauuacauaacuaagauuuucuguaauuuuaucaaauugcaugaaacaagguaugcuuuuuugacacuuuuuuuuuuuuacauuuuaaugucucuaaaauuaggaugugugcuacaauuagugaugucuuagcacugugucauaguuuuauuagcagugcuuucuuucuuauucauaaaauaauaguaugucuuauagccaguggaauuuuagauucugugaaauaugguauugaaccauacuggagauuaauauaaagucauaauuccuauucuuugaaaaaauuaacuucuuuguacccuacauuuugcauuuaaaaaguuaauuuuggccaggugcgguggcucacgccuguaaucccagcacuuugggaggcuggggcagacagaucaugaggucaagagaucgagaccauccuggccaacauggugaaaccccgucucuacuaaaaauacaaaaauuagcugggcaugguggugcacaccuguagucccagcuacucuggaggcugaggcaggagaauugcuugaaccuaggaggcggagguugcagugagccgagauugcgccagugcacuccagccuggcaacagaacgagacucugucucaaaaaaaaaaaaaaaguuuaucuuugcuaggcauagcggcaugugccuauagucccaacuacuugggaggauguggcaagaggauugcuugagcccaagaguccagccugggcaacauagugagaccccaucucucuaauaaaaagaaguuauuuguuuucaacugaacaaaaguugaugaaaaagacauuuacaaaaauguucacaaccuaaauguucaucgacaggagaauagauaaaugacaguauauuuacauaacagaauacuuuaaagcgauaaaaccaaaugaacugcugauaccugcaacaacaugaaugacuuucacagguaugguauugaaugaaagcagcccaaaaggaccauaccauuuaacccauuuauaugaggcugaagaacaggaaaccuaauuaauggugauagaaaucagaauaaugugguuacuguguggggaaggggccaugugcaaaccuucugaguugcuggaaacauucugcaucuugauacagguguguaugugcauaccuguguaaaaauucauuaggcaggccgggugcaguggcucacaccuguaauuccaacauuuugggaggcugaggcgggcggaucacuugaggucaggaguuugagaccagccuggucaacauggugaaaccccaucgcuacuaaaaauauaaaaauuaaccaggcguggugguggacgccuguaauccuagcuacucuggagucugaggcaacagaauuauuugugccugggaggcagagguugcagugagcugagaucaugccacugcacuccagccugggugacagaacuagacuacgucucaaaaaagaaaaaauuauuaggcagcacacuuaagaguaguacgcuuuguauaaguacuguaacuauaacaguauaaacagaggugauuuugcauuggaauaugaagggcagugaauggggagccaacuguggggaagugaucccuaauguuacuucauuaguauaugucacauuguacgaagguuguguauuaugguguuuuuuagggaaugucauuauuauucugagaccuacaaggguaaagcuauauaucuguagguaaagacaagguuuucuauaaaaagaguaguugcugcugguguccuuaagcugagcaugagccccaagaacaugaggaugaggcuaaccuggacuuauauguuuguuuuguucaauaaguguaggaguuggugauccuuuuuuuuuuuuuuuuuuuuuuuuugagacagagucuugcucuguugcccaggcuggagugcaguggugcgaucuuggcccacugcagccucugccuccccggguuccagcgauucuccugccuccuacaggcacacgccaccacgcccagcuaauuuuucuuaguagagacagguuuugccauguuggccaggcuggucucgaacucccaaccucaggugauccgcccgccuuggucucccaaaguucugggauuacagacgugagcuaccgcgccuguccacuggucuguuuuucccuuuuuuacuucucuucuccucccccuaaacauaguuuuuaaaaauuuauuuagaucaagucauugauguaacuguuuccugaaucacauacuuucugggcacucucuuaggcacaggaauacagacaggggcaagacaugguucauaucuuugaagagcccauauaaugaagagcucauguaaucaagguguuugguuacuuguuuaaaagugcugugauuaauauagaugagaaagugacuaacuccaaggauauaagagagaauguuucacagaagaaaagagauuagagccagauuucagaggauagacuacaaaguaaagaauugagggucuggcauucuaagcagaggauauaggauauccagaggcuuggccgacuaagaguguacauacauguucaaaugaguuuuacuuaguaaguaagauacucuguuggcucucuauggcccuuuguauuacucagacuuugccucacacauauaaagcccuccacgaguaugauuuuuaaccauuuacauuccuccuccuucucucuucuguuugcucuauugccugaugcuaagggaucuucuuucaguccaaaaggaucuuuuuucgguccaaaagcugaaauaguaguuuugaacuuuuuuucagguuugaaauagccuuccaucucucuuauuuagaagaaucuuccuuuuaacacaaagaccuccucaaaucaaauuuccuaagugaaaucugaggaguaauuaauagggcgaggcugugaguuuaauuuccaguguuuuuaugugauuuauguuaaauguccagauuaaaaaaauagaaugaaaauauuuuaaaaguuauaaaauauaaacauuuagcugcauguuguaauacaugguugcuuugauuaucaaguccuauguugaaagccuagugggacaauaaaucuagcugcauuuggcuggcuuuuguuguaguuggagcuguugcugaggcaguguuggcagauguaaucucuuguguaagaguuguuuuggacaggccuugacucaggcugaacccagaguagcgccugacucuucugcuacucacggcucagucacguaggagugggaagugcugcaccugcugggaguacaagagggcccacagucuuggccucugauacucugugugccugauaucuuguucuuucacguuagccacuuguguguauuauuaucuugcugaaaagacaggggacagcacuugauacugcuaauucuagauuuaaaauuccuuggggcagugacuggguuuaauugcuacugaaugcuuagcaccuagcacgugguaaaaacauuuugauguuaaaaguucccaggauacccugguagcauuguuauuuuacagauacagcuaauuuguuaugcauaacuuuaaagaugcuaaagaauuccuuuaugauuuuccccacuuaaucagguuuucaagcuagaaaugcccuucuucagucaaaucuuucucaaacucagcuggcuacuauuugguaaguuugucccuuaauuacauuugauuaauuuaacuaugcauuaauuaauuaaacucucucuccccuauuacaagaaagauacuguuucuguaaaaguuugugacucagagaugcucuauaaaagcagccauuugaaaguuaguauuaagcuuggaggcaaauguaauugugcagaauguuguuguacccuuaagcuacaccaaauuuacaaaaaauauuuucuucaacaauagauuaaucuuggcauacaauaacuuuuuaacuuuguaaaccuuuuaauuuuuuaaaacuuuuugacucuuguaauaacacuuagcuuaaaacacaaacacauuguacagaaagauauuuauauccuauucuuuaagcucuuucuuguuuuuaaaauuuauuuuuacuauuuaaacuuucgguaaaaacugagacacaaagacacccauuagcuuaggccuguagagggucaagaucaucaguaucacuaucuucuaccuccacaucuugucucacuggaagguguucggggcaauaacacgcauggagccauugucuccuaugauaacaaugccuucuggaauuucuccugacugaccugccugaggcugucuuacaguuaacuuuuuuuuuucuguaaguagaaggaguauacucuaaaauaacaauaaaaauaaaguauaguaaauacauaauccaguaauauauuaacagauguuuauuguuauugaguguauguacuguagauaauuguauaugcuguacuuuucuacagcuggcagugcaguauguuuguucagacuagcaucaccacagacacauagguaaugcguugcuuuaugacagcuacaguguccuuaggugguaggaauuuuucagcuccauuauaaucuuaugggaccaccauuauaaaugcaguccauuguugacugauaugucauuaugcaguucaugacuauauuuuacuagaaaaacuguuguuuucuuucaucuaaucccuucuauggagaaucagagaauaucuuguuuuuaauauagguaaaugugauuugguaggugaauuaaccauggaguaagacaagccacuuucucagaagggguaguuacuucucuuucuguuucaaaguuucuucccucucuuuuaugucuugaaaaucaacgguaaaaaauuaauucacuauugaaguacauacuuacauacuuacauucaauagugaguuacguaaauguacguauuuacauuucacuaaaauaaguguacccagcaguuuuaccaucauuauccuucuuuuaaaaauaaaaaauuggccgggcccagguggcucacgccuguaaucucagcacuuugggaggcugaggcgggcggaucacgaggucaggagaucgagaccauccuggcuaacacggugaaaccccgucucuacuaaaaauacaaaaaauuagccaggcgugguggcgggcgccuguagucccagcuacucgggagacugaggcaggagaauggcgugaacccgggaggcggagcuugcagugagcugagaucgcgccacugcacuccagguugagcgacagagcuagacuccaucucaaauaaauaaauaaauaaauaaauaaauaaaaguaaaauaaaaauugaacuuuuaaggcaauauuuuacuccaaauagacuuuauuaaguugugaauuuuaacauuuucuuuaggacucuggcugacguugauggugauggacagcuaaaagcagaagaguuuauucuugcaaugcaccuuacugacauggccaaagcuggacagccauuaccacugacuuuaccuccugagcuuguuccuccaucuuucaggugagugugccuggagguggagaacuaugguuuugauaacuuggcagaugugauuuagaagagaguuaaauauuugcacugccauugauuuuaguauucaacaaguuauacuugaaaaggguacauauuagaaguaggugugggccaggcguggcagcuuacgccuguaaucauaacacugggagccaaggugggaggaucacaugaggccgggaguucaggaccagcguggacaacauagugagaccccguaucuacaaaaauaaaaauaauuagccaggugugguggugugcgccuguaguccuagguacucuggaagcuggggcaggaggaucacuggagcauagaaguucaaggcuacaguaaguugugauuaugccacagcacucuagccugggcagcagagcaagacccugccucaaaaaaaaaaaaaaaaagaaguggauguguuuucauuauguuauacauaaggaggcuaaugacuaaagagauaaagaaaaacuugcccaagaaccaaaauuagcugaacugugauuugaauccagauuucucugucuugaauauccauauacuacuguauuuuguaacgacauaccaaacuguuuuaaauaucuuuaauacuguauucccaauaucaaauugccauaaucacugguagucuguguaaucuagucugaaaauguccagacuacaugaugcuaacuuuguuguuugauuuuuuuagaggaggaaagcaaauugauuccauuaauggaacucugccuucauaucagaaaaugcaagaagaggagccucagaagaaauuaccagguaucacugagugucaaaguuguauauuuauacugaguucuuuuaaauucuaccuuuaaauguaauggaauauuuagaauuuuuauauuuuuaauauuugaugugcuauaugagaaaaaacuauuugauagaugggauguauuuugguauugauaaaauuaagauggucaaaaugagaagagugugaaggaagaagagacaguuagauguauuugacaggauuauagacaucugaguuaaaguauuucuccuaauuuaggcugaguuauuagaggaaacuuuguaaugaaaucuuuaccuuuaaaaacauuuaaauauugguugaaagaauacauuuguagcuguuuuaauauauuaggauguuaaugacaucaaaacaaauguauaaccacacagcuuugauuguccuugaagaagagaaaaaaguugaaaaaguuuuuuuuuuuuuuccuuguugcccaggcuggagugcaacagcacaaucccggcucacugcaacuuccgccuccuggguucaagcgauucuccugucucagccuccugaguagcugggauuacaggugccugccacuaugccuggcuaauuuuugguauuuuuaguagagaugggguuucaccguguuggccaggccggucuugaacugcugaccucaggugauccgcccaccuuggccucccaaaguguugggauuacaggcaugagccaccacacccaaccgaaaaaguauuuuuauuggcaaguuuauaaaaauuauuucucucuugauuggauucaaacuuaaaaauuuguuuuucuaaaauugaauauccuugaagaaaguagauauuuuuccacuuagauuugaguuaaaauuauccuuaggagaaguauucaaauacugauagcacucaaaugaucacaaggcauaaguauauagaaacuagauuacagguucuguaggcuguuaauguguguggaugcugauaggcauaccuuguucaguuacuuuugaggacaaacggaaagccaacuaugagcgagggaacauggagcuggaaaagcgacgccaagccuugauggagcagcaacaaagggaggcagaacguaaagcccagaaagaaaaggaagagugggaacgaaaacagagagaauuacaagaacaagaauggaagaaacaacuugaauuagaaaaacgcuuagagaagcaacgggaauuggagagacaacgagaggaagaaaggagaaaagacauagaaagacgagagguuauuuuuaaguuuuuuacuucuuaagaaaaucauuacauuuaauaagugacuauauuucauuugauuaaaaaaugcuuauuuuugaauuuuuguuuugccuuuugcucugcaucauuucauucuuacccuauacaaaucugaucauuccuucccuugaggagggaaagaggcuucuugcuuauaaggaguuuucagaacugguacgugguagagaaagcauccucugcaggugauaucucaaucaaaggaggaucgacugcagagcuaaguugagugaggagcuaagguuaguuaggcaacugagcaagucauuagacgaaagcaaguuuaagauccagauuaagaguccaaggaauuggagagacagaaagaugagagcugggcauugaaagucucucuagagaggaaucaagaggaugggcuugcacaggccuuugggauaguguugcugggaaagaaggguccuuaggaggacuggcuguguuuuaaagggccagggauggagcacaggaaguuauugcacacugaaauaauauaaauagaauuuuucccccagauaccagaauagagggaaaauuauuccuguuaacauuuauauuuaugaagucauucuguaacuuauuaagagaaaaaugacuguaacaaaaggauggucuuccaaccugggcaacauggugaaacccucucucuacaaaaaguacaaaaauuagccaggugugugguggugugugccuguaaucccagcuacuugguggggcugaggcaggagaaucgcuugagcccaggugguggagguugcagugagccaagguggugccacugcacuccagccugggugacagagcaagaugcugucuggaaaaaaaaaaaaaaaaaaaagaucucgugaagaaaugagaaaauaugauagaugaagccacuuucuuggaagucuuuaagcccauuaauaaaacuagauuugccuagcuacccuuaggcacuaaagccacuaagugcuaaacucugccugacuuuuauuguugucuucccaguuuuugaaucgugcaaaauuuuugauuuaaaaauuaaguauaauuccuuuuuuuuuucaggcagcaaaacaggaacuugaacgacaacgucgcuuagaaugggagagaauucggcgacaggagcuucucaaucaaaagaauagagaacaagaagaaauugucagguuaaacucuaaaaagaagaaucuucaucuugaguuggaagcacugguauggcugaaguuuaagugaaauuuaucugaaugaugauggagcuaccuguugaaaaauguaauugugggccaggcgugguggcucacaccuguuauccuagcacuuugggaggccaaggcaggcagaucaacuggggcaggaguuugaaaccagccuggccaacauggugaaaccccaucucuacuaaaaaaaaaaauuagccagcugugggcugggcaugguggcucacuguaaucccaacgcuuugggaggcugagguggguggaucacgaggucaggaguucaagaccagccuggccaauauagugaaaccccaucucuacuaaaaauacaaaaauuagccaggagugguggugugcgccuguagucccagcuacuugggacacugaggcagaagaauugcuugaaccugggaggcggagguugcagugagcugagaucgcgccacugcacucgagccugggcaacagagugagacuccgucucaaacaaacaaacaaaaauuagcuggccguggugggugguggugggugccuguaauccuagcuacuugggaggcugaggcaggagaaucacuugaacccaggagguggagguugcagugagccaagaucgcaccacugcacuccagccuagguaacagagugagacgccaucucaaaaaaaaaaaaaagaaaaauguaauuguguuuuaaaaucucucgugaauuaguuaugucuuaaugucauuagucacauuuucauauaaacagacuguacaauaugguuuacugagaaaaggauaaugacucaaaaugcugagaauuauguuguagcaucaguucagacacugaugaaccauguacuccugggcaagacauuucccuucucugugccucacuuuucccuugucugaaauaaagaguuguguuaguugagugauuuucaguuuucagauuggucucuguaagauggucugaggaggacuaagcagaggcaggagaggggaagcucgggcagcagaacagugauuuucucucccuaauucuucccacgcuucacaacagagaagcuugacauuuaugugcuuuauguuucuugggguuucacucaagauuugcuuggaaaaaaaaagauucuacuauuaaaaagacaacugauuugaaacugcugaccuaaaugaucucuuacaguuccaguucugcaggauuguaguucuuagcuaauacuggccacuaagcaguuuuuaccaaucagauguuagagggucaaguuguuaaaagacuuuguuugaaauguguggugagaagguauaaaagaucuggcacuauucugccacaacccuagaaucccaugagccuacccugaucauauaguaggguuuuacaaaaaugcauaccuagucauguaguagagccagauuuagaucuugugugaucauagucuaacauuuuauuugguugaugacuugaauuacauuaaaaauuauuuuuuuaaucaucacaauaucuuuagucagaaauauauuauuuuauuccuucaaauggauagacauacauaccacaaguauuaaucaugccagaguacuacaaaacaguuguaaaaaacuuuuaacucucuugcacuauuuuuauauauauauaucaucuugacuauauauaaugggaagagaccuuaagauugauuguuuuucccucaagaacuggugcaacacaugaagcacaguaacacaggugaaugugcagagucuggaaagguccagagccuauacguaucccauguugaggauaagaaugugagcuccagcagagauacacauguuccuuucaguguauguauuucaaauaugaaacagucuucaguaaaacuuuucaucaucaguaaguuuuaacccaggaugucauuuccccucacuccacuguauuaguuugguagggcugcuguaacaaaauacgauaggcuagguggcuuaaacaacagaaauuaauuuuuucacagcuccuaagaucuaagaccaagguuaguuaggcuuaguuucuugugaggccucuuuugguggcuugcagguggccaucuuucauuguguccuuauaugguguuuucucugaguguauuuuaucucuggugccuuuuguguucagauuuccaccucuaauaaggacaccaguuagauuggauuaggguccaccuguaugacuuuguuuaaccuuaaucaccucuuuaaaggcccugucuccaaauauugucacauucugagguacuggggcuugggacuuuaacauaugaauuuugggggacacaguucagcccauaaccccccaugucacccuucuucuuaggucccauugagaaucucugcuauuuguuugauuucuucacagaagaagaggaaaaaaggagaagaauauuaguauagaacagaacuguugccaaaacguuccuccugggcacuguuuuaauuagaggaaauuagauggccauauuuaggguagaaauagaaguucagagaagguaaugccgagcaucacaugcaaacauuuauuccucuucaucauucuuugagagugucucugauauuaauauuguuaauuaauauugucuaaugcugaauucagaaaaaaauucaauguguuauguuucugcuuucccauacuaacauaugggcucuugcacucugagaaugauguguuucccacuaauaacucgaguuaacagacacaacucugaaacacauuccacuugguuuuaggcauuuguuucaggaugaauaugaaugauaacugagauuuuaaaauuuaacuaaaaauauuauucuccuuguagaaacauuuucuauuagcauuuuauguuacuauauauuuauaugaucuuccuauagaauggcaaacaucagcagaucucaggcagacuucaggauguccgacucaaaaagcaaacucaaaagacugagcuggaaguucuggauaagcagugugacuuggaaauuauggaaaucaagcaacuucaacaggaacuucagguaaguccuucacugcuaaauuguucuuaaacauguacaauuaauaguucuucugggcugggcacgguggcucacggcuguaaugcuagcacuuugggaggcugaggcggguggauccccugaggucaggaguucgagaccagcccagucagcagggcaaaaccccgucucuacuaaaaauacaaaaaaauuagcuggguaugguggcgcaugccuguaaucccagcaacucgggaggcugaggcaggagaaucgcuugauuccgggaggcagagguugcagugaacccagaucgcaccacuguacuccagcauggaugauagagcgagauuccaucucaaaacaaaacaaaacgaaacaguucuucuaauagaguuuuguuuugggggucaauaaccuugagucuuugauaggcuugugaucuaaauacacgcaauccuguauacaauaucaggaaguccauagaccuacuaaaacucugcuagacgucugguuaaguuuugcuuaauauauauacguaaguggacauuuaucacuuugaguuuuaacucuuuaacaauguuuaugcauucuuaauucauuacuugcuauaacaaacgaccuuagacuggguaauuuauaaacaacagaaauuuauuacucauaguucuagagacugagaaguccaagaucaagguguuagcagauucaguguccgaugagggcuugcugucuccuuuaaaacuagugccuucuugcugcgucuucacaugcagaaaggguaaggcagucccuucaacuuccuuuauaaggacagucaucucauucaugaguguggagccuccuaaagcccuacuucuuaauaguacugcauugggaguuagguuccaacauaugaauguuggggacauaccaacauucagaccauaucauacauuaaaauaagguuauugcuacuaauuuuaggaaauuuugacuuaaaguuauucuuuuuaaaauuaugaugagaacuugaauaugucccuugggguccugguaauucucuuccuuacuugugcaguagggucugguucaauaauuacuauuugcagaauggggcuguggaagcauucugcaucucuagaguucucuuacccaauuucucuuacugcauggacuggcaauuaaucagucuuuuugcuuuguuacaggagagauaaacaaaagccaaaaauauuuucugucugauuuaaaccugcuuuccuaguuuuuaguccuuuuuauuuuuuccucccucugucacccaggcuggagugcaguggcaugaccucagcucacugcaacuucugccucccaggcucaagcaauucuccugcuucagccuucugaguagcugggauuacaggcacccaccaccacgccuggcuaauuuuuguguuuuucguggagacgggguuucaccauguugaccaggcuggucuugaacuccugaccucaagugauccaccugccuuggccucccaaagugcugagauuacaggugugagccaccgcacccagcuuuuagucccucuuugauauacacauauucauccugaaguaucauggcaugcuuacacauaccaucuagcgcaggucugcugucauucaucaguaagcugaaaauuguaggcuucuagacacaccccauuuacaaaggcuuucuucacugccuuuuaauuucagccagucacucaaaauugauuuuggcuuaaauauuucuuggcauaauuccauucuaguugauucauaaguuguaagcaguuuacaacuauguauuauuucuaaaauaaguuucaaagaugaguaaauccuguuuuaaaguuuucaaaaaaaacucuuggacaauauuauaacauuguaaucagguacuauuuuuucuuuuuauaaggaauaucagaauaagcuuaucuaucugguaccugagaagcaauuauuaaaugaaagaauuaaaaacaugcaguucaguaacacaccugguaagucucuaagguuugucugauuacuuuuauccuuuucugaaugacuguaucagucacauuguuacuuuuuuaaaauuaaaaaaaguauucuguuauaaauaacacuuuuugccuguaaguuuaaaguuucaaaauaaagugaaaaauaucccagauguuagagcauuuuuagugauaaaaaguagauaaaaauaaaauaguaaugauugugguaugacuucauaucuugaugauauuuuuauguauauaauugaaacaucaaauaaaguguuagacuauaagauauaaauuuggcucuaacacaagacuacaugugcauuuugaaaaguccugcacugauuuuaaagaacuguucaggaggaggcuuuaugguggggccgcaccugggauucuaggguguuagcgugcagcagucauaggcuuaagcaggaugguaugcucugcccagacccuuuauauuaucuaacucugugcuucauacaaagaauuuuaccaucuuggcccucugacaccuguggaacaaaacauuccaggauaauuuaugggauaguaacuguuuuuguuuuugcucaggucccaaugagaaaacugaaaaaaauucucuguauuggauacuauaccaauaaaagcauagcagaaacaagguuuauuuaaagaaaaguaaaucugcagauguuguguuacaacugacuaaaguauccuaaaaugucacucauugagucucuaucaagucaauuauuccauuguaggucucuuuauuauaguuuuggcuguuuacaaaguucaauaaauaguauccccuucuuugcgcaaguucugaacaaauuaagaaauaaggcaaaggagcaagacaaaugagaaaccaaaucacugccucauuauugaugaagcugauucuaggcagugugguuuaucugugggugguauaguugcaccuauaaagcacuggaugcaugaacaaaguagaaugcagguuuccugugggcaguuaagucucuagagagugagggcuuaggaggagccuaggcuguacauuccuaggucuuuaacuugagcucacuaguuagugaaaggaaggaaagaagcugggauuguugggcuagugcagggcccuucacguggaagaaauaucagaaaugaaguucacucuugugaacuauuuuuauugugucuccugccuuccauugauguggucuauccaugucccugcucagacaguguuccuuauacuugguucuuuccuguucaaaguauauuagcccccaccucaccccuacacaggcauuccagagucagggugagcuaacccaccugauaugcacaguggcagaaauauaucuuuauuauugucaucauuguugucauuguuccuauuugaauugugaauaaaauguagaauaugucuuauugaggacgugauggggcuauucuuucucuguggaauguaauucagugcagcuguuaccuauuuauuuauuuagccauaguccaauucaaaauaggaagcuuuuguuugggcuuugaaaaguacccuguaucccuuagaugccucucuguauaacaauugccauuuaagauuaccagccaugugccaagcacugugugagucaguuuugaugcauucuuuccuuuaaucuuuacaauaacccuuugguauaguuauuauucccauugugagcucaggaaaacugagguucagagagauuaaguaguuacccaggaugguacaaucauaguacucaaauucaugucuaacuguaaagcccacuguacuaccauguuguuucuuugucuuauuuuccaguuacccaacauagugcucauauaugucaucaaauuugguauuaaaacaugcauuauuaguaauauacauuguuaugaauaaagcagaaauaugggccgggugcaguggcucaugccugcaauccuagcacuuugggaggccaaggcaggcggaucacgaggucaagagaucgagaucauccuggccaacauggugauacgccaucucuacuaaaaauacaaaaauuagcugggcaugguggcgcacgccuguagucccagcuacucaggaggcugaggcaggagaaucacuugaaccugggaggcagaggcugcagugagcugagaucgcaccgcugcccuccagccuggugacagagcgagacuccgucucaaaaaaaaaaaaaaaaaaaggaagaagaagaaauaugcagcuauaacacuucgcuaauagacgugaaagauuccugaauaggcuggacacuguggcucaugccuguaaucccagcacuuuagggugcugaggugggcagaucacuugaagccaggaguuugagaccagccuggccaaugcggugaaaccccaucacugcuaaaaauacaaaaaucaguagggguaguggcacgcaucuguggucucagcuacucggaagguugaagcaugagaauugcuugaacgugggaggcagagguugcagugggccgagauggugccacugcacuccagccuggguaauagagugagacucugucucaaaacaaaauaaaaaaaaaagauuccugaauaauuagagacauuuuauguuccuaaaugaacuagcuuaauauuauacuauacuauacaucaauacuaugucaguucucuccuaauuuauauauucaguucuuuuuggguuucuuaaaaugaaacuugggaagauaacugacaaauucaucuagaaaauaaauuguacaagauuaggcaaaacuugaaaaagaaaaacuuugguaggggggaggagacuaacccuaucagauaucgaaacauaagauaugaaaguuagagugccuaaaauaguguguuauugaucagaaauagaaaaguagaacaauggaauugaauagagucuagaagaaagcccaugcauguauggcaacguaggauaagauaaaguuggcacuuaacaucaguggggaaaggaugggcuuucaguaagugauuugagggacaguggauuaucugaaagaguugcagaggagcucuuuaccgcucucuauguacagaaauaaauucuagauaaauuaggaggcuaaacauaaaaacaacuuaaaaacuauuauaaaacaggaaaauauuuuauaaucuugguaugaggaaggucucuuuaaacaauacauagagucaugaagaaaauacuuacagauuugaugauuaaaaaugaaaacaucauaaugaaagacagcauaaacacuaaaaaauuugaaguacauguaauacaagaauuuagagcuucuacaaaucaaaaauuaagacagcccaauagaaaaauacggcaaaggauaagaccuaacaauucaagacucuggccagaaacauaaauagauguuucuuugacaucacugguuaucaagaaaauacaaauuaaaauaacaaucagguuucuuuuuugccaauuagcaaaaaugaaaaaagauugauaauauccaauauagaugaggguuugcagaaacagguauuguugguggcauaaguugauaacagcuuuuuuggaauaguaguuuggcaauuucugucagaauuuaaagugugcauuaacagaaugaaagacaaaaaucuacgagccacgugaucaucuccauaaauaacagaacgaguauuugacaagguuuaacaucuuuucaugauaaaaacucucaaaaaaaauagauauagaaggaauuuucuucaacauaauaaaggccauuuaugaaaagcucacagcuaucauaaucaauggggguaaacugaagacuuuucaucuaagaucggggugucuaaucuuauggcuucccugggucacauuggaagaagaguugucuugggccacacauaaaauccacuaacacugaugauagcugaugagugcuaaaaaaaaucucauaauguuuuaagaaaguuuaugaauuuguguugggccacauugaaagccauccugggccgcauguggcccauggccugcagguuggauaagcuugaucuaagaucugguaugagguagggauacgcacuuuuuaccacuucuguucaacguaaugcuggaaguacuagcaggacuacucagacaagaaaaaggaauaaaauacauucaaauuguaaaaguaguaguaaaauuaucccugucugcagaugacaugauccuauauguugaaaacccuaaagacugcaauaaaacuuagaacuaauacaugaauugaguaaaguuguaggacacaaaaucagcauacaaaaaucaguugcauuuuuuacaccaauaacuauucaaaaaagagaucaaguaaacaauauuauucaugacagcaucaaaaauaauuaaauacuuaggaauaaauuugaccaaggaggggaaagaucuguaacugaaaacuaauugaugggagaaauugaaaaagacauaaauaaauggaaagauacuccauguucauguauuggaagaauuaauauuuuaaaaauuaucuguacuacccaaagcaauauacagauucaacacaauaucagaauucaaauagcauuuucacagaaauagaaaaagcaauuuuaaaacguauauggaaucacagaagacuucaaauagccaaagcaaucuugagaaagaaaaacaaaguuggaagcaucacacugccuguuugcaaauauuaugaagcuauaguaaucagaacagugugguacuggcauaaaaacagacauagggacaacaugaaccugcaagauguuacauuaagugaaguaagccaagcgcagaaagacaaauacgguaugauuucauuuauuuguggaguguauauauuuauccauaaaaguagagaauaaaaugguggcuaccagggcuggugagagaaaaggggaucacugagaguuugcucaaaggaaaucaacauuucaguuagauaggaggaauaaguucaagaaaucuauuguacaaccuggugacuauaguuaauaauagugcauuguauucuuuaaaguugcuaagagaauagauuuuaaguguuuucaccacaaaaaugguaaguaugugagguaaguaugugagguuaauuagcugaauuuagccauuuuacaauguauacauauuucaaaacaacaugcguacuauaaauacaaguuuuuauuuguugauuacaaaagacauagauuuacagaauagagagccuagcuaauuaacauacacauuauguuaauuagcuaaauuaugcauauguuaauuagcuccuuagccaauuuacaauguauacauauuuuaaaacaacaugcauacaauauauauacaauuuuuugucaauuacaagacauacagacuuaugaaauagaauagagagcccaaaaauaaacccaaguguauauggucaacuaauuuuugacaaggguaucaagaagacacaaugggaaaagguagccucuucgauaaaugguauugggaaaacuggauauccaccugcaaaagaaugaaauuggagccuuauaccauacucaaaaaucagcucaaaauggauuaaacauaagacaugaaaccguaaaacuccuagaagaaaacauugacaaaagcucuuugacauuggccuuggcagugauuuuuuggauauuacaccaaaagcucaggaaacaaaaauaaacaagugggacuucaucaaacuaaaaaguuucugcacaguaaaggaaacaaucaagaugaaaaggcagucuguggaaugggagaaaauacuugugagccauguaucugauaagugguuuauauccaaaauacaaggaauauauauaacucaauaccaaaaaacaacccaauuucaaaaugggcaaaggaccugaguggacauuucuccaaagaagaccuaaaaaugguaaagagauauuuaaaaagggacucaacauuauuaaucaucagggaaaugcaaaucuaaaccacauugaaauauaauaucaccucacaccugguaggauggcuguuaucaaaaagaucagagauaacgagugguagugagcaugugggaacaagggaacccauguacacuguuggaggaauguaaauugguauaguuguuaaggaaaacaguaugaagguuucuaaaaaaaauaagauagaacucuuguaugauccagcaaucucacuucugaauauauauucaaaggaaacaaaauuacugucucaaagagauauuugcgcucccuuaugcuaaaugcaguaagucaguuacagaaagacaaauacugcaugaccucaguuucauauaaaaucuaaaaaaguugaacuccuguacagaaacugagaguagaagagugguuaccagggguuagagggaggggaaaauggguagauguugaucaguggguucagaccaacaucuacccauaccagucagaaagguaguuauauaaauuaugcaguagccauaauguaaacuacuauggagcaauuuaaaagaaugaacuagaucuguuuguccugauugauaagauaucuuacuaaauugaaaacaaguugcauagcaauguagacaauaugauucuguuaaaacccauggaaauaaaaguugaguauguacacaucuaaauguaaaugccuaaaagggggaugaacuugcaguugaaauggagguguuuuaauuuuuuacucuguauguuucauuuuauuuaaauuuuguacuucuguacuucaaaaauaugauaaaguuaaaaacagacauuuaaacagauaauauugcuauuuuaauuuauuguaauguauucugcauuauauauuuccaucugguuucuucaucccugcaugaauauguaaaaaaagauaauauaaaaugaaaccuucuguucuuaccuccuaaaauaauguuacuaaauaauccaguuaguaauacuuacugaaucuuugcugugaauauuucccuguucuugggagcacuaagaauaaauggaaagcuacuuuaacuauaguuucuauuaauugaguauuaacuguggaccagaguguacaauggcuuuauauccaucaccucauuuaauguagcaugaugcucauuguauagaugaaaagccugaggauucgauuggugaagcaucuuuccuaaaguagaauuucacuucagguccuaguccuuuugaaugcagaaccaaggcuuacaaccauuuccucugaugcucuuuccagcauauaaucugggaaguggaaauaacaacugaauguuuucucuuguacuggucugcauuguguauacauccuucguauuggucuaguuacaucaaucugaccaaacaguaaaugacaugcugguaaugacauacgaacuucugcaaaauguaaacugucugauguuuguuuuucagauucaggggucaguuuacuucauaaaaaaucauuagaaaaggaagaauuaugccaaagacuuaaagaacaguuagaugcucuugaaaaagaaacugcaucuaagcugucagaaauggauucuuuuaacaaucaacuaaagguauuuauuuuugauacuauuuauuuuuagguaacugccuucuuaccuucauuauuuugauuuaauagaauaaauagcuaaagcuauuauauguauuacauuuucauaauuuauuuuauaauuucaacuauacaagaauuucaagauuguuuuuaauguucuaguuauaugacauagugucauauaacuaaacauauacuuuaucacaguuuccaauuuuugaugacuaugugcuguuugucuuggcaucuauacauuuccagaacaauugccuuugucaguauuacagaacugaucucagccagcguuauccuaggcaauuuucaaaaaugagaaauauggaaaauuugaaauaguuuagguguuaguggcucuuuuaacacaguuuuuauuuuguuuccuugugaaguguaauuuaauuaaccuuuguuaaauaaugcaauaaucagugaaaucuagaacagaaucuggcacuauaaacuuugcacaaaaagcaaguuaaugauucauuguuugccgcaguggcagagcagauguccaaaacauagacugucugcauaucauucaccacaguauucauuguacacugaagccauaccuaugaaagaaacuaaaaacccaggcucauggcauagaauguaaauuugggaauagucucaguuauuccuuugcuaacaauauaaaguuuccagagcauaagcuauucucuguaagaaauaaagcuuuucauaaagcuuuuguauaagaaaucucucucuucauauggcuuuuaucaugcugacuuauuuagaauaacauuaacagcaaauauagaguaaacagcaugcuaaagaaaggacaacaugguggcuucagguaaggaaagggaauuugaggugaacaauguuaauaauacacuuuacacaagcauauguucaguagaaaaaaauuuuauagaaaaccaaaucauuugucauugcugguuagacaagccagccaacuuaucuucccuauauuauuucuuuaaaaaaucuacauaacugggcaugguggcucaugccuguaaucccagcacuuugagaggcugaggcgggcggaucacgaggucaagagaucgagaccagccugggcaacauggugaaaccccaucucuacuaaaaauacaaaaauuagcugggcguaguggcaugcgccuguagucccagcuacucgggaggcugaggcaggagaaucgcuugaacccgggagguggagguugcagugagcugagauugcgccacugcaguccagccuggcgacagagugagacuccaucucaaaaaaaaaaaaaaaaaaaaaaaaaaauucuguacguaguuuaauuggcuuuuuaucugccuuaucuuacagugugggaauauggaugacucuguucuucagugccuuuugucucugcuaagcugucucaacaaccucuuccucuuacuuaagguuauuuucuaauaucuagcuucuuuucuuugaguuacuuugcuguuuuauuuuuuuaaaacuagacuauucuuugccuuuaucugaguaucuuuguuugaaauaacauauacaauauaagccuuuuucuuucugcuugcuugaauauccuucugcuaucugacugccuguuugagucuaaugccagaagucaguaagguugccugucacaguaaccuuucucaaaagaaguccaggacacuuagaaauauaaccugguuccuuuacaacaucccugggaguggguuaacugauaaagaugauuacuaacucaauucaaaggaaaaugugagauuaaaucacuuacccauaucacugaaaaucaguguuuaaaauaaaacuuaauacuuuaugaaaucuagggcaaguuuaugucauauaugcaccaagcugcuuccuaauacuguuguaaggacaauuuuaaagaaccaauaaugcaggggcaacuuuagucaggucuaguuaccaggcucauauuuagacaugcuugcacaucagauaaaaauguuuaaauuauauaaauauuucucuuugccauguauaacguagauuauuaaaaauauuuuaauagagcuuaaagaaaugugcuuuauguuuacugcuugcugacucuaguagauuuugacuacacauuuuacucaguacuaaaauggauagcaauagggcaguugccuauaugcauauauauuccacagugaagacagaaacaugauaaguagaguucauuuguuaccugagcgaaguagggcaaauuggaaagaugguagcagcaggggacccauauuuuagccuuuaugguuauggcaugaauggccagauuauaugguuuuuagaacuuuugcuacggauugcauagaaacuaaacuaaguuuccucaucuguaaagugaaguuuaaugaugauuuguggacuguucucccucacagagucugauucuuugaguuagcauuugauucuccacaggccagcaguuauucuugucccuuguuuuacuuuguuccuucugcuuccugccuuccagacuuacacugcuuauugauacuuucaucagagcaauuuaggaaacuaaagagauaugaaaucuauacugucagagcagucaggagacuguguugucacagaaagcaagaaaagaggucuucuguaguuacuagaaaaugauacagaguuauuaguuaacauagugcuaaaaaauauuggccaggcgcaguggcucacgccuguaaucccaacacuuugggaggccgaggcgggcggaucaccugaggucaggaguuugagaccagcguggccaacauggugaaaccccgucucuacuaaaaauacaaaaaauuaucuaggcauaguggcggaugccuguaaucccagcuacucaggaagcugagacgggagaaucgcuugaacccgggaggcggagguugcagugagccgaggucgcaccauugcacuccagccuggucaacaagagcaaaacucugucucaaaaaaaaaaagaaaaagaaaaauauccauugaauuugucaaaaagaaaacuuuugaagaccuugcuaaaagugccauuucacuugagugauaagcagaagcuggauugcaguggaucaggaaugaguaagaguugaggaaggguuaagugaguagcaacaacucuuagaaugaaaagaaaaaagcaugggggucaaaggaaaaucuuuuuuuuuuuuuuuuuugguuuaagaaagacuugaaggaaauaguaaagagaaaagaaaggaggaggcagggggaaagagagaaagauugagauugugguaauugauggagcaaagucccugaagaagcagauuaagauggaauggagagcacagauuaaaggauuagauaaaaagaauacuuucaguguaacauacggggagaagaugguuaugaaugcaguuaaauuuguugguagagaguaggaaguugacaguaaaacgggaaagguucccuugucccccuugaagggcaggugauggggauguggcucacuucuucagugcuccccugcucaaaccucuaggggagcauacagaugggcaggcuguggggcucugaccccacggcagugucuaggggugaauguuuacagcugaagccccaguggggguguguuacagagugcucuuuuaguuugccgucuauaggcgguucguguuacccagcucaguuagacccccuuccuuaucacaaggacagaacagagggauuucuguaucccaggguuucuugccuugguguacuggaagaauuggaucacacgugggcuuggagaaugaaugcaagguuuuauugaguagaaguagcucucagcagaugggggagccagaagggagacgguuuuacccuggagucgggccgcaaccugauuucucacugcucuggccaaacuccgcauuguuccucuggucaguggccugcuggccugcuggugccuguugacaugcucuuccaccggcgugcucuugaugaccagcugcuugugucgucuucugccgaugugguccucaugacguccagccacuuaugccucugccuuuuuaggaucucggguuuuuguaggcacaggaugguggcguggcaggccaggguggucuuggaagaugcaacauuugggugcaaaggcaggagugccuguccucaccuagguucaugggcauaggcccgaggcugaagcccuagccagggacccgccuuucucuacccaguacuucccuggcccacucccauaucgacagcuucaagacuuaaaaucagagguaaguuggaccaucagaaagaaucuuccuggguagaggaggacaugauauaacucagccuaggccagaagaagagggguggagaugcagaaagugcuauugguuuuuugagauggaaaguugagagggcugcagucugauggccuaaugaggcaagguuuauagcugguagugaggagaauggauggaagauuaggaaguuucaggagagaaauaggcaugaaauagacaucucagugcagauaugcaagcuuaguagaggaaaaccuaagugugcugagcaauguugaaugucuuuuugaaguuggaggugauguauuuaaauugaaaacaguaugccuaauugugugauuuugccucaccaauguucagcuguuuagguauaagcacagagaaagcugaugaaauagguucaugguucauacagguuugagguuuuaauagacaugcacaaagagagagggacagaagaguuacagaucuugacaaaagcacuaugaucaagaugagcucugaaacaugaacuagacaugaaggaugugaagagaggaagggguguuaauaaagaaagagaaugaugggagucaacagaauggucucagugagguugaaaaccuauugauggcugggcguggugucucacgccuauaaucccugcacuuugggaggcugaggcggguugaucaccugaggucaguaguuugagaccagccuggccaacaugaugaaaccccgucucuacuaaaaauacaaaaaauuagcugggugugguggcacgcgccuuuaaucccagcuacucgggaggcugaggcaggagaauugcuugaaucugggagguggagguugcagugaggcaagguuacaccacugcacuccaaccagggcaacaagagcaaaacucugucucagaaaaaacaaacaaacaaacccuauugauauagauguaccagguauaagaaaaguucgaaggguaagaacuuacguuugaagaaugggauauuuggucaaugguaguucuguuucugauuaguaagacucaggguguaauaaugggagugauggauuaaguagaguuaaaaaggucauugaugaagagaucagccugagacuugagguuuggauugcaucauuuauguggaugucaaagacuuagagaauagugaggugagugaaugaccaggugacuaauagauaacaauaaaaaggaaggagagaaugguauugcuggaugguaggagccccagaaaagcauggaguugcuaagagugagggggaaauaaccaucugaaaguggcagugaagagcaaggaaaauacuguaguuauccucugacccugauguaaauggaguauaugauaauaaacugagagaggacuagcagaaaaguaguauccggagggaucagccaagaaagugacgagggaagagaauuuucguucagagaagauugguagcuguaugauaguuuccugaucacauagaggaaguuccaggagaguggagagguuugaggagagaaugaguaggggauugggucagauuaagggauaaacagcacuguagagauaagaauucaggugauaaggaaugagaagaaaggcugugucuuaucaguaggugagauggaacugguccugguaguguuggagcaggacaggcacuuaguucugaugcugugguccuuugugauaguagagcaccgggguuaaccaccacuccuuuaggcuacuuguagugacaacagaaguaaaauauuucaauuauuuaauuuagaauguuauguuuuacuggaaccugcaauaugcauguacagaauuaaugauuuuuacucuuuuggucaaguuauacuaagacaaagccaguggauucaaaagugagacauuugacaggccauuauaccauuaagaaaauucacacaucuggccagguacuguggcucacgccuguaaucccagcacuuugggaggcugaggcggguggaucaugagaucaggaguucgagaccagccuggccaacauagugaaaccucaucucuacuaaaaauacaaaaaauuagccgggcaugguggcagacgccuauagucccagcuacuugggaggcugaggcaggugaaucaccugaacccgggaggcggagguuguagugaggugagauugggccacugcacuccagccugagcaacagagcgagacuccgucucaaaaaaaaaaaaaaaaaaaaaaaagaaaauucacacaucuuuagcagugaagugcaacgaaaacuccuggccuaggaaucuaaaaaagugaacucuagucuuauccaugccacuugccaguuguguaacgaucugucauuuacccuccaaauuugcuuucuuccuuuacaaaacaugcugacauuaucugccugucuucuuugcaaagucuugugauuaaaugagaucgcauauagauggaaaugcuuuguaaacucuuauauacgaauauacaaauauuuuuguuauuugugaaaaaacaaaauuacuuucccucacucuucuuaagaaagggguugucagaaucuccaaaauaucuuuaguauuuuggaaagucaaccaguguugacuugagauaaugauuggggaaaugcuuguccauagagggaaaguagaaucuguuaaugguagaauugugguuuccuucaaggaguuaggucuuaacccuaugcuuccaaggaucuggaguaaucuacguuaguaauaccccugcagguggcauaaccugccaugaccaaguuggauuuaccucagccauacaaagaugauuuaacauacagaaaaguuuaauguaauuuacuauauaaacagacuaaaggagaaaaagauuaugcucaucucauuagauacaggaaagguuuuugauaaaauuuaauauccauuuaugauuuuaaaaguaaaacuuauuagcaaacuaguaauagaaguuccuuaacguaaaagagauaaucuaucauucuguuaagauugagaacaacuuggcugggugcaguggcucacaccugcaaucccagcccuuugggaggccgaggcagguggauugccugagcucaacaauucacgaccagccuggccaacaugguaaaaccccgucucuacuaaaaaugcaaaaauuagccgggcgugguggcaugagccuguaaucccagcuacucaagaggcugaggcaggagaauugcuugaacccgggaggcggagguugcagugagcugagaucgcgccacugcacuccagccugggcgacagagcgaggcuccaucucaaaaaaaaaaaaaaaaaaaaaaaagauugagaacaacucuuaaugaauucugauugguuuauuuuuuucuugcuuaacuauuauguguagcaaggaccuccuggaaguagugacuuaacccagaggaauaggucuaaggauaggaauuuuuacaucaccauagucaaauagaggaaauacuuggcaagcuuuguggugcucuuuaaaucuuacuaauuugcauagacuauuguuuaugcauuuuucauuuguccaauaaauauuuauuaaauauccauguuguacuagacucucuguuggcuggagacaccuugaugaaagacagucuugucaagaaacucacuucaguggaggaggcaaucauauaguuggaagagaagacacuaugauagaggaauauacagaauggcacaaggaagcucauuaacucugacacugcagggaauaggguuaguaaaggaauacuuagagcucuauuuuaaaggacaaguuggagggcuaagccugcagccuuguugagaucagacauuaauuuggcuccuuuuuacucuccuuuuagacugaguacucuccucauuuuugacuucauccaauaauaauaacuaagauuuacugagaaccuaggugcucugcacuauaauaagcacuuuauauguauuaacucauuuuauccucacaacaacucugugaggcacguaucauaacaggcuuccccaacccgugguccacaggccacaugcggcccaggacagcuuugaaugcagcccuacacaaauuuguaaacuuucuuaaaacauuaugagauuuguuuuugcaauuuuauuuauuuauguauuuauuuuuagcucaucagcuauuguuaguguauuuuacauguggcacaagacaauuuucccucuuuccauguggcccagggaagcuaaaagauuggacacccuuguaccauaauuaaccucauuuuacugaugaggaaacuauaaaauaacuuuccuaagguuauacagcuaguauacagagccugagucaagccuuguuagucuuauuccagacccaugcuccucaucacuaaaccaccuugcuucucuauauauuguaaccacuauauucuucugcuuuucaauagaauuuagagaaagguacaacaaauaaaacccuagaagcugagagcuguggaaauucugcuauaaaagcaguaugcauuacuauuggcuuaaguuguaaauguuuugcucagacauguuggacauagucucuggacagcaugcuguacuuagaucaaaucuacuauuucaaucaaguaaaagguucacuuauaaaauaguuaucucugaaaagaaauggaguuuggaguuguguuauuguguauagguugauaccaaaaaacauuuuuuaccaaaacauucuacccaaauauuguccagcucucaccuuugccaugaaguuucuuuugauuacucuuaaguccccccgcccccacuucuuuccuccagccuccuuuuucuacucucucguucaggauucuguagauuccaaaugaaagaaaucuaguucaaaauaguuaagcuaaugagugauuauuagaagcauccuaggaccacuaacugaauccauggaagggcugcuggacaggggcaguuccuaggucuccgagccaugauauugaacauucagcuucuauaguacccuuucucuccagcucagucucuaaucuguacuucucuuuuuucugaguugauuuuauuccuauccccaggucuuauuugguugugaggcagcuccagguuuacuuuaucccaguuuaaugagcugcagaaagguuucuuucuccccacuucaacauaugugaaucccaggaaaauauucugggccagcuuggauuaugcuuauguccuuuggaccagucguuucugagcagggaaguaaggugcugugauuguuuaggucaggaguaaacaauugugccugaugggaaugggaggagcucugaguuuggcagaccuuuuaaaaccacguaagauguugggaggaagguggaaagaucaguuuccuagaggaaggcagggugcuguugaagaagaggaagagaaaaugcugaacagauaaucacaaguuccugcuaaggaauuuaccucugcccugcauguugacacuugccucuacauugagauugugaacucuuuaaagacaaagucuguagacgugggagucagccuuguauuggauccucuuggaacgcuuuauagcacuuagcauacaacuagauguucaauaagcaguuguuuauuucaacuccuguuuggaaugcuuuucauuauuuuggcucaugguggucaugauuuuaggcagacaucuuuuccauuuuuaguuuugaacuaaauuauuuaauaauucuguguuuaguucaagaugauauuggauaaaaauaacuugguuaaauuacauaugucaaaaacaugacugaacaaaauuucucuucagauguuauaacaagcaaauuauucccccauauuuuuaauggauugcuuuuuuuaauugaaaaugauguaccaaaucaaagcaucggcuuguuaaagauucuguguuccguagaaaugaacugauggaaaaguagauuauuuuaauguguuuaucucaggagcuauaugguuuaaauacuuaagguuuuuuuuaucaucuagauauuuuuuaaaacuuuaaauauuuuaaauuuaguucaacuugcuauaggauuuuuaucuuuuaaugcaaaugccacauuaauacauaugacaagcauauuuaaaucauucacguauugacuuauuuucuuuuucuccuuaggaacugagagaaaccuacaacacacagcaguuagcccuugaacagcuuuauaagaucaaacgugacaaguugaaggaaauugaaaggaaaagauuagaacuaaugcagaaaaagaaacuagaagaugaggcugcaagguaauauagcugauauauuuauugugcuauauugccauuagaauuguaauuuuguugcucauaucuuuaguuuaugaaaauuuaaggaaaauaaagggauuauccuaaucagauucuggaucucauaaguucaguccuuuuagggaucaaguuugcaguaacugauuuuauuuucuacuagugaaaaauaacagacuuuggagucaaaccuguauuagaauucuugcucuuccacuuacuaccugggugaccuugguuaaguuauuuuuaucuuucugaaccucaguuacuccaucugaaaauagagacaauaaugcauaucucauagguaaauguauuaaauaaaauaauacagcuggaacugggcguggugacacacgccuguagucccaagcuauuugggaggcugaggcaggaugaugaguugagcccaggaguucaaggccagccugggcaacauagcaagaccuugucucuuaaguuaaaaaauaaaauaauguagcuaaagagccaaguauaauuuguugcacauaguaaacacucauucauuccaucuuuccuugguaaaucuauuaguuuccugaaagaucauaaaagcagaauacuuaauuguauauaguaauacugaauguagaaugccacauugaugcauuucucuuuuuaucacuugagauauauuaauugccuccauuuauaguaaggagaaguaagacauuugugguaucugaagccuagaauuauucauuuagaaacuuugcaugguauuuuucugccauugagauucuuuuucuaauacauucuucucuuucuuccaaguuuucuaguaucagaaaguaguauaauuaguuaacaaauauggaugaaccaguauuuuuuugccuugguaaagaguagaugaguaauuucuaugaaaaagcuaauaguuacuagggaggcaaggaagacacauuaccauuuggcaggccucuauucuuaaugguuucaaaguagccaccuccaacacauuuuuuugaguggcuauuguuggcugugaugcugguagacuuuggauuacuccucauaauucuaauaggagauucagacaguuaaacgaauaacuauaauauuguuuacuccuagacccccauuucuuuauuuugagacaggguccuugcucugccaccgaggcuggauugcagugguaugaucagggaucacugcagccucgaccucccgggcucaagcaauccuccugccuaagcucccacugaguaacugggaauauaggcauguaccaccacucccugcuaauuuuuuuugaauuuuaauagggaugaggccucucuguguugcucaggccggucucaaacuccugggcucaagcgaucugcccaccuuggccuucuaaagugcugggauuauaggcaugagccacugcgccuggugaucuagaccccuguuuuuguggccuccuaacgagauaauagaauaauauagaaguagagaaaguaaaguucaaacgaaguagcucuuacagcucuuauuuacugcuuaacuuguaccacuuaauuacauaagggagcugugcagugguuccacagcuaauccuuaugucagaacuuucuauugacauaugcaguuaccuuaaucuuucuucaucguguucacaauuccuuucaggccaaaagauuauacuaguuauaugcguuuaauuucauucaucauccuugcacauuagguaguagagaagagaaaucaaagagagcggaagugcauauaggaccuacucagucugaagcugggucuuaguaccacaucuuggauugauuggccauuugcccagguauauucccuucuuuuccccaagguauugguaauagguuuucacauuuuaguuguggccucuuugcccuuugcccagcuucugaggcauccuguggcacuggaccgguuucucaacuacuaacucuuacauaaaguuuaccagaauucuggcaugauuuccugcagguugagcucagccaaguaccaccccucaguaagccuagaguagaggggccugacauccuuuccuuaaauuaaacaaggagccuuauccagguuguccuagucucauacuuauguggccaugauuaccuggcaggaggaguugauggaaagaaugaagagcuuaaaaaauauauagaaaauuuuaauuuaaugagcccucugguuuuuuuguugugcuaaauaugugcuaaguacucugauagugauauuuauaaugcuauaaaaauucaaaugaaagcuaauuggguauuaauuacuaggcuuggaaaagugucccggaaaguuacagaggaacugagaaaggggauauuaguugaaauuaagugaggacugcaagagaagcauuuuccucacaggagaaccagaaguccguuuugaaaguugccggaggaagcauucuaugacaugauagaggaugaaggagguuuggaaauuguuggaaggaaucuaguaaaugggcuagugaaccagcaguaugaagucugaaacaguugagagauaaggagaaagcauugaugacuaagggccuacaauauuuugaauuauccaggauuucgagauuccuucaggaauuaaggaauagagauguggaauuaugccaagguucccacuuuggaaggguauauaugcugacaaaucucaggaauguuuccagcuguaaucuucacugcccugauagugcugaggcuuggagaaggugcuaaauuuaagugguggcagcucuaccucugaguaagguugugaaaauacaugcaaaggagaacuauaagaugcaugaguucuaauacuaaaauaauugaucacagaucaccuugacuggcuggaaaccaaacuguagcuguguuagauuucauugaaauguuuaccaaagcacguggaccuagagaggagaaaugcucuauuaucuaagcaaacaaaaaagacuuuuugaaguaauaauauaaaaaguagacugggcgcaguggcucaugcccguaaucucagcacuuuggaggccaaggagggaagauuacuugaggccaggaguuccagaccagacugggcaacauagcaagacccugucuuuauaaaaaagaaauuaaaaaguuggcuagguauaguggcaugugccuguagugcuagcuacuuuggaggcugaggcaggaggaucacuugagcccaggagauccaggcugcagugaccugugauugaaccacuguacucuagccugggccauagaguaagacccucucucuuuaaaaaaaaaaaaaaaaaaaaaaguagguuguuuuucuagaagcauuuccuauuuccacagcaacaaugacuaaaccccugaaacaaagauuagauaggacagugggaauaacagcuggaagacaguucuugucaaauaucuggagagaaaggaaggaaacuuagauguaauuuuuagauuuauuugcugaaugguuccauuucaaccuuuuucuuuuuuucuugaguuuggagguugguuagcaggagggaauuuuugggugugggaaauugucagucauacaccccagugcauccacuaaucaauccaaagcuuccaaagcuuuucuugauugauugauugauuuguuuuccuuucaccucugaucucagcaguuucuccccaccccuguacuaauacuucauugcuaguucuucaccuugacaggaaccagaucuuaguauguuuuuauuuaguguaaaaaauuucuaggacauuauacaaacucuuuuucuuuuauguaaaggaaagcaaagcaaggaaaagaaaacuuauggaaagaaaaucuuagaaaggaggaagaagaaaaacaaaagcgacuccaggaagaaaaaacacaagaaaaaauucaagaagaggaacggaaagcugaggagaaacaacguaaggauaaggauacuuugaaagcugaggagaaaaaacguaaggauaaggauacuuugagacaguagaacaaaugcaacaagaaaaaaaugaccugauaagagacaaaaaaagggaagaaaauuagaaagauacuaauuguagagucagaaaaaaccuuuuuauaaauuaaacuuggauaaaaagcaguaggcuuauuaaaacagacugaaaucuuaacacagcaguagaaaucuuagcacagcaggagaaaagaagauaguuacuacugauugugaaaagacucagacaugguuuucauaauugaaguaaaauaguuuuaaauauuuuauucaaccacuauaacuaagcuauuuauuuuaaugaaacaacaguaaaauuuugauacaccucaguccauuuccacaauacuuuuaguaguauuguaucucuuuuagauacaugaacccuuugaaucauuauuaaugauacaguuuguugaaauuuuauaaguuaaaacauucuaaagaugaacaaaguaaacaauuuuauucuuaucaaauucaguauauuuguguacucuuccacuguuuuccuuuuagaaccauucugauagauguauagauuuuucuucagccaucccuguuaacuugcuauucuuaucuuuugagaccccccuuuuuguccuuuacuucccuguuauauucagaccuccacagaucaaaccaagccucucuuugcuuggucuccuuccacuuuguacagcucagccuggcccccacuccugcacuuuccuuucuacccaugugugugcuucaucccgcaagucaucucuuuguuuugcugccuccuaccuuacuuaagaugagcauccuuguuugcuuuuuuauuagaugacuagucaagauacugaaauccuagcaagucuguaucaaguggauuuucauuguaguauuuggugcuugauuuuuucuuuuagguuuuagagcucuuuauugagucauagcaaagauguauacauguaaguugcaaauaaugacaauugucuucucuuuaggugagacagcuaguguuuuggugaauuauagagcauuauaccccuuugaagcaaggaaccaugaugagaugaguuuuaauucuggagauauaauucagguaggaaaugaauuuuuuuuuuaaucaugaauaaccuaaauacauuguaauauauuaguuucuguaguaauguugaccauuaauuucauauauuuaccuuuguaaaauguuucuuaaacauuaccucauuuggacuuuacaacauacuucagagcugcauaggacaguuauuauuacuaacuaaguucuagccaaggaagcuuaaacucacacaaguuguaacugucagcauugcagugccagaaugggaugcaguuauguguuuuuuuauuuccaaauccagcguuguuucugcuaugccauacagcaacuguuaaaagaauugaaggaguuagauuccacagcccuaacuggauacaggcaauuuguuccuuggaacgaaagucuuuauuguguuaucacaauccauauaaaauacaugaauaagagaagaucccaggaguaguguuugauagagccaguaggacauaauggaaagaguacaggcuuuagaagcacacaaacuuggauuuuagucucugcuucuguuuucuucuuguuaaacuaauguuaaccagaguaucuagccagaguaucuagccagugccucuuucccccgcucccccugcacugucaccaguuagugugauuuaucaguuagguggcaaauguuuaaugauacuagggaaaaaaauuuaccaaaacgcuagcacccaagauaaacccuaaacacacauuccugcucuugccauugccgcuauuaguaguaccggagcugugcccgagcagggggagagguuuguucuacaaccagcccaaguccacugucugcucuuccuaccauuccuccucuccuuguuggugauggugucuggaugaagagauacaaccaaucucugggcguguuuggucaagaguuuacuuauauuuuugguuauauuuuuuauuuauuucaacaaauauuuuuugagggcugacuauguuagacuagggauuuagugaauaagacauuaucucugcucuuaacacgcuuguaggcuaaugaaaaagcgugacaaccuaaagcaguagaggaaggaagguaaggaaaagguuguagacugcuaccagcuuuagcacagaccucucccauggucagagagccauucugguggcagugacaacagaaacauaaaguuagcugugugucuugggugcuuguguacucugcugaaucauuaacaugaaguauuagucaugaguuacuacugucagucaugaguugccugauuugaacaaauugguuaaugauggugucauuuccuaagagggaaaaucagagggggaauauauaaguagaauuaugaguucaguuuuguaugaguuucagauguccaggcaguaguaguuggaucuccagaguaccuagagagaugucaggcagcggucugggcugaggauguaaaucuggaugucgccagugugaugugaugguguuggaagacaugagaguaauggagcucauccaggggaguaguaacgugagagagaagaggauugaggaugcaguuccugagaaacauggacacugaaggaauuauuagaggaaguggagccuuaaaaggagugacuaguaguaggaaaaaaaaaaaaacaggagaguuuaauguuagggaacuuugagaagagugaucugcaagugaaauaaaacaaggacuaaaaaaauuauuagauuagcaauagcacagguguuguuaacuugaggacagcaguaucaguuaaguggacuaguagagcgagaagccagauuucagugaguuggaauaaauuggaagagaggaagaggagacagugaauauauaaaacucuuugaaugagcuuggcuuugaaagggagaaggagagaagguaguaaauaaugagaaauguggguugagggaaguuuuuuuuuuuuuuaaaguuggcugaagcuugagcaaguuuaaauaauaguagaaaggaucugcagagaggaaacagguuaaugauaauggaaagaguauaaauaacugauaaagauuguuuuuucuuauuaaaguauaauuuauauauagcaaaguguacaaccauaaguauacagcucaaagaauguguacacaucuguguaucugugaagccccccucagaucaguguguagaacguacagcaucaggaaggcacuucauguuccuugucaaaccucccuguucugacuaauagauggagaugaggaagauucuugaaaaggcuagaaggcuggaaucuggagcccuggaagagagugguagaaggauugaauaccuuauccuuugucauuagagggcaggaagaaagggugggagggauuaaaguaaauuuugcugaaguagaagaugaagucaggucccaggacuuccaaauucccgguaagauaggaggcaaggucugaucaacuuaauggaugaggguguuaccggagguuucauugaaagugaaaaggauuagaaauuccacugagucuuggccacauuuucgaugacaagcugaaauguuuuucuagccuucuaaucuguuaaugcuauuuugcuaacauuaauuaauaaguaguuaagaagaaguaauaaguaguuuugcuaggccugugagaauuuauauaaaauguucaguuuaacucaguauguaaauuaacaacuaaaaauuaauuacaacuauaaaugacagaugugaaagagauuaaaauugaccucuuacuaaaacaacuuggccuaacuacagaauaaaugaacgagauuuuucuucuugauuagguugaaaacacuaggaaaaaguguaucuagaaauuaauacuuuuaaaagcuuuuggccaggugcaggugcacacccauaaucccagcacuuugagaggccgaggcaggaguaucacguagguacuggcguuagagaccagccugggcaacauaggaagacccuguuucuacaaaaaguaaaaaaaaauuagcggggcuugguggugugcaccuguagucccaccugcuguggagacugagguggcagaaucacuugagcccaggaggucaaggcuacagugagcugugauugcaccacugcacucuaguagccugggugacagaguaagacccugucugaaaagucagccagccagccaaguccgucagugaagggagguagaaaggaaaguaggaagggcauguaaguaaaugugguaaauguguguguguguauguauguauguacauauguguaccuauauauagccaauacucauagcuuacggugauuccuuuccuuaagaccauacuuuuuuuuuuuuuuuauacuuuaaguucugggauacaugugcagaacgugcagguuuguuacauagguauacaugugccauggugguuugcugcacccaucaaccugucaucuacguuagguauuucuccuaaugcuuuccuccccuagucccccacccccugacaggucccgcugugugauguuccccucccuguguccauguguucucauuguucaacucccacuugugagugagaacaugugguguuugguuuucuguuucuguguuaguuugcugggaaugaugguuuucagcgucauccauguccaagacaauacauuuaaaucagguacaaugcugagcauuuugcagcauugaaauacuuugguuuguguaauuccucaggguuuauuguauucuugucugaauuuauauugcucuggcuuagcuauuuuauuuuauuuauuuauuuauuuuugaaacugggucucaaucuguuacccaggcuggagugcaguggcgggaucauggcucacuacagccucgaccacccgagcucacgccauccucccaccucaaccucuugaguaguggagacuacaggcacacaccaccacaccuggcuauuuuuuuuuuuuuuuuuuuuuguggagauggaguuucucacuauguugccuacgcuugucucaaacuccuggccucaagcaacccucuuaccuuggcuucccaaagugcugugauuacaggcaugaaccaccgugccuggcagacuuaacuauuuuaaacuagucuuaaacuagauuuacaggauaauauuucauaaguguuugcuuucauucuaacuauuuuagaacaccauuuuaugggagcuacauuacugugacaucauacaguuuagccauagcagcucugguuuaggaguuuucuaaauauuucauucaugauguaauaaauagccagacauauaacauuaaaaugagaauuauuuaccauaaacauaaaugaaguugcccuaauaauccauuuauuacuaauuaagcuuuaagucuauuguuaaucaaauuuagaauaauccauucaaguuaacauuuguugaguuuguaaccaugugccucuggugacauacaaaaaugaauaaggagaccacagucuaggaaaaaaaagaaauguguauuacuguacaaaauauaacaugauaaauuucaauacuaauuuauaugaguaaguacugugggaacccagagaaugaaggaaaaacaaccaaauagaauuggggaacauuuuucccaaggauaggauggaggaaggccuugaaggauuaugccuuauauuugcuuagugcuuuacaguuuccaaagcgccuucauaaauauacucaauuuaauucugaaagauacccuagaggagggcagcacagguauuuccccccaaauuuguagaugacaaagcacacaagauagcauucauuaucuuaacgaaggauaaccagguagcauggcuaagacugaaaugugguucuuuuaacucucaagucuguaguauuuccucuaaaccauguaauauucugggcagaagagaauaccuuaaauaaaaacauugaggcuugcaugugccagguguuuuuaaagaaugucauauaacuauuugccuagaauaucgaacaaaugguaagagaugaagcuagaaagguaaguugaaaccugacaaagaaacuguaauuucagaguauucaaauucuacacuaagaaguuugaacuuuuaagagcuuuaaacuagagagacaacaucugcuaggagaaaaauccuaaugggucuaaaguggcuuaccauagaguaaaaggcaucaagauuggaaaaggagaagacagacuguauugauuugcagaagacaugauaaucuauguaaaaagucccauagaaucuauuaagcuacuagaacuauuuaaaugaguuuagcaagguugcagaauacaagaucaauauaacaaaaucaguuguaguucuguauagaaacgaugacuauucagaaauugaaauuuaaaauaccauuuacaauugcauaaaaauaugaaauacagauaaaacugauaaaagauuugcaagaccuguuuauugaaaguuacaaaguuuuauugagaaaaauugaaguccgaaauaaauggaaagauauauaguguucauggauuggaagauucaguauugauaagaagucaguucuucucuuaaguccuguguaaacaaauuuuuuagaaaaagauaagaagucuguucuucucaaauucuuacacagacucaaagcaauuuacaucaaaacuuuaacaggcagccaggugcugugauccacaucuguaacccuaacacuuugggagaccaaaaugggaagauugcgugagaccaggaguucgagaucaacccgggcagcaaagcaagaccucaucucuacaacaacaacaaaaaucucagcaggcuuuguuuuuuuuuuuuguuucuuuuuguuuuuguagcaaaugacgagaugauucaaaagcaaaacaacuuugaaaagggaacaaaguuggaaaucuuuuaguaccugaauuuaaggcuuauuauaaaaguuacagcagucaaaacaguugugauauuagcaucuagacaggaaaauagaucaauggaacagaguagguaaauagauucaugcuacguguguuuguguguguguguguguguguguguguauaaacaacagauuuucgacagaggugcaaaagcaacucaguggaaaaagaacagucuuuucagcaaaugguauuggaacaauggauauucauaugcaaaaaaaugaauuucaauuuguuccuugcaacauauacacagauuaacucaaaauagguaaaauaugaugucaaaugugaaccuauaacuguagaauuucuagaagaaaacagagaaaaucuuaacaacuucggguuacucaaaguuuuucaguuucuuagcuaugacaaucuaauaaauaguguuucuuucuuucuuucuuuuuuuuuuuugagacagaguuucgcucuuguugcccaggcuggagugcaauggcgugaucuuggcucacugcaaccuccuuccugguucaagcgauucuccugccuccaccucccgaguagcugggaccacaggcaugugccaccaugccuggcuaauuuuguauuuuuacuagagacaggguuuuuccauguuggucagacuggucucaaacucccgaccucaggugaucugccccccucggccuuccaaagugcugagauuacaggcaugagccaccgugcccagccuaguguuucuuuuugaggaaaacaguucuguaaguuauugugguaaugauucuguaacucuuugaauauucuaaaaugcauuuaauuguguacuguaaauggaaggauuauguggaaugugaauuauaucuccauaagccauuguuaaaaaaguuaaaacauguaccuaccaugugacucagccauuccacucuuagguauuuacacaagagaauugaaaacauauguccguaugaagacaaauguucauagcagcuuuauuuguaauagccaaaaacuagaaaaaacuuuaaugucuaccaacauuugaaaggauaaacaaauugugguauauucauaugauauaauauuacuuagcaauaaaaaaagaacaaacuguucuuacuguauggaugccuugaguggaaaaaggcagacaaaaaggauacauauaguaugauuuuauuuauauacaauuuuagaaaauguaaacuaauauauaggacagaaaacaggccaguguuuucguagagauggcagggaaggucauggggaggggcaagcuggaggacuuaugguggaacaagaggaaacuuuugggggugauggaaguguuggcuaucuugauuguggugauuuuucacagguauauacauaugucaaaacaucaaauuuaacaccuuaaacaugaaauuuauauuaaugauaucugagaaagcaguuuuuaaaaauaugaauggauucaacaugauuuuaauagauauauaacacugucaagucuguguuuuagaaagguauggaaaauggauuggagaacagagacacaacuaccauauucauuuauucagugaguuaagugauuucuacuaugcuagacagugggggucaauaaagcucacggacaaauggaagagagauauguaaauaagucauuauuuacauauaaauaauuuaucuguaguaaguacauauacuuauguauuagcuacauaauuaagugucauuaugcauauauaauguauauaaugcuaauuaugacaguuauguaugaaauaacucuggcuuggguugggggaaguuagaaucuugaaggaugaguaaaaaucauaauaaucuugagugugaaaugaaaaaaagccugaaguagggcagugaggguggguugacaaauuagaagagucuuuaaugacaaauucaguaguuuggauguggaaguguaaaagagguaagagccaaagauuuuuuauuuagaaugacuaaauuuuugguggugugaauaauagaggaauuuaggagaaggaggggauggaggagaaaaguucaguuuuaaaguugacuuggaaguucccaugggacauccacuugaagauaucuugcaaguaguugaaaguauaggcauguugcuucgggaagaagucagcacugagaucauagcucuuggauucauuauugcacagaggacugaucaaacuauaggaguaagugggcuuauucaggaaggguauagaaugaggaaagaaagccagugaugaaacuugaggcuguccuuaguguuuaaggaacaaggaccaagaagcagagggagaaacacugugaggauggaggaugucacacuguaggaugaaaaugucugggagaagcaaugaaauugauaaaucaccugacauguuuaccaguuggaaaauaguauucagagaagaucuuauuguucuguuagagaguucaaaaaaacuguguaacaggaacagaaaaaaguaagccaaaaacaaaaaaaguaaugauuauaggagaauaaaaaguuuacaaaaaaggaaauuuaaucagcagcaugcugcaugacucagaugugaaauauuuaaacauaaucauaauauuauaaacauuaaauaaauuuaaauaaagauuaagcuauaacaguauugguagaguaagaggcuacagugaaagagaggucaaucuucauuucccauagccaaaagccaguaaugucuaaaauugaaaaaauucaagaaaaagcaguauaaauauguuauucagaaauauaaauggugauauagaagaaaccaggaagaauggcaggucaggagugaaaaucagggcauaaggagccaugagauaggggaggauuguuuucccucauuagccauauauaaugaaugcuauuugucuuuguaaaauauuuucauguaacuuggauaaaauuaaaauuaaaaagacaacuugccagucacuggaaauaguagcuguuaauuuguagaaaaugccuuagcuguuuaguuagaugggcuuaauucugaaaaugagaauacuauacaauaguuuucaucucuuuccauuguaaaugugugaauuucuaagcacuguuaauccuucuuuuuauuuccguagguugaugaaaaaaccguaggagaaccugguuggcuuuaugguaguuuucaaggaaauuuuggcugguuuccaugcaauuauguagaaaaaaugccaucaagugaaaaugaaaaagcuguaucuccaaagaaggccuuacuuccuccuacaguuucuuuaucugcuaccucaacuuccucugaguaaguuuuuagcuaacaguaaaguuuauauagaucugcaaauguguaaauaccuaauauauaauggugucagccuacuacuucaucauaguguaauccggguuguacucuucaagacuacuuuuuguuccagauuuaauacugaaauuuaguaagugaaaacaugggucaguaguuuguuaauaauuauuucuuuucccacaaauuguguguaagcacaguguauauaauauguaaguugauaaauugguaguacuucauuaaguucuaaacaaauaaauauacuuauaucaaaguguuauauuugcagaccacuuucuucaaaucaaccagcaucagugacugauuaucaaaauguaucuuuuucaaaccuaacuguaaauacaucauggcagaaaaaaucagccuucacucgaacuguguccccuggaucuguaucaccuauucauggacagguauguugucuguuauuuuugugggcuuuauucuuugaauuugcuccugauuaaaauagaaugaaaauuauauacaaaggaccauucacucauuuaaccagaguuuguagcauucaguuucuuucuuauucacaugugaugugaaguugaagaaaugacuauuacuuagagguuucucaacaauuuuuuuuuuuuuuuuuuugagacggagccucacucuguugcccaggcuggagugcaauggugcagucucggcucacugcaaccuccggcucccugguugaagagauucuccugacucagccuccugaguagcugggauuacaggugccugccaccaugccuaauuuuuguauuuuuaguagagacgggguuucaccauguuagccaggcuggccucgaacuccugaccucaggugauccaccugccuuggcgucccaaaauguugggauuacaggcgugagccacugcgcccggccuagguuucucaacaauucuuuuccauaauaccaaguugcuagcagcuaagguuucuaagcucaaaauguuauuuuuacaaaucucaugauauauuguucuugauuuguaguuauuauaauaagaagaugagagacuugggcuugacgguuuuuuuuuuuuuuucuuaaaguuauuugggaacguuagaacuuuuuaacguauauuuagccucugauuuagauauaacuauugcaauaggguuacauuaacauuauuuuuuuaaauugcagacuucaucagaauaaaguccaaaguccuccagauuucaccuucacucaaaaaaugccauggccauagguuccaggcauuuuauuaugugcuagaaauuuaaggaaaaaauaagucaaaaaauaccugacauugacaccaggcacagugacucagugccuauaaucccagcucuuugggaguccaagaugggaggauugcuugaggccaggaguucaagaucaaccugggcaauacagcaagaccucaucucuacaaaaaauuuaaaaauuagccgggcauaguggcaugugccuguaguacuagcuacuugggagguugaggugggaggaucacuuuagaccaggaguuugaggcacaauuaauuaugaucauaucacuguacuccagccugggcaauagagugagccccgucucuaaaacaauuuuuaaaaaccagaaacucaccauucaguagaucauaaucuaaugaacaugacagacauauaaauaacuguaaagcaugagaaaugcuguauuaaagauaucuacaaggucuguaggggguauauauagaagagaucaucuuacucaauuggugagaauuggagcagccuucacaaagggcaagguauuugaguagggucuucaaagauaagauuucacccaacaaagaaggaaaguuauucccaugaaagaacaauuuggggaaagucaccaaggcauguuaacacaagauauuugcaggaaacaagcauuguuaauaauauggcuggaauacaggauucauggagaaaggguuaagcgaaguuggagagagagguugagguuuauuugggaagcauuuaauaccgugcuaggcaacuugguaguggaaagucccugaggauuuuuaagaguggaguuauuguguauguuuuagaaagauaauucuggcacuaacauaaagucuggauuagcagaagaaaacaaccaguuaaggaaggauauuacaauagcuaaauaacaagagaugaugguuugaacaagugcuaugguaauuaagauauaagaaagaggagauagauuuagaagauuauuaggaaaugauauuaaauagauaauccauugaauguggagagugaggaagaaauaggaguuaaagauaauucuucagucuuuagcgugagcaaccaaaaggauaguaguauccuugucuuugguagacagugcaggaggaauggguuugguagguucuaaaaaugauuauguuucagccaugcuaaguuuaagcuauguguauuagggacagcuugguagaaacacccaguaggcaguuugauauacaagucuggagaucaggagauaaaauuacacugaaaauauagguuugagaagucauaggcauaauuaagaguauuuagggaaguccuguggaacaguaagggaaaaggguuggacaaaagaggagccaucaaucaccagagagucagcuucaggaacuacaaggcuugauguuagcuguuuagagaucaagaggaauaaggguuuggaagaagcauuuggcuuugauguuauuauuaauaaccuugucuggaagagguucaguagugugaugagugcugaaccuaaauuagaagugaucaaggagugaaauuggaaaaaaaguuuaagacuaucauuuaaggaauucagaaguagaagcaaguagagaaguagauugaagagaaggacuuaaauauuuuuagaaaaugaaaggguauaauagaagacuuggagaauaagugaagaguuuagccuuauuaaaggaacaaaacacuccuuccuuugagagaggagggaaagaaagaagaaugaauagaauagaauaggaggaaguuaagagaaaagcagagaaacagagggagccaagcaugccaauuuccuucccuaguggaguaaacagaauuacauugcaagcuggaagagaaaaaagauuuacaguaacauuccuuuuucauuuguuccaugauauguauuucauggaugugugaauacauuucuugaguacacauuauuuaccuucucuaccagugaugugaugagguuucuuugaaugguggguuuucagucugucuuaacagaaggcuagucacauaguugucuaucauguauaauuuaaagucaguuaguagacuaagguuaucuuaagucaccacgacacaaaacuggucugcuguuugaacaguaaguauguuauauacacagaaacagaaaucauaguuaccauugccuuuuaaaaauuuuuggugguuuuguauucauagggacaagugguagaaaacuuaaaagcacaggcccuuuguuccuggacugcaaagaaagauaaccacuugaacuucucaaaacaugacauuauuacugucuuggagcagcaagaaaauuggugguuuggggaggugcauggaggaagaggaugguuucccaaaucuuaugucaagaucauuccugggagugaaguaaaacgggaagaguaagcaucuuuauguguuuucaugagauguggauguugguauuuucacuaaugagucagccauggucugauugaguguauaauaaaauaacaauuuuauacuugaguuugaauaucagaaagguaauucuggccggccgugguggcucacaccuguaaucccagcauuuugggaagccaaggcaggcagaucacuugagcccagggguuugagaccagccugggugacguggugaaacccugucucuacaaaaaauacaaaaauuagccgggcauggugguacaugccuguagucccagcuacuugggaggcuaaggcaggagaaucucuugagcccaggaggcagagguugcagugagccaagaugacgccauugcacucuagccugggugacagagugauaccccguauuaaaaaaaaaaagaaaaaagaaagguaauucuuaggaugaaaaaagcauaccucagguauuuguuucaguuuagaauaucuuucauucuaguuauuucagauuucauaaaauuuucaagcuacucaaaauuauagaucuguugcuuuuuuuguuuuugagacagggucucacucuguugccuaggcuagagugcagugguggaucauggcucacugcagccucgaccacccagccuuaagcgauccucccaccucagcuucccggcuagcugggaccacaggugcacgcuaccaugccuggcuuauuuuuaaauuauuuguagaggugggguuuugcuguguuaccccaggcuguguucucaaacuccugggcucaagcgaucuuccugccuccaccucccaaagugcuggaauuacaggugugagccaccucaccuggccacuucuuuguaccauaaaucaguuagaaaaguuacuuuucauuuucuuucaagcauuucuccccuguuuacuauaaauugucaauauuuaaguaacucuuuacugagggccuccucuuugccaaauuggggcauucccauuucugagucuccaagauucccugaauauaacuucucuuauugcuuauagcacucugcauuauaguuacugauuuuuuuaaaccaaugucccuuauuagaucauaagcucaaugaggcugggaugcaugucuuuuuuuuuauuuguucauuuuucaguuucuucaugccuguucuaauccucaugcauaguagcugcucaaucauauuagcugagugaaugaagagaggcgugaaugaaugaacaauugaaugaauuuucaaaugaaaaaagcuaaaaacuagauaggucucugaccuuuauuuccuacucuguagggagucaaguugucgaauauaauaauacaaggaaauaaguacuauaauauagcuauggguaacugucucuuguguuuuauauggaaguugguagaaaagcagucugauuugaugaaaagaugcuggucuuuugcaaucaagaggcuugaguuuuggcucugcuauuuuugccaggcuguaaggaauaaccuacuuaaucuucaguuuucuaauugacugaaugaaaagguuaagccaaauaaucuuuaaagacccuuucacugcugaguuucuguguuucuggaagguagugcuguuucuaaaaauuugcuuuucagccugacauggaauuuuggauugauugauugauugauuuugagauggagucucgcucuuucggccaggcuggagcgcaguggcgcaaucauggcucacugcaaccuccaccuccuggguuuaagcaauucuccugccucagccucccaaguagcugggauuacaggcauccaccaccaugcccggcuaauuuuuguuuuuuuuuguuuuugagauggaauuucgcuuuuguugcccaggcuggagugcaauggcccgaucucagcucaccacaaccuccaccucccggguucaagcgauucuccugccucagccuccugaguagcugggauuacuggcaugugcaaccaugcccggcuaaauuuuuuuguauuuuuagcagagacgggguuucuccauguuggucaggcuggucucaaacucccgaccucaggugaucugccugccuuggccucccaaagugcugggauuacaggcaugagccuaauuuuuguauuuuuaguagagacaggguuucacuacguuggccaggcuggucucgaacuccugaccucaggugaucugccugccuuggccucccaaagugcuaggauuacaggcgugagccaccaugcccagcccuuuuuauuuauuuuucaagacagagucucacucuguagcccaggcuggaaugcaguggcacaaucucagcucacugcaacuucuaccuccuguguucaagcgauucuccugcuucaaccucccaaguaacugggauuacaggaaugcaccaccacaccgggcuaauuuuuguauuuuaguagagacaagguuuugccauguuggccaggcuggucucaaacuccugaccucaguugaucugcccgccucggucucccaaagugcugggauuacagguguuugccaccacaccuggccgaauuuuggauuuagaagaauauaauaacaguaacaacaaccauauauagcuggcauuuguaugcaugcacugugcuaggcccuuuauagacaauuccuuuauagaaauugucuuauuuuauguccauaacauuuacagagaagaaaacuuaagcaaaaacagauuguuucaguguuuuagagggcauuucuucuaacuaugcauucaguuacuaguguuuucuaacagauaaggcauauaacuugaaaaccugcaguaauggagaauuuagcauuaaacaagacaguccauucaguugugaccaguaguuguaauaagguuccccuucuguuuauuuaaaaacugccucacaguguaauuuacucacagguccuagggaggccuggugcaucccacaggugucuaguuaaacaggacagucuucuagauuuuugaaaacagauuccuggguuaaaauggaaauuaauguuauagcuguucugagauaauaaaaacaaaguuuuauuauuuuuauuuuuuuaauguagugcauucuaaacaaauaauaaaauguauauauugccuuuauuuuuuccuacacuaaacuaagcccuauaugugcuuaccacuuaacaauuugugggugucuuuuaaguuucuuuagaaaggcgaaauaucucacauuugaaaaacuauuuguaaaucauauugaaauuuuaaaaauauauuuaaaaauguagaaguuuauaauuaggcuguucuuaauccugcaggauguuguguauaagucuucccaguucuguguacuaagacuauauuuaauuugagaaagcccuaaaaaaugcacuacuaaaaccugcugugcaucaaaucaccuuucuuauuuuugcuuguauuuguuuguuuguuuguuuguuuguuuauauauuugguagaccagaagcuuuguaugcagcuguaaauaagaaaccuaccucggcagccuauucaguuggagaagguaagcuuuuggcaauuuguaaauuagaugguaaucaauuuagcucuugacuaacuaccugacuucacauaguugcuguucuucacauaguugcauauucuccccauuucugugucugcaguauuaaagugagauuaggaaaaccugccccuaucuauuucacaugaauauugagaauauagaaaaaauaugggugaaaauacuuggcacuuuagaaaggcagugcuaugaaaauucagcauagacugguuugaugaauaacaucauaaauaaaaaguguugcaauuauugauuauagauguuuaggagguaaggaaauuucaauacauuucauugcuuauacauuuuaauuacaauguaccauaugaaucauuaaggaggaccaagguauacuuuaucauaaguauugcaaagaauuuuuuucuauaucccuuuggguuguuugauuaguaaauuauuuugauuuuguuaauguguugaaaaaugaaagauuacccuaauuucagaggauauuuuuauuuaauaguuacauacauuuauaaaugaaauguauaaguccauuauaaaguuaguugaauaguugagguacauuuuauguuuugcuaaaaauaucaguuuaauguuaaacaauuuauucaguaucuguuacguugaagauucuaugcuagagccuggaaaauacaaggaugaauaaaaguuuccaaagugcucacaauagaauggagcauacaguugugauaaauucuuuaaugagcgaacaaaaccaauuuagaguaggacauaugaauccacagagauggcaguguugcaucauccuaaacaaugaguaggaucuagcagagugacaaaggaugagaaugcacuucuagacagagggaauggcaugagccaaggaacgggggaacgucaugucaccagugaagcugaaucauagguguacuguggaaugagugcucugagcugagccuaggaaaguagugaggagcauguuggaaaggacccgacuuuuauugcagcguaccuaaaccuuguaaucacuuugaauuuuguuaaauuaauugaguaauacugggaaugcgaauaguaaauagguuguaggugguguuucucaucgucucaaguuuaugauauuaagaucaaauuccauguuggccaaauauaaauaaaacuagaaagaaagaaaaagacuuagaaaaccaagucaccaacuguuucuucuaagcagugacaaucacagaaacaaaaaucaaaggcgauauaaaaauuuagauauuucccuugaggucauuuguuaacaacuauuuaucgagcgucuacuccaagucaagcacugugcuaggagcugggucaucaggauggagcuuggcuucuagugcugcugucuucuggguauugaguguuuccauaacuguguacuuaaaagaauuaaagagaaaauaauauagcagauuaaacuauuucugguauaaaaaaguuaaaaaauauauuuuccuaucuugacuccauuaucugaauaacugagugacuuaaucucacuaagccucaguguauuuaucuauagagauacuauuaucuguuuguaguuuuggguaauucuuugugauaaaaaaauaaacaauugggaauaaaagaaacucuaaaguuuuauguuaagucaaauaacuuuuuucuaaggaauuauuaaauaauugcuucguuccuuuuucuaccuuuagaucuuuuuauguuagguuuccugaaggcacaaggucuuuuacagcaaacuuauacaaugucuuggagaauaaccuaauuucuuuuucacuucuguaaucuuaaaaccagaaucuacuucuuuuugcuuuguucccuacagaauauauugcacuuuauccauauucaaguguggaaccuggagauuugacuuucacagaaggugaagaaauauuggugacccagaaagauggagagugguggacaggaaguauuggagauagaaguggaauuuuuccaucaaacuaugucaaaccaaaggaucaagagguauuuugauauuaaaaucaacccauucugguuaaucagguuuauacuuaaauuauuuugguauuaaaaauaaaaucaacccauucuuguuaaucaagauuuauacuuagagaucauguuuaugguuuugaucagguugcuuugguuacaaagaaacuguucacaguagcuccgguaaaauaggguuuauuauauggcuccaguuagauaaagggggcaagauuucaugaaauucuaagaacaagaguuguaggguaggguugagcuucaugauaacugcuaggaaguagaucuggauucagagaaacacaaaaaggaccaccuugaaguaguucgccaauuuucacuuuaagacuguaacauuaaugugacucagcuuacaugagcuccugccucauuucauccaccaccaguaugguauagugcagaaguucucuuuuugguuucaggaacuuuacagucuuaaaaauuauugaggaaccccauaggcuuuuuuaaaguauguucaguauagcuaaugauauuuaccguaucagaaauuugaaaagcgaaauuauauauuuauucauuuuaaaauaacaauaauuaaauccauuacaugguaacauaaauaacgugcuuuuaugaaaaacagccguauuuaucaugaaaacaaaguuuagcaagacacacacacguauauauacguauacauacauauguauguguauauguauauguguguguguauauauauauacacauauauauacacauauauauacacauauauauacacauauauauacacauauauauacacauauauauacacauauauauacacauauauauacacauauauauacacauauauauacacauauauauacacauauauauacacauauauacacauauauauacacacauauauauacacauauauauacacacauauauauauacacauauauauacacauacauauauacacacacacacacacacacacacauauauauauauauauauauuuuauuuuuuuuuuuuuuugagauggaguuuaguucuguugcccaagcuggaucucggcucacuacagcuccgccucccagguucaagcaauucucgugccuuagccccuugaauagcugggauuacagccauccgcuaccaugccuggcuaauuuuuguauuuuuaguggaggcgggguuuuaccauguuggucaggcuggucuugaacucccaaccucaagugaucugccugccucagccucccaaagugcugggauuacaggcaugagccaccacacccagcuaauuuuuguauuuucaguagagacgggguuucaccauauuggccaggcuggucuugaacuccugaccuccagugauccaccugccuuggccucccaaagugcugggauuacaggcuguuuuauauuuuugcaaaucucuuuagucugacuuaauuaagucagcuacuuucucaugucuguuucuguauucagucggugacauuuuuuuuuucgguugaaguauaaaaaaauucauccucacacauacaugagagaaaaugaagaaguauuuuaauagcauuugcagauaucuaccaauguucuuuuuuauucuaccacacuaaaacuugacaaaugcugaaucguuauagguuaguugcaacauggaaucugaagcccuaucggugaacaguucuuacuguuacauuaaaauucacuagucuguuuugcauguugaguggaucuuuuacccgugcaugaugugauaacauuauuuguuguuuauuuggaaaauauugaaucacugaguuaugcagauauucccuguguggacacauuucauuacacaguaucugaaaaaucguauguguuaauaccaccacucaucagaaaaguuuuucaauacuaggaaacugucagacucauagugguagguacaaauuuucuaaaauuuuaauuuucccuggaaaucuugaauuuuaucauuggcaaaaaauccugccagcuguuuuccuugaagggacaggcuuacuucauuuuuaagaaaauguucgcuaaaucccaagucuaaauaguuuuucuguugguucuuugaaguaaaaauguuguuccaugaaaaaccuaguugaguggacaauuuagucacacaaauacuuuccuuaagacaaccgucauacuuuaguaugcagcacaaauguuuuaggcacacuucuguuuagucacacagaacuuuuaaaagguauggacuugaagauuaagauuuaauaaaauuuuugcuguuucauuaaagacauuauuaagugaaacuggcuuuguuuuacugugagugcauggcggugaagaacacuaccauacuucagugucauuuggugccacugccaugauucacacuaaagcaccaaugauuuuacccaccacuguaaaugucaacacagugaagaagacaaauaaugucuuaguauuuuuaugaagauaguuuuuaucccacagaccccugaaagaggcucaaggacuauuuccagguucuacaaaccacaugcugagagccauugguguaguagaaucagacugccuggguugacucuuagcuguaacacuuagagccugggugaccuuggacaaguuacuguaccuuucugugccucaguuuccuucucuguaaaauggggauaaucauaauuacuuaauaguguuauugugaaaauuaaauagcagaauauauggaaccucuuagagcagugucuguuauacaguacucagaaaauguuagcuuuuaacuaccauccacucugcuuaauacuuguacugcagcuauguucacuaacagaacaaaauucuuuuuaaucccaucccuuuuguuguucaaauuccuauaaagaggaaaugugguugggccaguuuauccuuuaaagugaaacagaaguaauaguugcuacacaggauagggauuuuuuguucuuaggucagauucagucaguuuggggggaggaugguaaaauaaauaaaaauaaaaacauugucuccuguucaucaagauccauagauaagucaggaucccuuagagaaagcaggagcaaaauaacguauaccuugacauauccaggacacauauguugugcauagugggcauuggugcuaacgccauugauaaauggagugcauuuggccuggagggucauguuuaauauuuagguuucagaaaacgagcucuuccuguugagucaaugguugacgaugacagccacucguauauaauguauuacauuagcagaccagaucuccucauaaguguuggauuuuucacuuauuuguuaauacugcaugagguucauugucauuuucaucuucauuuaaagagaaaagaauccugggaauuugaaaucucuaauucccauuaaccuuuauacuuuuacauuuggauuguuggaaauaauaaaacaacacgguaucuuuuccuuguagaguuuugggagugcuagcaagucuggagcaucaaauaaaaaaccugguacguauaguagugaucuuaaaaaauuacuaacguguuugcucugucgcaaucuugaauucauaguuucuucuuugucuuuucagagauugcucagguaacuucagcauauguugcuucugguucugaacaacuuagccuugcaccaggacaguuaauauuaauucuaaagaaaaauacaagugggugguggcaaggagaguuacagguaauauucuuuaaauagcaucuauaaauuuuauuauaaaaguacugcaugcuccauaaaaaagauaaaauuaauaaaaauuuuuagaucacccauaaucauuccacuuagagguaaucaauaucaauauuuuacugcauuauauuuccuuuagucucuuguguguacauuuuuagcacaguugaguugauguuauaaguaacaauuuaaggaauaauuuucuccaaagacauaauuguuuuccaauaaugcauuccuuuauaauucacagaucauguucuuaaagaaacagcaucaucuuucccugggauagucccaggcuugcaguauagccucuaggagaaagacauaaucuagauggugugcugagaaaauacuacuaauugggcuguccgcuaguggucuuagguuuuugaaacagcagugcaauuaaagacaauacagacauagaugaaccuuuuuuuuuucccuaaaacguuaauagaugguuauugcauauguuuugauacaggaaaaggguucuucucucacuucuauuauuuccuuacuaguuaaaacuaaaaagcauuuuagggauuaaaagaugacaagagauauaauagcuauauuuuuauaugagugauauauaauuguaguauggaggauaaacauagcuucauucuugcaaaucaggagucuuaggauuccugaagaaaaauggggguucaaauuuaauaccuucuugaauaacccccugaaauuccaccuucugauuuacuuugaagauggaccgaacuaagugggaaacaugacucuuuacaaauuuuacuucugaccuccugauuaaugauuaacaaagcuccaagaaguauuuguagucggcugcaccauuuuaaggguuaggagaacucuagaaaugucuuuuuagaauauaaauauuuuugugaaauauuccgagaacucugagccugaaagaccuccacauagacuucuucagaugcuguuuucagcaguaguuugagaugcauguuuuagugugucuuccaguuguuuaauguuuacuugaaaggcuaaugcugaguucgaggcccccaagaucaugcucauauuugaaaccaauuccaaauuugggggucuucaagacuacucucaaguucuguaagucacuagaaggacuuuacagaacucacuacagcuauuacacucauguugcaguuuauugcaaugaaaggauacagauuaaagucagccaagggaagagacacauggggcagagugcaguagaguuccaaaaacagagcuuccaguuguccucuccuggcagagucaugaacaguauuaacuccuccuggcaaugaugugugacaauacacacagaguauugccagucagcaaagccuuggugugcaguuuugacugggguuccucacauagauacaguugauugcccguuuuucugaacucagucuccauccccuaccaagguagagcugauacugcaugacccaaagcacaucacauuguuagauuuggcaugacccaguacccacagguaaacuaagacacucugaccagucaggauaguccaaggauuuagagauuacuuuccaggagcugagggcaaaaaccagaccucucuuuaggcaaaauuaaauuauuuacuacacauuuaugguuuuucuaauuuuuaaguuaugucucaaugauuguuuuuaaucucaucuuucaauuauguauuucuuuugcuaauuuuuaggccagaggaaaaaagcgacagaaaggaugguuuccugccagucauguuaaacuuuuggguccaaguagugaaagagccacaccugccuuucauccugguauggaaguggguuaauuuguauuucauuuuagaggaguuuguuaaaacucagcaacuucuuagauuagcucaaucuuuggaaaacauuaaaaauguguucuuuccuuaugucugcuuaaaagggacaugccacugagaauuuccuuucugaaaaguucaguguaggaacagccagcuuauucacugauacuugaaccacuucgacucuuugaaaucuuucaaugugaaauuguuacaccaucauacuuaaagugaaguacuucacuuggauuguuaacugcaguugggaaauucuuguuuuuguaagaccaggaauaggggaaggagggugagaaagagcaguucaagggaaauuuuagccuaauuuuaauauuuaauauuaaaauaauuuaaauccuagggagauuacaaaugauugacccuugcaggaauaauuaauuuguuuaauguguuauuuuguuauucuugugauaguaugucaggugauugcuauguaugacuaugcagcaaauaaugaagaugagcucaguuucuccaagggacaacucauuaauguuaugaacaaagaugauccugauugguggcaaggagagaucaacggggugacuggucucuuuccuucaaacuacguuaagaugacgacagacucagauccaagucaacagugugaguaauauuaaauuauuuuucucucaccuagugugaaacuucaauauacagcacugcauuuauuccuuuucuggauuagaucuuaaacucagcacucacagcaaauguagauuaguguuuaaagugagaagaaacaaaaggaaacuuuuuacaaggucagaaguuauacagcuuuauuuuaaauacuugcuagcuccagacuuucguauuagacuuaaucugagaguauauaauuuuuccuaugaguucuuugguaugacugccaucuauacugcagcuucuuuuuacuaucauccucuuuuucagugucccauguucuuuuuugguuuaauaaaaaguagcuaguggcugggcgcaauggcccacacccauaaucccagcacuuugggaggccaaggcacgcaggaucccuuaagcccaggaauuggagacuagccugggcaacauggcgaaaccccaucucgacaaaaaauagcaaaauuagcugggugugguggcacgugcuuguaguuucagcuacuugggaggcugaggugggagaucucuugaacccgggagguuaagagugcaguaagucaugaucacacacacugcacuccagcaugggcaacaaggugaaacccugucucaagagaaaaaaaaaaaaaaguagccagcaauuacccuauucaccuauucaaaauuacucuuuuaguguacagaagccauuacauuucuaaccuucucauuuauuucucgcuguuuacauaucauccauguuggaagaaaauuaaaaauuaaauauuugacuguugcaaaauucuugucaggugauucuuuagauagucaccuuuuuccacaagggauguaucaaucaaggucuauuucauuauuuucagaacaaggguccagaucucgaagugugaaguuugguacuauauaaaauuaucucucuguauuuaucuagccguucuuuugguugacaguaaauauagcauuaguaauaaauuagggaaugaauaguacuuggaaauaacuuuuuaccuuuaugaaaugauugucacuuuuucccacucuuuuaauuuuuaguuuuauuuuuaaaauaucucaugauauaucucuuaugaaauuuaaaauacuuagccuuucauuuaaauucaguugcugagaauauauaaaagguaacccaaacaaaacucagauacacuuaugauucaguauaaggauuaugaauuuauaccauaucuauaauuuugugcauucucacuuuagagcuuauaaagauaguucugacccugggagaaaccuucccuuuacauaaagcaacuaaguuucccaacuuggagaugggaggaauccaguuuuuugugauuugaauagucccaaaaauauuggaggguuucagaagugauaaagaaaauuguaacuuggguugccuaauaaaugaucauuuuuaagcucugcugaugguuuggcaguucacaaugauuaauuagaaaccaguuuaucuaacuagcuguggcaucuuucuugguguugagaauggaaaagacuuuucagaccuacuggguuuggaagaucuuuggcuagugaucccugaaggcaugccggugugucaguacauuuggcuucuauagcaucuaugaucuaaagugaugguuuucugaauauguuguugugguuugaaacacuuuuuccaauuaagccucauagaauagggaauauaaagaacagauaaaagcuguuugaaaggaaggacaggaccauggccccaggucuuauaccuuucccccgccuauuuuaugaagguccuuucaguuuccccucugcagauaauuuaaaaauuacucuagagaaaucuacuucaaggcaguaacagucuccuagaaaaguaacuuucccagagaguuaauugagugacaauuuuuuauuccaaaaagaagcagcauaguuucugguugucaguaaauguuuaauacacuaaugauacagaaaauagauugauaucaucuguuaguuauuauucaaggacacauuugucaugcaaauuacuuuugcccagaaaaugcuucgucugcuauuuuaguauagguggaacuggcagagccuuagucugccuguaguugagagagauacccaaucuaaacagcacuauccaguagaauuuuaugcaauacagaaaacagucuauaucuccacucuccaauacagcggccacuagucacuuuugauuauuuggaguguggcuaauacgacugagaaacucaauuuuuaauuuaauuuaacuuuaauuuuaagcuaaauagccacuuguggccuguggcuccuguauuagacagcaugccucuagaagacaaccaauuguaaugcaagcccucccugaaauaaaacauggaaauagcagggcugggcacaguggcgcacaccuauaaucccaacacuuugggaggccgaggcaggaagacugaucgucaauauagggagaccucaucucuacagaaaaauuuuuaaaauuagcugagugugguggcauaucccuauagucccagcagccugggaggcugaggugggaggcugcagugagccauggucaugccacuguacuccagccuggguaacagagugagacccugucucaaaacaaacaaggaaauauugaaagauuaaaauaagaagaaaaagaauaaucgucuuucggucauuauugaccuacgcaaugauuuuauagcuccuauguguuucagguuuuacucuuuugggggguuuuggauucuauguuaacauucuucccacuguucauuuaagaaauucaucauuugguauuacuugagugucuacucuguacugacuaggaguacugggaauacaaacaagacaagacaauccauucucugaaguagcuuuagagguuaguggggaacaacauucagauaaauauaacaauugcugcaaugaauauuuauacaaauauguuuuggaaaaagacccccuaaaucuuuguggagaaagaaggcauguugugaaagauacaacagaagauauuugagcugguacaugaaggauaaguacuaauuguuugcuggaagggcaaauguuggggaugcaaggaggaacucaucauuuucuuggucauuuuacauacugacagcugggaaaacaaaauguucaagagguuauuuuauaaaauaagaguaguuucgaauuucucuuuguuauaaaguuauuaccaguaacuuaccuauuaccuuguuucuggcggguauauguggguuuuuuuuaguuuaaucagaucuaaaaacugaauacuuuuauuguuuugccuaaaugaauggcuaaaggcuugucaucuauccuggaauaaaagggcucucaauucuguaauucuaaggauaaauucuaaagagguuccucugagaugguuuauuguuucuauaaaacaacuguuuaaauuaucuaggaaagugaggcguaccgauuuuguuuacuugaaguaauuauuuaucagaaauugaagaaucauaauugcuuuuucaaagaagaugaagauuaauguuaauuguguugguagcuaugaacucacauuguuuauauaaaccuauaauuuuaauaggauaugguucagaaaaugcuuaauccuuaaagucaggaauagauacgagauccuuguuguaccuacccagcuuuuuauagaugaaucaccuguuuguaguucuuguaauagucaaugaaagcuaguuaaauuauagauuaccauuuguguuucuuuggcccuuuuaaguauuauuuuucauuuuguuacauaauuagaacuuuuuuuaagauagagaauuuuaacaguucaaauuuguuuaguugauguugcauguuguuacuagucaaauuuuaucucacccaccuaauuugcauuauguucauuuuauuccucauuuucuuuuuuuaggacccaauguugucuuccaguugugaaagcaccccagagacccacuauccaaguuucacucuagcguggaggcagggcaggcagcccugaucaaauaucuccuacacaauucguuuacuucguuugaauguuagagccacuugugauuauuuuuuuguguuucuaacuuacaguuuaaauuuauuuguaaaaaguuaaaggauagugggucuuuguguggcuuucccugcuguucacucuggcaucuuuagcauuuuucuucuuuuuuaauuugauaauuguaggucauuagcaugcauauugaguuugcccuuauguggugggaguucaaacacacaaagacccacuauuugcacaaacuauucuuacugguuuggaauaggcugccaugcuuuuuuaauguuauugcaacauguguauucauuuacagaauucagauaaaauuugcuuauguucugcuauuauguuugaucuaauccuaaucacagugagcucuuaauuagcucaauaugugguuugcccucaagugugcacuguuuauuacuuuguaauaugccacuaugaguacugacauuuagauuuguuuaaaggccaagaacuggaaacagccaugcccuguuuucuguguauuugggaugggaauaacaacauuuugggggagcuuuuuaaaucucagagaagaggaaaguggccugcucuggcagguaugugcaguguuucauuuguuccagucccaagaaugagcacuguccuaugguaguucgcuuaggaucuuuaugugcucugggcuaaugaagguacugcaucaugugcugcagcguguguauucuuuuucgaugaccuauaaagggauuauuuuugaggaaugaaaggcucccaucauugacugugagaugggaaaaaccuuuccuagcuuagagcauuuauaucuuaauccauuuuaaagucagaguucauuguuaccuguuuuaaucaggugacuacaugucccaguauacaaaggggcacugguugacauucuucuuaauguauuuaguaaauaucauaagaaauccuuuaagaguuuaaauguccccaaaacagacaugugggcucuagucaagaaugaauuagagugaaggaaagcuguguaacaccuggcauuccucuguguucauggagcuucuuugaggcucuaagauugauuuuaccaucagacuucucuaauaccuguucuucaaccauauuggcuacuuugacauaagaauuuacuucuuuuccuggaauggaaaacacuuuaaaaaauaauaacaaacauuauuauaaacuaauauaugugagaguacuuaguugauacaaaaaggaguuuuaguagacaguauuauacuauauuugaaaaucaaggagaauuuuaugcaacuuaaaauguuuacaaacugcagugcaaucuacuguuugugaaugucaaaguaucaggaaaaguguauauacaaucacagagucauauuuccucacaaaguuauuuacaaagagugaaauauguuuuuguaccucucaguuucaguuagaggcauauuuugugcaauauuuauguuaaugugccuauacauuaugaaugaauuauuucagucauacauugccuaaaucauaacuuuaugaugcuugggaaagaaucaacaguuaaaacuucauaaaguuauaaugucuguguuccaaaauacaucacauuauuaggauguagggagauaaguaugugugcucccuaggguggcaauuucuaguuacuagaccaccucuauuuuuagcauuuggcauccucaugauacuuuuauaaauaugacauuaauaggaaagcaauaauuucauuuuacagauagaauaacagauuugccugcauucacugaaagagugcaaagacuggguccuugugaauucaacugacucucccaaauuguauuaauuaccuguucuugccuuuuauuuucugaacuugcugcuuuugcauucuuuugaguucaaagacaguuacuuuaaauccauuuuuaaacccucgggguagaaaucauaccacuguuaaucagccacauuauuuggucuaagguuuuuucuuuauaauucugaaacugaguuuaucuaauacauugaugaauuauuucaaacguauuuuuauaguucaaaucacuucacuuuuacacugauaaauauaaauuacugggaaugaccuucagacagcguuuagcaucuguaaccaaccugaaaauaauauguucaucagguaccuauggauuaaaucauauacuggcguauuuaagcugaaugucagucuggaaaauaaauuuacuauauuaacugaaauaccacucuuuguguagguauuuugucauguauuuaagaaaaagauaaaaagaauggaaaucauaugacauaauaacuuaagucuuucuuaaaagugcaugcugucuuuugcaauaccucauucagccaaguauuuguucucuuccucauucaguauaagucagcuuucaauuugcuuagaaggcaacauuagaagguuagaguucaucagaaacauagaauuuuaaaaugugaguucaacugaauaaauuugaauuucuguaggagguaaagaaucaaaauaccuguuuaaagauugcaauugcaauguauaauaaucacuuuuaaauuauuugauuaaaccuuuuagguuuuccagaaaugaaaaaaaucaguucuaaaaccaaagcugauuuuuagaaaauuugagaauguaaaucagcccuauccauaauauaguuucucuaaaacuuuaucuuaaagagucauuuuaaaauaauauaacuauuaaaaauguaacugauauuuaaauguuuugaaauaaaacauuuuaaaauauaaauacuguaguuuaaaagaaagaaacugggggaaagaaaaguagagaaagaaauaccaauuccaguccaaagcuuuauuugccagguuuucuuagaaugacuuuuaccaguuuaugaauucuuguaaacagaaucuauaauggaaauacugaaagacuuuugccuaaaguggcauuauugaaugcugcugugaugcuacuguaauguaauaaauuauuaaauuguugcaaagugcuguuuuugccuuaaaauuuuauuuugugugucuugaaaauuauaguauuaaagguauugagauugugcaaaugcugggcacgcuuggcaugagauaaucuguuuuuauuuuuacaaaauuguaauauaacuaugcaaguguguuuauuaaaagaacacaaacuauauuaguuguauuguguauuucuuuugaaacauucuuuaaaacuuacuuuuaauuguuuuuauuuagucaugauuaaaugucuuuggaaugucucuuuuuccuuaauguagucucaugagaacaggccagcaaauuguuuuauaucauagggggcaaaauaaauguauaaguggucaagaugaagauaauuugauuggagauaaucauauguaucucaaaagugaaauaaaguuugauuuuaauacauuguugcucacaaaaguaaggaaaacauaaucuaggguaauagacuuguguuuuuauaaguuuuacugcaacuuuuuucuaaaaagauuggauggaacuuacaaauuaauacucauugcaaauguagaguaagacuuuuaguacaaaauaagaguuuauguaaaagaaacagcagugaaugcuuggagguaucaaaguuaagcaguguuaaaguuaaucauguugguggucguauaagcccuuggguggaaagaaagauauggaucuaaauccaguccaucugucaacaucuagcacaaacaaccucuuuccaaaaagccuuuccucaucuccggaaacuuauucaacuaacauguaugaaguguuuacauaaggcuaagcaggugcuggggauacaaaacugagugucaaguggccauugucuuaggugguacauaguucuuugaggggauuaggcccauaugcagauaauuauaaaacagcauauucagcacagugauagauauuugccaggcacuuaaggacuacagagaaggaauaccaaauucagccauagauuggugaacgagagacuugcuggaggaagcaacugccagguccauaagauaaguagcaauaagccagauuugguggguaggaugguggaguguaugauaaagacaagaaauggcaugguggggaaguguaauuauaagcauuucaguaucgucagaauggaaauacagagccaggaacuauaaaaguugaggcuugagaggcaggccaagggcuaagucagaaauucucuagcucagcuguauguuggaaucacuugggaaacuugaaaaaucuauaguuuccaggguccuaauuuaaauggauugaaguucggccugaucguggggaucuuucaaagccucccauaugauucugauaugcacccaagguggagcaaaaaaugaugaaacggaguucugagggaaaauuggcaggaacuggagauagauggaauaugagugucgguggaaaagucaguuauuuccagauuugugucuugagggacaggaugggauaauggugccaccaacugcagugaagaauuagaguugggggaagaagaggaguuuggagcaccuaugggauguccacauagaguugucaagcagguggucagauaagauagacaacaucagauguacaccaccugguggaaugacauacauauugguaguuguugaaccagugaaaguagaugagauuacuugggaagaagaucagaccuccuagaagaucagcaguuaaggguuggauagugaaaggaacucacaaagaugggaaacagguuauaugagaaagagauuauuuugcuauuuucaugauuuuuaaaaaauaaugaaauuuuggcucugcaaccaucucucacaccaguaaaaauaaaagaggaaaagugcucuuuuuugaggacuucuuaguuuagauacuuuucuaagguccuugaauguauuaccucuucauuguuuucuuuuuugagauacagaaauuaaaacagauuagauaauuuguccaaguggaaccugcuaguaagcgguagaggugguccauggucuggcucccaaguccaugcuguuagccucuacacuagugugcugauauugccaccaucuccuaauaaugaacuucggcacuacaacuguuacucauaccagugaaacaaaaacaggaugguggcucaugccuguaaucccagcacuuuugagaggccaaggugggugauuaccugagccuaggaguuugaggccagccugagcaacuuggugaaaccugucucuacaaaaaaaaauaaaaaauaaaagauagauagauagauagauagcugggaguggugcugcugcacgccuguaguccuagcuacucaggaggcugaggcaggcaguucaauugagccugggagaucgaggcugcagugagcugagaucacaccacugcacuccagccugagugacagaaugagacccuauguccaaaaaaaaaaaaagaaaaaaaaacacaggaaaaaucagagauugcacaggcuuuucucuauguaaaaaggacacacagagaagagucaaggagucaaagacugaacauaauaaacaaggacaagacucuaugacaauaguauccagaaggauaaagcugaauguaaucacuuuuuuugguaacagcuucauugagauacaauucacuugccaugcaauuggugguuuuuaguguauuaacaaaguuguccaaccauuuccacagucacuuauaagacauuuuuaucaccucaaaaugaaucucuguacaauuuagcuaucacccccauuucccuaagccccccuccagccuucagcccugagcaggcacuaaucuuuugucuccauguuugucuauucugaacauuucauauguauggaaucauaaaauguguagcauuuugugauuggcuuauuucacuuagcauaauguuuucaagguucauccauguaguagcauguagcuguacaucauuccuuuuuauggccaaauuaacaucccauuguguggauaugccacguuuuguucauucauuauuuaguggacauuuggguuguuucaaccauuuggcuauugugaauaauacugcugugaacauuugucuacaaguuuuugugugaacauauguccauguuucuuuuggauauauaucuaggaguagaauucccaggucaaauggcaaaucuauguuuaauuuguugaggaccugccucacuggcugcaccauuuucuauuuccgccagcaguguacagggcuuucuguuacuccacauccucaccggcacuuguuauuaucugacuuuuauuauagccauccaguggacauaaagugacaucucacugugguuuugauuugcauuucccugaugacuaaugauauugggcaucuuuucaugugcuuguuggccauuuguauaccuccuuuggagauaugucuauucagauccuuugcccguuuuaaaauuauuugucuucauaaucacuuuuuuaaaagacuucauuuuuuagaguaguuuuagguucacagcaaaauugagaggaagacacagagauaucccauaugucccuugccccgacacaggcauagccucccccauuaacaacaacccccaccagagcaguacauuuguuacaauugaugcaccuacaucaugucauuaucaaagucuguaguuuacauuaggguucagucuuggugcugugcauucugugggauuguacaaauggguaaugacauacagcuaccaucacaguaucauacagaguauuuucacuacccuaaaaaucuucugugcucuaccuguucagcucucccucccucccauccccuggcaaccacugaucuuuuuacugucuccauaguuuugcccuucccagaauaucauaugauuggaaucacacaguacauagccuuuucagauuggcuucuuuuacuuaguaauaggcauguaaguuuccuccauaucuuuucauggcuugauccuuucguuuuagugcuaaauaauauuccguugucuggguauaccacaguuauccacucacugaaagauauugugauuccuuccaaguuuuggcaauucugaaugaagcuguuacaaauaucugugugcaggcuuuuuuguggacauaaguuuucauuuccuuugaaucaauaccaaggugugugauugcugcuggaucauaugguuuaagaguauguuuaguuuguaaauggcaaacugucuuccaaaguggcuguaccauuuugcauucccuccagcaaugaaugaaaguuccuguuguuccacauccuugccagcauuugguggugucaguguuacagauucuggccauucuaacagguguguagugguaucucauuuuuguuuuaauuugcauuuucccaacaacguaugaugcaaagcaucuuuuuauaugcuuauuugccaucugcauaucuuuuuccaugaggcaucuguuaaggucuuuggcccauuuuuuuauuuguuuucuuauuguugaacuguuaaaagaguccuuuccauauuuugaaaaauaguucuuuaucagauacgucuuuugcaaauuuuuuuucagucugugccuugucuucucauucucuugaccacaucuuuugcagaaugaaaguguuuacauuuaaugaaguccagcuuaucaacucuuucuuucauggauugugucuuugguaucauaucuaaagagucaucacuaaacccaagguuaucuagauuuucgcuuacacuauuuucugggagcuuuauaguuuuguguuucagauuuagguuugugaugcauuuugaguugauuuuugcgaacaguagagaccugugucuauauuucauuuuaaagacaauuucuuuuuuuuuuuucgcauuuggauggccaguuguuccagcaucauuuguugaaaagaguaucuuugccccauuguauugccuuugcuccuuugucaaaggucaguugacucuauuuauaugggucuauuucugggcucuauucuguuucauugaucuauuuguguauucuuuggccaguaucacacuggcuugauuacugcagcuuucuaguaagucuugaggucagguagugucaguucuucaguuuuauucuucuccuuuaauuuuuuuguuggcuauucugggucuuuugccucuccguauaaacuuuuagaaucaguuuuagaaucacuuuuuaaacuuugcuuuaaagaacaacaaauuaugaaggacauucuuaagagagauguuuuaagcuugucaaaaggcaaaaaucacuuacucuuucaaagagaacgauaaaugaguguagugggaaguauagugggaggauugcuuugauuccugucucagcuagcucaccccuccgagccuuagccuggucuguauaagugagaauaauaauacccacauugcacaugaggcuuaagggguuuguaaagcacaaguuuaaugucugacacauaauagauacuagaaauaacagcuaacauuuaguaaauauuugcuguguaccaagucaugaacuaaucuuuggguugucugaguaaguaguagaguuggaacucaaguccagaucugacuucagaacucauucucuuagccacccccacaugcugcuuuccauuaacugggagcugcucuuaacucccaaccacaaaagcagaacagucaucaguuaauugcaagauggaggguaaagaaaauuaacugcuuuaaaugaauccaagcuggucaaguuacauuccaagguaccgaagaaccugccacugggaucccugugucaccgguggucauccauuagccaccugaagucagagucagccagugcuauagaauuuguguguccuaaacucagcaauuuggggcaaagucuccaauuauguauguagucauaaacaaguggaaaacaugaguuauaugaacauaccauugggggagauuaaugguguaauaagcuguucaguaauacuaagaaaaaauauauaugugcauaugaaacccguauugcccaaggacagaacuguaguaaucagugcacugauacaaagugcuacagugcauggaacagucucuuuggaacuggcuauuagauacaagguccuaauugugugugugacagaguagaaggguguguaagggaauaauuauaucacuuagacauaaaaaagaguuagaguaagggccuuguuugcuuuuucauugcuuugggcuaauuggcauucagaauauuuauccuaaaccuuuuuugccuuuagaauucaguucaccaagcauaggaccugguagguuuauacauggaaucuccaguaauugcaguguaagcaucaucuuaaauggccugccauuggaaaguauaagacuugaaucaaguuaccuagauuuagauauguaguagcucuaauuuaucugguaagucucuucaccacuaagcuucagauuaucuauuuacuuauagagcaggggucagagcuguuaucaguuauucggaggauugaucaggguuugaaaaucaucauacacauauugguauaguuauuuuuauuguuagaauugaaaguucuaacaugaugaaacuacuauuucauaucucuuuauaauagucuauauccugcaucucacauuaacucccucaauugagucaugguacaagucuggcagguuagaagguaaugcagauuuuagccugaacuaacugcucucuggggccaggucugcgcuuuugucuaucauuaggaggucauugcugucuuaggcuuaugaccuuuuacaguagauucaaaaguaaaaauaaaaccaauaaaauuugucuuuaucugguugcacuugucaauauaguugcuuuuggaaauucuagaauaugacuauuuucugauaggcaaauaguuugcuuucugauggucugcaacauuagaauaugauuucaacuucuuuccuuuuugugcuuacaggagcaacauagcuccuaauggaguagaacuugacaggccucaaaaagacaugaauuuagaaauuuguccaguaauuauuuaaauuuccaaaaguaaaaacaaauaucuuugugguggaagcaugcuacccgguacucaauaaauauuugccaaguggaugaaaagcuauucuuuuacaacauaaaauaucuuguaacuuucuaguguccugauaaaacuucaauaaaaaggcagccuucagaaaaugcaguuuauucaucuagauuuacuguuaaaaaucucaucuuuucacugagcuuaacuacaguauaacuggaaaccauuaugugauacucuggccgcauaagugggcacacagagaauagcauuguucaccggcacugcuccccuccaaaugggcaaggacuuuugugggacuugugacauaaucugaacaagcacucucuguguucgucaucacagauugucuuuuguccuuuaccuccuggaaucugcccagaucuuuccccucuccuuucuuaggcaucucuuguuugcuucuuauucuugcuugcacuguaacuuggaauagugcuucccaacuauggugcgacauaccuaugauucauaacuugucucucagucuccacauccucccacagugugggggugggucuuguggcccagcccacuacuaauuauuccucugggaacaucaaccugauaguagccaugaucucucaucuuucuucuuugcccacucuucuugucuaccaaaaaggaccuaccaggaaguuuucaucaauuucucugacugccuguagucaacacugcuguacugucuccugaagcucagaguguaucuucacaucacauuccauaaaugcuuaucgaagcccuccugugugucagacacuggggauguggcaaauuauaagacaaaaauuucugccaucuuggagcugguguuugaguaggcuaaaacagaaaacgaacaaaaugagaaugugaaguguguagcaucuuagaaaaaugaagcagggaagaggaaugggaguucugcaagggagguggauccagagggauuuuauuuugaauaaaauacucagauaaaaccucucugagauagugacggcaggcagagacuggaggggugugaggauaucuggagggagccaugcggauaucuggaagaucauucugggcagauuuugcaccugcaaaaucccugcagcaggagcauccuguggugccugaggaauagugcggaggccugugcggugggaagagggaagagcaggagagaaggaggaagcgagggucugggugugaccuaggaaaugaaggagguuguuuagguucuugugggcuauuuauaaacuuuggcuuuuguuuggagugagaagaacccauuggaggguuuuuauuauuuuuauuuuuauuucuuuuuuuugagauggaguuucacucuugucgcccaggcuggagugcaauggcaugaucuccggucacugcaaccucugccuccuggguucaagcaauucuccagccucggccucccaaguagaugggauuacaagugcccaccaccaugcccagcuaauuuuuauauuuuuaguagagacgggguuccaccauguuggccaggcuggucuccaacucuugaccucaggugauccacccaccucggccucccaaagugcugggauuacaggcgugagccaccgcacccagccaaggguuuuaaugaaaggagugacaugaucugguguguuuuaacaguacugcucugccuugccagauuaaagaggggaagggaucagaagccaggagauccauuggaaagcuacuucaguaauccaagcacaagaugaugauaacuuggaucagaacagccaugggggacgugugagaaguggucuggauguauugugaagagggaucccacagguggauugaaugugaagugugagaaguaucagguggcgugagcagcuggagagaugauauugccauccacugagguggaaaauuauagaggagcagguugggagaugauuagggguuuggcuuuugauguuacuuugaugugccuuuuagacaucugaauggggauacugaguauacagcagaacgugugaagaaguucagggaagauguucaggcuggaguguaaauuugggagccuaucaguacauaaauaagccaugagaaugaacugggucaccaaggcucugaguaugucgaggaaaguuccaaggacugaaucuuagggcacugcgacauuagaagucuggagaguugaggaggaacgagcaaaggagccguggaagggcagaccagugaggugggaggauaugaggagaggagagguggugaccuggaagacgagugaaaaaggaucucaugaggaucgagucaucagcaaucacagauguuagcgauaggucaaguaaaauaacggaggaggcuaccuggggagauuaggaaguucuuuuucuuuaaagugaaauaucugaaaauaauguuaaauguauaauuuuccagcuacauucaguaaacauuuuucuacaguaauauugauuccuugguguuuguugaaauugguucuguggguucuuuguguuguuguugagacagugucuuacucugucacccaggcuagagugcaguggcacaaucuuggcucacuacaaccucugccuccuggguucaagugauucucgcaccucagccuccugaguaguugggauuacaggcgccugucaccacacucagcuaauuuuugcguuuuuaauagagaugggguuucgccauguuagccaggcugggcucgaacuccugaccucaagugaucugcccaccucgaccucccaaagugcugggauuacaggcgugagugagccagcacgcccagccugguucuauggaaaaagaauguauagucucuuguauguguguucauauguuaaccuuguuaauaguguucaaaucuuucauauucucauuaauuuucauugagagaacuauauuaaacucuacuacgauuauagauaugucaguuuuuucuuuuuuuuggagggaggugggguaugggucuuaguuuuuuauuuuacacuuugaggcuuuccuguuaguuguuuuuuuauuuuacacuuugaggcuuuccuguuaguugcaaauaagaucagaauuauucuucuuccuggugaauguuucuaccaucucauacggguccuuaaagccuaauuugucuguuguaauaaaaccuccccaguugcuuuuagaauuuuuauuuggauagcuuuuucuagcccacuacuuccaacacuucuaugaccugauuuuuaauccagagccucucuuuucacugacagauuuaagccauuuacauugauuaaaacaauuuaauacuuuuauuuguaucuauuuuauuauguauuuucuauuuaccaggcauuuucuuugccccuuuuuguucugcugacacagggacuucugucgcacugaucaaguuucuuuguuucuuuuauugcccucuacugguugggaaauuauguagucuaugucuguucuuugagugguuaccuuuccauuuuuaacauaccuguuugccuuugaucaauaucucuuccuucugcugaucaaugcaaggaggaugauuuaucucuaaugauucucuuaugucuuucauguuauuacauuuuuguguuuuaacuucaccuuguauuuauaccugccaacuuaguauuauuguuguuuuauacagucaaugauuauuuugauuucuuacacauuuacuaguauuuuggcucaccauuucucauaucucuuuucuuuuuccuucuuauguaauuuccuucuuccugaaauacgucuuuuaauaguuuuuccagucaugucuauuagugguaaaugcgcucagacuuugucugaaaauguguuuauuucucugucaucugugauuuagauuuuuagcuggacaguuauuuuuuucucuguguuguguguuaugugcagccagucuaauugcuguucaugugguuauucugauuuuucuuucugacuguuuaaucauguuuuuucuucccuccuugguguucugguauggauuuauuuuuuuccuaaucagaagccauuguucugaauuugaggcauuguaucauucuucaauucuagaaaagucucagccauuauaaucucaauauuaccucucucaauucuuucuauucccuucuccuggacuaccugucagauguauguugggccuugucauucuguccucugugucucuuaacuuccguuuuauguuuuccaucuuuuuuuucuuuuuuuagugcaauggcacgaucuuggcucacaacaaccucugccucccagguucaagcaauucuccugccucagccuccugaguagcugggauuacaggcacccgccaccaugccccgcuaauuuuuuguauuuuuaguagagacgguucacccuguuggccaggcuggucuugaacucuugaccucaggugauccacccgccuuggccucccaaagugcucagauuacaggugugagccaccaugcccagccuuccaucucuguuucuuucugggcuacauucuaaauaauucuucacaucuguuuuuagguuuacuaauuccuaggauguguuuaaucugcuauuuaaucuauuaauuuaucauuuccaugacaauauuugccauuuuuauucuuuuucaacucuccuuauucuuucuuuuaauagacuaccuauggcuucaagcccuucauuaugugucuugaguaauguuaaacauauauauuuuacaucuccauguguauuuuuguucuacugucauauguucuugguguucuaauccucauuuuucaauuuaugguggauuuuucccguuuuuuguaauuuuuuuuuuuuuuuuuuuacuuugagcucaucuuuaaugagacuugguuuuucuguggaaucucauggagccacaguugugagugugacccuccaggccaguugcaccauuccuuuggccagucacccuaaggguaucaccagcuagugaccaauuuuuguguuguuuuuuguuuuucuuuuucuuuuuuugagauggagucuugcuguaucgcccaggcuggagugcagugacacgaucucagcucacugcagccucugccucccagguucaagugauucuccugccucagccucccaaguagcugggacuacaggcagacgccaccaccccuggcuaauuuuuguauuuuuaauagagaugggguuucaucucuacuaaauguuagcaauagguccaguaaaauaacagaggaggcuaccuggggagauuaggaaguucuuuuucuuuaaagugaaauaucugaaaauaauguuaaauguguaauuuuccagcuacauucaguaaacauuuuucuacaguaauauugauuccuuugugcucagaccucaagugagcaccaagaaaaaccagaauaaccacaugaacagcaauuagacuggcugcacauaacacacaacacagagaaaaaauaacuguccagcuagaaaucuaauucauggaugacagagaaauaaauacauuuucagacaaagucugagcacauuuaccgcuaauagaacuccugaccucaagugaucugcccaccucggccucccaaagugcuuggauuacaggugugagccaccauaccuggccaauuuuuguguuaauucaucugaauucuugaacuccaaguuuguguaagaugcaagcccagcauuuccauucauuacuuaacagacaaaaaacuuuuuaaucaugucacucuucuggagagaggacauuuuuccuacuccacccuguaacauucagucuccugccagaguuuccucucauuggccaaacccaggcagaggccaaauagaacagaagcuuagaaaaaacagccugcaggauuggcuuuuuugcagcccagagcagaacagggaaaaggugagaaauggaccugggcacaaacaggccuaggaccaacacaauauucuauccccuaacaaauauucccugacugcagguagccaacacgcugugcucagcuugcuauuacagaaauguguuagacacagucccuggucugcagucagagccacugacaccguaacuacacagauuaacaacagcaccaguuagacgauguguaauguuaaaagacagauacaaaccaguaccauggaaacacugcauguguucagcggucacagcuugcuaagggcuacucuauugacaaugcagguauagagaguggcaaagggguguauccuauccauaaaacccgaauuccucaguucaucaggacuuuucucaggacaaaaaagauguuacccucccuccucucaaaaaaagaggauucuguggucaaauacguguugggaacccugagcucaucaaauuuuucuguagcacagaguuucucacugccuaauaggcuaaugugcacuggggcccugcgagugagauauacagccugcagcauugucuggauucaucugaccgcacaggacaggagcaucaggagccuauuuuggcauuugcuggacuggggggagcagagagccaggcagcaggcaagaggcagaagacagaaggaaacaccaagaagaggagaggcucaagggcugagaaaggcagacucaagucuccaaaaaagccucccauccaaggcgccugugcugugggccggcaggggagggugcaagcucagaagaggucacugaacuuggcaaugccaaggucaucgauaccuucccgagagcagugucgggcaguggggcagaaaccagaaucccgaguggagaugugacagggaaagcuagcgagaguuggccauggguguaaaccccucuagugacauuugccaaugagaccaaaggcaggcggugcugaggagggggcaggguuggagaagugugcuuguugguugguuucaaacagugggauaggagggacacuuagcaauguuuaugggcuaagaaggaaauggcgaagagugaacauagaagcgugaaggaaagggaggggcccuggaggagaggcugacuacagacaguggcuuuagaaagaaacaggaccccuccuucccuaacucaggaaggacacacagggacaaauggacagacagaaggggaggaagagaggccucgugucuuuauuuuuucccugacaucagagguaagagcaucuggaagugaggguaggagcuggguuggaaacuuaaacagaggguaaaaauuuaagagcaggccaggcgugguggcucacgccuguaaucccagcacuucgagaggccgagaugggcagagcacuugaggccaguaguuggagaccagccuggccaacauggcgaaaccccgucucuacuaaagauacaaaaauuagcuggguguggugggcaccuguaguuccagcuacucggagacugaggcaggagaaucgcuugaacccgggaggcggagguuguagugagccgagaucgcgccgcugcacuccagccugggccacacagugagacuccgucucaaaaaaaaaaaaaaaguugaagagccgucaugaugaaaugcaaaagggucagcuaggcauggcaugccagggguguccccacauuauccugcuacagcuaaugcaauguauagucuaguuuuagaaacaaauaucugagguucuugcuauuauuccaagguauuauuccagauacaguggccaauacuugugguuuuuaauguaaaucauuguuucccaaggugugauaguuguauccuuguggugcucaacgcacugguacacaaaauggaccuguuucauucgaaugauuauauauuugcuuuaaugauuauuagaagaaacauaaugagcacacuuaacuucaaacacgaguacguuuagagaaaaauauuaaguaaauaauaauagagauggaauguggauauggcaaaagucuugaaagcagaacaugaaguuuguaagacaguggugugggagguggggcaaccuuggaaacuggucugaguucccuccaucaaucaccuggccacaccgaguagcaccacuggaucauaucaggaucagugccauuucgccaggugucuggucaccaagccucuccuugcuccacaaaagccucgucaagcagacauuuggauuagccucagugauuuuuuuuaacacucaguuacccucugcaguucccccuggcagaagauaauaaaauacuaucucccuaaaagcguaacaauuuugaacaugacaguggcauuaugauuuauuucuuucuuuucuuuauuuuucuucuuucuuuuuuuucuuucuuuccuuucuuucuuucuuuuucuuguuucuuuccuuuuuuucccuuccuucccuucccuuccuucuuucacuccuuccuucuucccucacuccccuccccuccccuccccuucccuuuccccuuacauucacuuuuuccuuccuucucccuguuccuuucuuuuccuuuuuuuuuuuuuuuugaaacagggucucacucuuaucuggccuggaguacaguggugcagucacagcucacugcaaacuugaacucucagacucaagcaguccucccagccuuagccucccaaguagcugggacuacaggcacaugccaccacgccuggcuaauuuuuuuuuuuuuaauuugguagagaugagagucucacuuuguugcccaggcuggucuucaacuccuaggcacaagugauccucccgccucagccucccacagugcugggauuacaggcaccacagucuaugauuucuuuuuagaaacaccaaacauaaccugccuuauucauuuauuuuuuuguucucugugggaguaauuucuuuaaagcuguuggcaacaucuguagaauauagaaaagcugucuuccuuagaacugucuguaagcccagaucuauacaaaauguauacaaaugcaaaggaaauuggaaagagcaacacgcccugcuggauggacaguguccuggcaggugcagggugcgccuucgcucugcugcccuucuugguugccuuagcuacagaaggucuucccuacuucauucgucucuuucccaguuuucugacacaagccacuugcugccucauguuguagcuugcuggguaccuacaugcugucaaccuaaauaacggagagggagacucucuaaaagaaagugauauuuauuuaagaauaguuauugcaccgggcauggggcucaugccuguaaucccagcacuuugggaggccaaggugggcggaucaccugagaucaggaguucgagaccagccuggccaauacggugaaaccccaucucuacuaaaaauacaaaaauuagcugggcgugguggugugugccuguaaucccagccacucaggaggcugaggcaggagaaucacuugcacccagaaggcagagguugcagugagccgagauuugcgccauugcacuccagccuggcugacacagggagacucugucuccaaaaaaaaaaaaaaaaaaaaaaagaaaagaaaaauaguuauuguaaugggaauaugcauaccaacaggugcauauucagagaacuaaaggaggacaaaaguuuuuaaaggaaaaaugaagaggaucacauaauuuuuuuaaauauauaauuauccuuggccgugagaaucaauaaggguggcacuuguccgagguuggacaggcaguugcugggcagauaaccuugcaggacuauuuuuuugugucaggucaccauggccuuuauguaaguuugugguuuugcagucuuuugugauaguucuaguuaucaaguauucauggaugagaacucucucuucauggccuucccuggcccuuugucaggauuuuuaacacaagugacuccauuuugauucugacaacuuccacugcuuuugcuuuuuuuuuuuuuuuuuuuuuuggagaugaagucuugcucuuuugcccaggcuggagugcaguggugcgaucucggcucacugcaaccuccaccuccuggguucacaccauucugcugccucagccuccugaguagcugggacuacaggcgcccaccaccacgccuggcuaauuuuuuguaauuuuaguagagacgggguuucaccguguuagccaggauggucucgaucuccugaccucgugauacacccaccuuggccucccaaagugcugggauuacucccaaaggugugagccaccaugcccggcugcuuuugcuuuuuuuucuaagaaggguuuccugagguauuucgccacaucacuguguauaggcaagcccucagcuacuuguuaagugacucuggaauuaugucacuucauaguuugacaucuaguucagcugugaugugccugugaauugauccauagugaaugcaguaccucucacccugaugcaagguugcuugugacuuuccugucauuuguggcuggauaucugcaguguaccaggaguuauuuguucuagugagaugaggcaguggucuucugggaauugcugggaucugggaauuucagguuuuauaaccuuagaacuuuccuuuaagaaaucuagagacuguuucucaaacauuuuuuuaacaguagcucacagugagaaauacauuuuacauuucgaauacauacauaacuaaacauuucacaauauuuaccaaagccauaugcaugguaauuucuauuuauuuauuuuuuaaugcugggccugaccagcauuuuaaaaccaaaaugauauaaugacccacuaauggcucaugaccugcaguuuggaguggucugaagcaucugauucauuuaaucauuucaguaacuucgaaaaaugucuugagguggugagauucuucacacgcucugcacaguucugaaaagaaauuaggagcacauugaaauguuacagacauugcugauuugccacuuuggagcugugagugccggcucauuaaugccaacucuccgcguacgcaugcugcucugcagaaguuagcagcguccuuuuuaaggcugcgucauucuuucaaagcagcauuuguaaacccagcacaucugcugacaaaugucuauuuucuacaaaguugacuaaaguaauauuuuaaacuacccuguuuuuuccacagggugugcugaucugcaaacccuggacacaaugcagccaauugagaggaaaagacagggcuauauucaugagcugauucagaccgaagagcgguacauggcugaccuucagcucgucgucgaggugaggaggcugcugcuggcuagcucucgggguaucugcugucucucaugagagauggugggcaucagacucagggcugccuccacgcagagucaaagcaaggcaucacuuuugaugugugaauucacaaauagugacggaagcucucacauccuccaaaugcugucucugccugccggauaaugcuugagauugaaagucucuaaugagcucuuucccccagaugaggucacucagagugaagcgggagaacaagagggcauucgcauggcuucguuggauguggcaggagccccaucaaggaaggacggggauagaguggaugggaagggccuauggcagaccguagcuuccuuggauauuugccuaauaucuguuuuaacaucugacauuuucauaaacugguaucucuggaggaacugugaaacagugaaaguguucaccucaugguuguaucaguuuggaaaacccaaugggagcauauuguaaaauaguucccaaauaucauauagcuacuguuuguuuauaccagugaccucuacgcugaugacagcuauccuuauucgaguagcacuuuaaaaugauuugugcuugagugaacaaaagaagacuuuccauuucuacuauaccuuuguuuccaugccuuucaguucccaguguacaggcccucaggugagaagaccaguuacauuaacaaaccaccugaaaagaacaggcguccccuacccccacacacccaacaggugcagcguauaccuggccaugccuuucauagcugaauggagcagaggcugcguccuucugcgucuguuccccagcaagcccugcccuggauucacucuccaccuuaaacgcaggccuaaugccugggauauccagacauggaauacuuguuccccucccaugcaaacuauauggcacuucucgguuggugauaucuaucuucacugcacgccugugggcucacugagaacagggaccgugcagccuucauccuguguucccaaaacuuagccuggcccuuggucggccuuuccauaaguagucagugaauuggguguguuuaugucugcaccucucuggccaggauagauggccuagaagaaaagcccaucauuuugauuaauccccuacaaggaucagcccugcugcuggucagauuccaguccuaaggcacuguaaguagguguggaggucucccuaacacuaggacagaggugagcaggcaccgggugcuugccccauacucugaggagugaagcaucaggucuggguccaggauucugggugaaaagcaccauucacaggugaggccuucuuaugaccauccucaugaagguucccagaggccugaccagcuuauucccaucugcuuaccucaccaagcccggcacaaagcagcuacauggauggcuagaggggcaugaaugaaucagcaaauaaacaaacagauggacagccagacucuucccugucccuccauagcagccuccgagcaggccggccgucuuuccagggcugcucucacaggaguggccuagugucuucagucugauuuggaacuguaaaacucucuuuagagagugcccagcacuuguacuugaauucugugaauccauguucaacucaacucuguaaacaugaauuacaaaccacgaugugcaaagggcuaugccagagaacagagaugaaagaaaguucuuguccuccaggaauucagaguccuguuggauggagagagguacaguggggccaguaaggcugaaaccugggguuagugaccaccccagccaggaagaacuuucccaguuauguuuuggacaaggacaaguuugcuacuccaggaggaggaaacagaagugggauggcauguauggagggagucaggggccuacaggccauccagggugacuggagugugaaguagcugagggccaggcuggugagguuggcagggggcaggucucauaggcccuggaaccuccaggaggagucugugucuuaucacacggacaguggagagcuuugagugauucuaauagcagcaugucaugggcauuuuggaaagaugacauaugagaagagugucucagguaacuucucuauuuccuuaagguguuuaaagucauucccuaggaaucucaguuaugcaguugaaacuuagauuuagaaucaaaaagagcugaauuuuaguccuaggccuuucauauucugucuuugugaucuugagcaagucucccucuaagccuuuauuucuucauaggucaauugguaauaauaauaccugacucagcuucgccuccaucacccgugaagcuacuugagaacccugcaaacacacacgcguguguguacacacacacaagcaucugcauauuuguacauaucagugcuuuguaaauccuuaagugcuauguaauacagauguagaguauuacuauuucucccucagcagccaacuucuaaaacccacaucugcuuagaguuaucuuagggguggcauaaguuguuacucugguucuccuguugaaugucucacaaauuguugucuagaacucuacgaugcuccaccuaacaauggccugcuuccucaauccugcaagcuuguacagugccuagguguucaugcccauggcuuuauuuaaccuucauaacaucccuaagagagaaaucugaaaaucuccucuuaaccagauuacuagauucaguccuuggaacuagccuugauaagagcugcacuagcaaaaagaaagaacauuaugcaguauaaaaugugucauaaguaugcuuauuuggaugauuagcuucaguuuauguugacauuauuugaucugauuaguuucaguuuaugaagacauuguuugauuuagaccacacguaggcuguguauccacacuuaagcuaacuaguuuuucuauguuuugacuuuagguuuuucagaaacgcauggcagagucaggcuuucucacugaaggggagauggcccugauuuuuguuaacuggaaggagcucaucauguccaacacaaagcugcugaagugaguccugagcaucaccugucauugccgcugaccccaaagcccccagacugagacucacacaaaacccucugcaagggcuucuuagcaaaggaacuucaacugcuuucugcuuccucaggcuuguuauuuuauuaucauuuuaugaaauauccugugacuguaaaauacauaaguauugaagaaaguaaagaaauauaacaaaauauuuugauaaagaaaaaauuaaaucauuaaacaacauaucaaucuaugauuccaagauauaagauguccuugacccuggcagggcagaagagucagaggagagcugcagcucacggcgcagauaaaacugccuaguuugguggccuccuaagucucuauccccaugugaaguucuacuguuggggugauuuuccauccuucguggcugugaggacaggccccccaagggaggaugagcagucccagcuucccucagggauagugccucucugccuccacaccuggccccugcagcuccugcucccuuuuuucucuuacagacugaaaauuuccuucuugguucaaccaagaacaaguuagaaucuuucaaaagaaacuuugccaagaagcuaaggugaaaccaaaacaauucuaaaggccuugaaacacccaaguguauuuuuuuuuuuuugagauggagucucacugugucgcccaggcuggagugcaguggcacagucucagcucacugcaaccuccgccuccuggguucacaccauucuccugccucagccucccgaguagcugggacaacaggcacccaccaccacaccuggcuaauuuuuuuuuuuuuuuugagacggagucucgcucucucacccaggcuagagugcaguggcgcgaucucggcucgcugccagcuccgccucccggguucacgccauucuccugccucagccucccgaguagcugggauacaggcgcccaccacugcgcccggcuaauuuuuuguauuuuuaguagagaugguguuucacugugucagccaggauggucucaaucuccugaccucgugauccacccaccucagccucucaaagugcugggauuacaggcgugagccaccaugcccagcuacccagguguguauuuuuuaaauuuauuuuuauuuuuauuauuuuuagaggcaaggucucacucugucacccaagcugcagugcaguggugugaucguagcucacugcacccaacuugaacuccuggauucaagcaauccuccuaccucagccuccggaguagcuggaacuacaggcgugcaccaccaugcccagcuaauuuuucauuuuuguagagacagggucucacuauguugcccaagcuggucucgaacuccugggcucaagcaauccucuugccucggccucccgaaaugcugggauuagaggcaugagccaccgugcccagcccacccaacugcagggacuuuauuuacuuuuuuuuucuuugcugacaucacaccccgguuggcuugaccagcagagcuuuuggcccaagcuaucuccucuuccucuugaguucuccuucccagugccagagguucuuagguagcucacugguuaucauuaccauuggucugccaugggauucauccuuuaauuaccuaagucauucacuuagaaacacaaaaugagaguguguucuuggcagggcuuugcgggugcggaagaagaccgggggcgagaagaugccggugcagaugauuggggacauccuggccgcugagcugucccacaugcaggcuuacaucagguucugcagcugccagcuuaauggagcagcucuguuacagcagaagacagaugaagacacagauuucaaagaauuuuuaaagguaauuccauucugggccuugcgggucaggcuccuucugaggcuggaggcaacagcacacaguagcccaacagggaaucccagcaauggagaagggcauccccaucaguuuccaaaggaaacaccaaaacggcagagaauuuuccgauuguuuuguguugccuuuauguagaccugauuuuuuccuggcacugggaccaucauuuuuuccccaucugauagcagaguguuuuuuuuuaagcauacuuacuuaucagcuacuuuauacucccaagaaacaaccagaaugucacuuucuuaauuuuguaaauugccuucauuuaauaccugccuuauuccagaaagaguauaaaauagcuuacucuuuuuuuuuuuuuuuuuuuuaaacagaaucuugcucuguugcccaggcuggaaugcagugguaugaucuuggcucacugcaaccucugccucccaaguucaagagauucuccuaccucagccuccaaaguagcugggauuacaggcaugugccaccacgccuggcuaauuuuuguauuuuuaguagagacgggguuucaccauguuggccagguugauuucgaacuccugaccucaggugaucggcccaccuuggccucccaaagugcuuggauuacagguguaagccaccgugcccggcccuaaaauagcuuacucaaauauauaaaaugcaacaagauaaaauuuaaaauaacuagaugaauaaacuuggacaaaaggaaaugagaguaggaaacaaagacgauaccaggaauuaggauaauauauaaaaugcauaucugugauccuguaaauauaccagaagugugcacagaugucaucaaagcuuccagaaacugaugagcagaagaagaaaggaucaguuccgugaugccacgucacaaguuaaacaugagaaguaaagcuacagcuguacucagagagagaacacuguguauaauguaaugagucaacaacauccuucguacagguuauuauaauagaaagucauauuuugagaaguuauuugcauugauguuguucaguaguagaaacuauuauuauaccuguuaaaauggugaggaaauugaaaguaaaaucuguuuucuugcuuuuuuucauauuuccuguuggguuuuuuuguucaugaaauacugcauauugggauauauuaaacagccauaucaguacuuaaggagaguauauaauuuaaauauuuucauuaucagaaaagaguagaaaguaagaauaaaauauaaagauguuuaggcagagaauagaaauuagaaaaggaaaauggaggaaguaauaaagguaaaaagcacaaauuauaucaauauauccaagaacuguuauauugaagagagguaauaaaauguaacugaugaaucuaauagagaaagaggaaaaaacacaaguaacagaauggauguaaggagaucucuuaaauuaaagugcauguaauuccaaaagacaugcuaacaaaugugaaaacaugaacaaaauuuguaauuuucuauuaaaacuugaaaacuggcucaauaagaauagaaaaucuuuuaaaaauagaaaaucuuacuauuacgauacuauacaccaaggagaaaauugagaaacuuaccccaaaaaggagcuggguucacuugauggauuuaacagggaauucucuccaacucuaaaggaacagauuauucuauauuauacaaacuguuacagaucauaggaaaaaguaaaaaggucaccuaauucauucuauaaagcaaaaguagccaugauuccaaggccuguuuaaguuaaaacccacuaucauuuacaaauacagcuguuaaacucuuaauuaaaguaacaauucauaaaauuaagcauuacaugaaaagaagagccuaucauaaccaaauaggauuaucucaggaggcuauagcauacuaugcuuagaacaagacaggcuucagaaucucggccccgucacugucuaauugugugaccagaggcaaguuauuuaacaugugggugccuucaguccccucaucuauaaaaggagauuaucacacaguacuuuuaaaggacuuuaacucagagaccaacacauuacuauuagcauucaauaaaugauuaucguauuuuuccuuacgaugaucucagggaugcaaaaaugauucaauauaaggcagugaggacagagcccuucgauuugugauaaggguaggaggcagggaguugccucgaaaugaacuggaagaaacauggaaaccaagaccauagaauuaaacauucaucagaauaaugagauaaacugagaauuguuaguauaugugcauguuuuaaaauaaugauguaaauaggauuucaaagucaucacaauuguaacaguagucaaaauaaauaaaaauacugccucaugaaaggccugcuauagguuaccuuaaaaagcaaaaucuagcaauaagcuguguucuaaaauguuacuuuuuaaaaagacucagaaaauauggaaauaagaagcacgaagaugcuugugacagcaaccuauauagauacggccaaaacaaaaggggggcaauuuaaauauccaguaguggggaaaugaugagguggauuacagugaguguacuuuucagucauuaaaagcugccauccuagagcagcagcugcugucuucaggcaguguaccagagcuagggguagaggcaaguaggaugugggcccugggccuggcguucacaaaucggguguggaauagagacacugcaacacgaugccucucccuguaucaccuggugcacaugugguguaugcuaaagguggccagggagggucauggaaaggagggaaggugucccaggggagagccuggacaaggggaagcagggccugagucuugagggucaagugugaaucagcuccgagaagagagggcaggggacagucccagcacaggucaugggaaagagcugaggagcauccgcugggcuuggcacaugagcugagauauuccuacugugaaccuaauagguaucauuuuagauccugaguuauuuaaaagaaagucgaagcccccucacuuuacuacagugcgacauaucaguguagcaaaauuacacuuguauguugugaauauacacaaauuuuaaaauaaaaauaaaaaauagaacacucaccuaaaaaaaauucuaaaacaguaagacagggagaaacauaaauaaauaaaagaaaugugaaaucuaaaaggcgaucaaagaccagugcuuccugugaucggagcugugauuuccucacgagccucacuguuguuuugcagaagcuggcaucugacccgcgguguaaaggaaugccccucuccagcuuccugcugaaacccaugcagaggaucacccgcuacccacugcucaucagaagugugagugugcaggccgggcaguggggucugaguuaggagcaggaugcgcugagguccacagaggccagauccucagggagcccugagcaugccaccucacccugcacacagugugacaccgcacaagugaucccacugucccggggaccagaugccugugugugugugugcacagaaacacgcugaauccuugaagugggcaaaucagagaggaauccaguaucacuuggguaaccugucacccaccuuucaagaaacuccccagcaucucaaagucauaaguauacuuguccaggcagggaaaggccccucuaggucuccaguuguggagcccaucuugaacccagagaaagaccagaguaaccuuagacuccagucuuuccucugagaucugccuccauccacccugaacaccuuuccuagaugucccaggaggcuccacuuggcacaucauaaauagaguucauuugugucccucgcuguauucggcuucaacauuccuucuaaaauuccuuccagcuuucuuuuugauaagcaauagggcccucuugagcccauaagccuucuaaggaaaaggcagacuuuacaaaagauuaucccacgauuaaccauugauuacaguaacuuacaaagaaaagcagcaggaauaugauaagcuuguuacuucuauugaugauuccuugacuuuuggucuguuagcugugugaccucaacauagaccucaugugauagacgccugcacuaaacugaaccauaaugcagguucacagccccuucauugaaauacuuggggccagauguguuucagaauucggaauguagcucaaauaccauauaauauaugacuccucaacugagccuuaggguagcacuuacaaccagacacacuaauauuccuacaguggaacauaagaacaaucacuguaagaguaaguaaauauaucucuucuguuuaggucagauuuugccaccaaauggguacugaauaaaaacuuuaggcucucaggcuguucugcauuuuagaauuguaaaugaaggacugugcacucaucugacuagagugagagaguccagacggggcaucuggugauggcuccuaauuucuggagggaccacacacguuuguauucuggccucugcgcguucacaguugcagcaugcgucguuugaaaucgcuucagaaugaacagaaugcauuucuuccacaugcugacaaugugauuuuauuguauuuuuccuguggcaugggagucauugcuuucaucagauuuuuuucaaaaggaucagugaccccaaaauuguuaugaaccauugcuauucagcaaguucacacuuaccacagcugcagccaguuuauacaggagggcgcacccuuacauggcuuaaauuucggaaggagucgggaggcucccgccuauuaccgggagccagucggagagcaaccagagacccacacaguucagagcacuugauccguuuagcacugucaccuugucacagcagcguuaccugucccuguguccccaagaacuugugggaguacgaguuucucaagggcggaaagugucgucuuguucaccgccgcguuuccagggcauggaagcaguccauaacaugggguuggaggagcgguccugcgaagguccaggugggcaggugagagacgcagcucccccaugugacacugcccacucuuuuccagauucuggagaacaccccggagagccaugcagaccauuccucccuaaagcuggcccucgagcgggcagaggagcugugcucucaagugaaugagggaguucgggagaaggaaaacucggaccgacuggaguggauccaggcgcacgugcagugugaaggccucgcggaggucaggccugugugguuaagccgugcgccuccagggaggcucuggguggggaaccagcuccgagccuucccucacguggacagucugcaccuuaggcagccugcguggacucaccacccugccccugcaaaggcauuuuuuuuucuuuuuuuuuuuuuuuuuuuugagacggagucucacucuguugcccaggcuggagugcaguggcgagaucaucucggcucacugcaagcucugccucccggguuggagcgauucucuggccuccaucucccaaguagcugggacuacaggcaucugcuacgaugcccagcuaauuuucguauuuuuaguagagcugggguuucaccauguuggccaggcuggucuugaacuccuggcgucaagugauccucccgccucugucucccaacagugcugggauugcaggcaugaagggcauuccuucuuggauugucaucuuccuuucuccuaaggagagaacacugggauuuuuuguuuugaguucuuugaauucagcugguagaaucaguguucuguggcuagaaguaaugauuuucacugggccaguuuggacucugaagaguaauguauuuaaggaucuuucaugcaaagugaaugauucuagccacauucccaccuagaaaacuccaccacaguauccucaggcccagggcacuggccucucaggggcacuggaugguuugugccgggauuuaaaaagugaaauuuucuuucucuuuaagcaacuuauuuucaacucucucaccaacugccuggggccccggaagcucuuacacagugggaaauuauacaagaccaagagcaacaaggaacugcacggauuccucuucaaugacuuccugcuucuuaccuacauggucaagcaguuugcuguuuccucuggcucugagaaacuuuucagcucgaaguccaaugcucaauucaaaauguauaaaacggugaguaucacgcgucuggggguagcaucaggggccuaaugagguguugccucuaucuuaaggccuuccuggcagacccugagcuggccuuacgggacccuccucaccugguuccagaucgcucgugcuuccuuugcugcuucccacgggaagggccccaugcagcugggcacuccccaccugccacaggccaucagccagauuccagcugagauucuggcuuccuccuggccagcgugacaccugggcucaccacugugugcauucagcauugggucucuguaagccgagccccagcacagcaccagcguugcuagcagagagccuuuugcaccagccgucaugggcgcuuggagcuccuguccccacccagucccaacaccugacccaccucgauaaugacuuuuccagaaauggaggcuucauuguucuuacaaauggagguuucauuuguucuguguagaagaccuuagacgcuagaccccuuucuccuucucaacaaggcucuucagaacaaacagaacucucucuggacauaggcggguggaguguucuagcccaucucacagccuguguuuuggcccuaauucuuucagcccauuuuccugaaugaagucuuggugaaacugcccacagacccuuccagcgaugagccugucuuccacauuucccacauugaucgggucuacacccuccgaacagacaacauuaaugagaggucaguccugaccauguguggccugccuugaacucugggagaaggccuggacgucucccucugccauaaacccaucuccagccgugcuuaagccccacuaauucuguauccugaaccucucuuaacacauccccucugcuccagucccaugguaggccuuggucacugcagcugccuccuaacaugcuucccggcuucuagucucuccccacaccacucagcagccuucccaaauggcagaucagcaccugaggcccugcuacagucccugcaggggcugcccgcaggcgacagcccacugugcuuugcugguuuccgaggccuccuugggccacaggccucagcccucgucccuccaccugcagacuuucgccccucaggcgcccuugugugggugccauccccgcuguucccagcuuccuucaggcugcagcuccaacagugccuccgcggcgccaacccggggggugcugcugcuccucugugugcgcuagaaccccucgugacagguaucauccguggggccaaugcaucaucugucuccaggucccagcgccuugcgagugccuggcauuuuguggucagccaagaagggucacuaccagcucucauacuccauuagcauaagcaucuuucaguugacuaauaucaggucuuugauaggaaacuugugaaaguugagguuagcaaaagacugaagaacaugugcagagcucuggggcuccacgcugaccugugagggugggaugcggccaacggcugccccugcuucucccguaggaccgccugggugcagaagaucaaggcggcgucugagcaguacaucgacaccgagaagaagaagcgugagaaagcuuaccaagguaucagggugcccggagggugggacgcagcccccaggggcccuaggaaugccggccacugcuccugcagucaggcugaugauauagggacgggucugaaagaccagaccugcugcgggaucagaccagagagcccuccccucuugaagcuacuacugcaaaccucccuggggcuccugcccacacagacacgggcuggcagugccagcuccgggaccucccucucugcaccaccucuaucccccccacuccacugcaccuucuccacuccuuucucuccaugacucaccucaccucugcuugggcuguggugcuccauuacaugccacaccuguggucugucucccuucagcuccugagcagccacugcuccuccucacccuccucuagggccugccauccacccucucccuuugcagccagggggccuagacccuaagucugcccucuccccauccuucugccccugccuccucccccuucucacuucaccagacuucaguccacguccuguccccaccagugacaccaguggccuaguuaguggcucagcucacuuucccugccccagcucccugcacugauggcagucacugaggcgcugccuucccucuggaccccauggccgccuucccaguucuucuuccacccuugcccaggccucuccccgaccucuguagcgcucucccucggggaccccaccgacccccagcuucagggucaggcuagccacacucucccaagcccgcgccucugaacagcacccuccagagaaccaccugccccgcugcucccacaucacacaucggcuuuucccaagggaccaccagccuccuuccagcagcagcuccuccugggacccucuguggacaguaguguggucccuggccacccaggccccucccuggcaccucacaccuggucagcugcacugcaguccuccucccucgccacuuucccaucgcccuuuccuguccccguaucacaggcccccgaucucccacccaggcugcagcacaaggcucucuuuccucucugccacccauccucuucauuucuggaguauucuuuuuuccagagcugcucuuauaccucuuccugcugaaguaucuucccuauugccucccaaauuaacgacacauuucuuaccccacacucagggcccauccccacuacuaccugccacccagccccaucccuagcucuuuccugugcccggcccauccagcugccuaguugagcagcccauuguugcccugccuggccuucccaugugagcucccccuccagcucaagugcucugcccucaccuuaaauucuucccauccuucaaggcccacgucaaacacagccuccuccaugacacccucuugcccuaaccagugugacuucuaccuggaccccccgcuguccugaggcugcgaucauccuccgggcgcucauccucuguugccucugcuugcgcccucucagucccugcuuuucucacuuaauggccauaagcucccucaaggcaacucccucccacaucggggccagcaugugacuuaugccaguggggcuccagauuuguugcaccggugauguccucuguguucauggcacagaucacucaccugcucaguggagccgcaauggucuuuguaaagcaccccccaccccacccugccccaccguggccuucagaccagagcucccacauucuucuccagccuccacaugaaugccaggccccaaccucccugcugcaucuccagcugugccaggccagccuguggccuccaccccacagggggccugugcucugagccagcugcaucuccaccuuccuccccgccggcccccugcaucuccaccuuccuucccgccgggcccccccaugcagccugcccuccugccugggccucccaccagcuuccuggcugcuauaguugcagcucuuuauguguuuuuuuauucagguuucccccauuuuguuauauacuccuaaaagguauguuuaaaacagcuuuugcuaauuuaguguuauuuuaaugguacuuuaaaagcuugcuguugaaaaaucaaugauugaucauuucauaacgcauaugaucucuuaauuggccaaagaugucaauccgguuuuucugccugaguuuugcuucccaucagcaucugcauauguugcugugcaucguccgugcguucaguccuucccacauuugucaauuacuuugugccaggcucugugcuaggcuuaacugagccuggacuuugguaucugauguuuaaauguugacccugccauuuagcagcucugaguggaucacacuccaguccuuucuaagccucaguguuucucaucaguaaaauggggagcuacauuaucagguaauuaugcaguuuaaauaauauaauuuacauaagucuagcacaugccuaacacaaaguaaguauccaguaaauguuagcugcuauuaagugcugcacaaauaccauguauuauuuuauuaauauuacuauuugcuaggcaauugagggguuaauauaaggaugaucgaaacaguccaugcucuacccuggcuccugucuggcagaggagacagacauuacacacgauuucagacccagcaggcugugggcugcucauaagcgagggauacuggaugcagaggagggaagggaucugggagguagaugugggaucagaccugcaucuugaaggaugaguaggaugcugacgggcagagaaagcaggcagggcagaaagagcaagcaggggcuuccuagcaggcaacacagccuggggaaaggcacagggcagccagaugcugggcuguugggcccagggcaguggcagauggggacagggagccgguaguguuaugguugguuugaaagacagggucugcauccuuggagaagagauuaaugagacuugucuuccucuuuuguagcccgcucccaaaagacuucaggcauugggcgccugauggugcaugucauugaagcuacagaauuaaaagccugcaaaccaaaugguaaauacugccuugauucauucagcagacauaacugcccugccccaguuuuugcugaugacuuuuugagacagagucucaguguauaaccuaggcuggagugcaguggcacgaucuuggcucacugcaaccucugccucugggguacaagugauucucaaggcuuagccuccugaguagcugggauuacaggugugcaccaccacgccuggcaaauucuuguauuuuuaguagacacaggguuucaccauguuggccaggcuggucucgaacuccugaccucaagugaucugcccgccucggccucccaaagugcugggauuacagcacuuugucacugacaaagugccacugcgcccagccacugaugacucuucugaacacugaauaaaggaaugcuuucuaacaguguguccagugccacuaaaaugcgcauauuggaccaauauucuuaucacuguuuucccaguaagugccagugcccgccuucccgagugugucugcgccgaggaagcaugcagcagguugcagugacacucacccaggauuguuccgugcggagugguccuggcgguggagcucucggccacuccccaguuaaugcugcugucagcacugggaacuuggagacccuguuacuagaccacagggauauggugccccaggcagcggcuccugcugccauggucucgagugacccauuauuggaauccugcuucugcucagggagggcacugucagucgcuucguuuuaccugcaugcaccacaugugucugugguuuguuuuuguucaggaaagagcaacccauacugugaaaucagcaugggcucccagagcuacaccaccaggaccauccaggacacacucaaucccaaguggaauuuuaacugccaguucuuuauuaaggaucucuaccaagacgugcugugucucacccuguuugacagagaccaguuuucaccagaugguaagugucgcucagccaggggaucuaaaggcuuucccaguuuccuagauccuggaguccagaucuaggggcuucagcugugugcagaccccaugccacuucagggaagugacacaggccugugucaucucgcuuuggcagcagguggguggccuuccucaggggaggagguggccugagauguguuucaggucuuugacccaucacucccuacacacacgacgugaacaccacuccuggagcauucucagaauggagauuugaauuccauguggcagcuucucacacacaaaccugccaucauuccccacacacccacucacgacauucaacagccaugagccaaaagaaguuccuuguuucagauuugaagguuuuaugaauccacuucuuccggauguagcucuuuaaugauuuuauaaagaagaaagacuucugacucuccuguguuuauucaccagauuuccugggucguacugaaauuccaguggcaaaaauucgaacagaacaggaaagcaaaggcccuaugacccgccgacugcugcugcaugagguccccaccggggaggucuggguccguuuugaccugcagcuuuuugagcaaaaaacucuccuguagggguucuaaaggacagcaccagcgggacagcccacaaggcuggggcuggagaaugagagacugcgcucucuuggggcugagggagcaccaugcagcuucaccccucacaaagccaugcacgcugggggcucuguuuuccugcacacuaaauagcuagcaaucuaugcaaacaccuuucccauaaagaaaccaaaccccauaguacagugccuuguccuaguguucacauguucagcucuguuuguuuagaugccaagguuuccauuuucagggcuauaaaaaguauuacuuggaaaugaggcaucagaccaccagauguuaccgcucgguugaauguguccaccguggagugguuuggugacgcuguaaccauuccacgccagugaccucugcugggucacagccacucaggaggggaagggucaggaugagaggcugcagccucgacacuuggcgcggccugauacugaaauagcgucuacucgugcacugaauaaaaacagaaacuugaucauuuuauuccugauuagauuuuaucacucucugcuaagacaauauagucuggaguauaagugggaaagcuugauuuaaauacugugaacucuaauaauguggaaaauauuuuucaacuuuaauuuucugaaguauaaauuauuuauguaaauucauuguuuuugcauauuucuuaggacaugcaucuuuaagcuuuaucauugcccauauguacagaaagagaauaaagacauauguuuauggaugg

SEQ ID NO: 192342 - RNA, 18091 nt, Homo sapiens
agaggacugagggccggugcuuccgguggcugcccagaacuucuuaugugcggcggcgugauguugggcggccacagagagauugguguuuuugugaggcagugagaccuaagguauuucaucuccacugcugccgggccuggcggguguggggaggcuguagggggucaggagggaaguggaucggcucuugguggguagggggcgggaaggaggagauucaggcgugcagagaggaugaggagaauggggcgggccgcgugugaggggucgcgggaugaggaucgagcuagggguggguguaaaugagggauuaugaccgugacucgugaauaacacuccugggaauaugucccaaggaagucauccaaagucaggaaaugcuuuaagccuuaagaccucgguccgagcuuuauuuauagcggguagcgggauaaaguuggguacagcuaggagcaguucaguacauuaugucacuucacugaguguaugugaaguggccucuaaaacuaauuuauuaaacuuuuaaauaacauagggaaaugcuaauauauaauguuagaugaaaaccgugauacaaaguugcacaguauaacugaaaaaguuugacagccaaacuaugcauagaagagucuagagggauuagucauaauuuucuuuggaugaauguuuuuucguuaacucuucuuaauuuuuuucuuguguaugauuuuuguuuccaaauaaguguaaagaacuugaaaucauuuuauaguggaaauacaauaaacuuggaaaacaaguugggggagggauguacuuuuguuuaaaccugcuggaaaugccaguucaccugaaucccuugauucucgucaugaguugucuuuaaagaagaugaaaaacagaauuaaaugguuauauacugagcaccggcucuuaguuuucugaccaccucuccggagaccugaacuaauacaguggucuuuucccuccuaaaacacccaggguucuugauuucauguucuccaaaaaacuuauacucuggagauugugaaacaauagguauacaauuaguuucaggcaaaaucaguagcguuggggaaugccugaagagcauuuaaaccuugguccuccuggcccucugaucuuauacagugagguucuccacuaccuugacuuuaaugauuaacccuaugucagugauuuccaaauccuuaccucugacugccuaagguacauugguaccauguagacaucuuacaugaagcacauguuaauuucaauuugucacauacuacacacguuccuccccuacugcccccacccccaccuccccaacagggucucacucugucacccaggcuggaaugcaguggugugaucauagcuuacuguaaccuugaacuccugagcucaaauccucucagccuccauaguaacuaggacugcaggugugggacgcugcacccagcuaauuuuuauuuuuauuuuuauuauuuuuuauuuuccuuuuuuauggaacgcuucacaaauuugcaagucaucccugugcaggggccaugcuacgcucuguaucauuucagucuuaguauaugugcugccaaagugagcacccaccucauuuuuaaaaauuuuucuguagaauuggggucucccuguguugccuaggcuggucuugaaauacuggcaucaagugauccucccaccucagccucccaaagugcugggauuacagguguuagccacugugccugcccuuccuuuccuuucuuccuucccucccccucccccuuccuuccuuccuuccuuccuuccucucucucucucuuuuuuuuuuuuuuuuuuuugagauggagucuugcucugucacccaggcuggagugcaguggcgcaaacucggcucacugcaaccuccgccagccggguucaagcgauucuccugcugcagccucccaaguagcuggaacuacaggcacacaccaccacgcccagcuaauauuguauuuuuaguagagacaggguuucaccauguuggccaggguggugucgaacuccugaccucagaugauccaccugccucagccucccaaagugcugggauuacaggcaugaggcaccacacccagccugcccugccuuccuugccuuugaaacaugcucugguuaaugguucagcaguuucucaagcuaaaaaucuggguguuauccuuaauucuuuuuuccuccucacuacuuauauccuaucgauaucacugucuauuccaucugccuuaaaagcaucucuugaauauggccuucuuucucuacugaaauaguugcaaacuugcuucauuuucacuuuguggcauucaaauuacuugucaacuuucuuccuucucagguccauucugcauauuguuacuugaauauaugcugguucccccaagauuccaaauuccucagcaugcccuuuaugaucagagaauaaacuuagaaagauauaucaauaucugauaauauaagguuuuaauugccuuguuaagacauuuugaggcuuuuuauauacuguagauguggggauucaucaaggguguuuaugcagaagagcaaaaugaucaccgcugugcuuuuuuuuuuuuuuuuuuuuuuuuaaagauaauucugcccaacaacacauaguaugcaggcucauuuggaaaguagagacugguaucaaggggaccucuccuuguuuuacccuaauaaaaagggagaagucagaaccugggcuaacacaggaguagaaaggaauggagcagauuuuuguaauuaucacugcguuuuugagaaaaaugugccacauuucuucuuguuaccgaagaugacaauauuaaaauucauucuucuaaaaaccucaguaaacuggcccaugcaguggcucacgccuguaauccuagcacuuugggaggccaaggcaggaggaucacuugaggucaggaguucaagaccagccuggccaacauggugaaacccagucucuacuaaaaauauaaaaauuagcugggcaugguggugggccccuaucccaguuccuugggaggcugaggcacaagaaucacuugaacccaggaagcagagguugcagugagcccagaucaugccacugcacuccagccuggguaacggagcaagacugugcccccacgccccccccaaaaaaaaaccucaguaaacuuauguuuguuuuucucuuauucccaaauccuugucuugugcuacccuggccacacacacccucauugacauuagacagaauuugguauccuaaaauauauaaaucgacuuggauguaauuggcccauuaggaauuuucucugcccaugaaaguguaucauggcauuauuuaucaauaaaauucuuuuuaaaguacauaaguagauauuagggagaaaacauuauuaucuuucauaagaccagugggacagagaucacaguuuucuucauuaguaaugacuggacuuuuuucuccguuuagcaagccgcugcagaaccacugaaucugacaucauauauaaaagcauaauagacccuuuuuuuuuuuaagugaaagauccuaagagcaaggacaaagcuagcaaggagauaugcgaaauaauuuacagauaagcaaaucaccagguugguagagaauacauuucauuggauuuagagucugaagacaacuucucaaguucugccuuugacacuuacucaguaaaacaaggcugaaaaaugucauuuagauucagugacagggaagcacugguggccuggugagagauguuuuggagaagaaauuggaauggaauucauuuuaaguauauuaagaagagagugaguggugaaaaauaugaguacugccaguuuacacaacuauuugauaacuaauaagguuaaacaucacuuuauauauguuuguagauuguugggggguuuuuuguuuuguuuuguuuuguuuuaaguagagacaguaucuugcuguguuguccaggcugaucucuggucucgaacuccagggcucaagugauccuucugccuuggccuccuaaauuguugggauuacaggcaugagccacugugccuggccaacagucauuuuguuuaguuuuguuuuugagaccgagucucacucuguuguccaggcuacagugcaguggugccaucuuggcuuaccguaacaucugccucccagguucaagcaauucucgugucucagccucccaaguagcugggauuacaggagugugccaucacuccuggcuaauuuuuuuguauuuuuaguagagacgagguuucgccauguuggccaggcugaucucgaaauccugaccucaggugauccacccgccuuggccugccaaagugcucggauuaaaggcaugagccaccuggcccaguaauuuuuuuuuuuuuuuuugagacggaguuucacucuuuuugcccaggcuggaguguaauggcaugaucucagcucacugcaaccuccgccuccuggguucaagugauucuccugccucagccuccugaguagcuggaauuacaggcaugugccaccacgcccagcuaauuuuguauuuuuaguagagacgggguuucuccauguuggucaggcuggucucgaacuccugauggucaggugaucugcccgccucggccucccaaaaugcuaggauuacaggcgugagccgccgcgccuggcucuggcccaguaauuguuuuuauacuaaauuuuuuuuuuuuugagacagaguuucacucuuguugcccaggcuggagugccauggcacgaucucggcucacugcaaccuccaccucccggguucaagcgauucuccugccucagccuccugaguagcugggauuacaggcaugcgccaccacagccagcuaauuuuuuuuuuuuuuuuuuuuuuuugagacggaguauugcucugucacccaggcuggagugcaguggugcgaucucgauucacugcaaccucugccuccaggguucacgccauucuccugccucagccuuccgaguagcugggacuacaggcgcccgccaacacaccuggcuaauuuuuguauuuuuaguagagacaggguuucaccguguuagccaggauggucucgaucuccugaccucgugauccgccugccucggccucccaaagugcugggauuacaggcgugagccacugcgcccggccaauuuuuuguauuuuuaguagagaugggguuucuccacguuggucaggcugguuuugagcuccugaccucacgugaucugcccuucucgggcucccaaagugcugggauuacaggcgugagcugccacacccaggcuuuauacuaaaauuagucuuucucagucuguguuuauuauugcaacauuuuauucuuauauccauuauuauauauuuauguauccacugauugauaguauuucaaaauauaauuuuccugaggcaguuuuucauuuuacauuaaauaguauuuuuuauguuuauauuucaaagugaguauucagguauuacagcuuauccaaauaauguccuuauucucccuacugacuauauguaucuuuuuuuuuuuuuuuuuuuuuuugagacagaguuucacuuuuguugcccaggcuggagugcaguggcgccaucugagcucacugcaaccuccgccuccccucccagguucaagcaauuguccagccucagccucccgaguagcugggauuacaggcaccugccaccgagcccagcuaauuuuuguauuuugaguagagaugggguuucaccauguuggccaggcuggucucgaacuccugaccucagguaaucugccugccugggccucccaaagugcugggauuacacuuuggguguaauggguguaagugcuggguggcucaugccuaugagccaccaugccuggcuaccccauuuuuuguuuaaaagaaaagccauaacauguaaaauccuauauaucuuugugucuuucuuuaacauuuucagaggcuaaacaccaaauuguuaaugaugcuuuuaucaaggcuuugaaauguuggaaaggaggaggagcuaaaggggcuggcacugaguaggagggaacaguuuuuuuuuuuuuuuggagauagaguuuugcuccugucgcccaggcugaagugcaauggugcaauuuuggcucacuguaaucucuaccuccuggguucaagugauucuccugccucagccuccugaguagcugggauuacaggcaugcgccaccaugcccggcuaauuuuuguauuauuauuagaaacaggguuacaccauguuggccaggcuggucucaaacuccugaccucaggugauccacccgccucagccucccaaagugcugggauuacaagcaugagccaccgugcccagccuaagcauguacuuguuuuuuguuguuguuguuucuuuuuugagguggaguuucgcuguuguuacccaggcuggagugcaauggcacgaucucagcucacuguagccucugccuccccaguucaaacgauucuccugccucagccuucuaaguagcugggaguauaggcaugcaccaccacacuuggcuaauuuuguauuuuuaguagagaugggguuucugcauguuggucaggcugggaucgaacucccaaccucaggugauccucccgucucagccucccaaaguacugggauuauaggcgugagucaccacgcccagcccuaagcauaugcuucuuuagugauucaaaugccugggggaaaaauauucagggugaaaaaaugaagauaauacuugccuaaccuacuuuacauuauuuuaaaagauuauuguaagauaaaaugcaauagggaaugugaaaauguucugaaaauuauuaagugcuguugaauaagaugaaguagaaguagaaauagaaacagugauuuuugagugucauuucaauagagggauaaaagccacuuuggaaggauuugaaauaagugcuaauaaagucagagaugugcauaucaguuauucauugauuuggcagugaaaggacgaauagaaauuagaugauggaggagacuuuucuuaaauuuuuaauuggaaaauuuucuaacuuaaaaguugaaaguaccauaaauacuaacauagccucaaucuagacucuacaauuauuaacauuuugcuacauuuguuuucuuucugugugucuauagaaaauuuggguuuuuuuugucaaaccauuugaaagcacauuguaggcaucaugacauuuuaccccaagugcuucaacaugcuuauuuaaauaauaaggaccuuguccugcauaaccacaauaccauguucacacuuaagaaaauuaauaacucuggccgggcgcgggagcucaugccuauaaucccagcacuuugggaggcugagguggguggauugccugaggucaggaguuugagaccagccuggccaacauagugaaaccccgucucuacuaaaaauaaaaaaaaaauuagcugggccugguggcaggcaccuguaaucccagcuacucuggaggcugaggcagaagaaucgcuugaacccaggaggcagagguugaagugcgccgagauugugccauugcacuucagccugagcaacaagagugagacuccgucucaaaaaaaaaaagaagaaaaauaauaacucuacaauauuuucugauauccauuccauacucagauuuccccaguucuaaaaaucuucauuagguagaagauuuuauuucuucaagauccaaaguauauacauugcauuugccugauagcucaguagucucuuaauuuauaauacucccccuguccuuuugucucuccacauuauuaaccugggaaggggcuaagccguugucuuaccaaauguccuacauucuagauuugucuagauuucucaugguguaacuuuccuucuuaaucauuucagguaaccuuuaucaaaaggauggaguugggaaaaggaaaacuacucaggacuggacugaaugcguugcaucaagcagugcauccgauccauggccuugccuggaccgaugggaaucaaguuguccuaacugauuugcggcuucacaguggagaggucaaguuuggggacuccaaagucauuggacaguuugaaugugucuguggguuguccugggccccaccuguugcagaugauacaccuguucuacucgcuguccagcaugagaagcaugucacuguguggcagcugugucccagcccuauggagucaagcaaauggcugacgucucagacuugugagauuagaggaucacuaccuauccuuccccagggcuguguguggcacccaaaaugugcuauucugacuguguugacugcucaggaugucuccauuuucccuaauguucacucugaugauucccagguaaaggcagacaucaacacccagggccgcauucacugugcauguuggacccaggauggccugaggcuggugguggcaguaggcagcagccugcauucuuauauuugggacagcgcucagaagacucuucacaggugcuccuccugccugguguuugauguggacagccacgucugcuccaucacagcaacuguggacucacagguugcuauagcuacugagcuuccauuggauaagaucuguggcuuaaaugcaucugaaaccuuuaauaucccaccuaacaguaaagacaugacuccguaugcuuuaccaguuauuggugaaguacgcucuauggauaaagaggcaacugauucugaaacaaauucugaaguaucaguuucuucuuccuauuuagaaccucuggaucuaacucacauacauuucaaucaacauaagucugaggguaauucucuuauuugucuaagaaaaaaggacuacuugacaggaacuggccaagauucuucacauuugguccuugugaccuuuaagaaggcaguuaccaugacgagaaaagucacuauuccaggcauucugguuccugaucugauagcauuuaaucuuaaagcccacguaguggcaguggcuuccaacacuuguaauauaauuuugaucuacucugucauuccaucuucagucccaaacauccagcaaauucgauuagagaacacugaaagaccaaaagggauauguuucuugacagaccaacuauuacuaauuuugguaggaaaacaaaaacucacugauacaacauuucuuccuucuucaaagucugaucaguaugccauuagcuugauuguuagagaaauaauguuggaagaagaaccuucaauaacaucaggugaaagccagacuaccuacucuacuuucagugcuccguuaaauaaagcaaauagaaaaaaguuaauugaaagucuuuccccagauuuuugucaccaaaacaaagggcuguugcugacaguuaauaccaguagucagaauggaaggccuggaagaacacuuauuaaagaaauccagaguccucugucuaguaucugugauggcuccauagcucuagaugcugagccuguuacccagccagcaucgcugcccagacacagcagcacaccagaccacaccagcacacuggagccuccucguuugccucaaagaaagaacuuacaaagugaaaaggaaacuuaucagcugucuaaggaaguggaaauuuuaucuaggaaccugguugaaaugcaacggugucuuucugaacuuacaaaccgucugcauaaugggaagaaauccucuucaguguauccacucucucaagaucuuccuuauguucacaucauuuaccagguaaauucuccuuugaggaacuaccacuauacauaaaagcuccugcagccggugaguacugcaagaaacguauugaugaggaagauggugcucuaacugagcuucacuaagcugggcauguuauguuacaggcaaguugguacaccuuugcagguugguugguuuuuagccugccaaccagauaggcgcacauaucagucugcaucaugauuuuaucaggugcaugacguggaaaaauaaaugucugcacuaauucgggcaauuuauauuuagaaaaaaaaucauguuauuucauugugacaaccuuuuccuuauauaauagagauacuccuccaguuauaaaaaagguuauguugcugggcuccauggcucacgccuguaauccuagcacuuugggaggccgaggcaaguggaucaccugaggucaggaguucgagaccagccuggccaauguggugaaacccugucucuaacaaaaauauaaaaauuagcugggcauggugaugggcgccuguaaucccagcuacuugggaaagcaggaguaucacuugagcccgggaggcacagguuucagugagccgagacugugccacugcacuccagccugggcaacagggcgagacuccgucucaaagaaaaaggaaaagguuauguucauuuaaaauguuuugaugcauuucuuuaugcaugcauguccaaacauuauauaagugggaucauauuauacauguuuuuaucauggacacuuuccuccuauauaaaauauggccuugccccaucuuccccuuaauccgcuguaaccagcagcuuaacauggauccuuucgugacuuucuccauggucacaugaucuaacacaggucuuuguguacauagauauauagguaugugggaaugguuugucauuguuuuuacaaaaauagggugauauggugcacucuuuacuucauacugagaguaugcucuuuauuuagccauucccuuguugauugacauucacuuuguuuuuaguuuuuagcuacuccaaaugaugcugcaguaguacucuuauauguauccauucauauuaguaccuuuauuucuguuggauugguucccagaaguagaaaugcaaauuugaagaguauauguguuucuacuuuuaauugaguuaccagauugccucucaaagauuuuuacuuaacagugcaucaucacacgcccgccagcuauguauaaggcuguccuuuuccucguaugucaccaaucugaucagugacccuccugcuucagccuccugagcagcugagacuacaagcacaugccaccacacuuggcuaauuuuuuuuuuuuuuagcagagacaggaucuugcuauguugccuaggcugaucaugaccuccugggcucaagugauagucuugccucagccucccaaagugcugggauuacaggugugugccacugcauguggccccaacccuacauuuuuuuaaagaggauuuuugccacauuaacuacauggaguuuucaguaguagaguuuuaauuuuuuuuuuuaagucacagcuuugcugugaggagcauuuuauuuuauuuauuuauuuauuuauuuauuuauuuauuuauuuauuuuugagacggagucucugucaccaggcuggagugcaguggcgcgaucucagcucgcugcaaccuccaacucccagguucuagcaauucuccugccucagccucccaaguagcugggauuacaggcacgugccaccacaccuggcuaauuuuuguauucuuaguagaggcgggguuucaccguguuggccaggaugagcucaaucuccugaccuugugaucugcccgccuuggccucccagagugcugagauuacacguguaagccacugcgcccggccuaauuuuuuuuuaauuaaaaaaaauuuuuuuuuaacuauagagacaaggucuugcuauguugcccaggcuuguuuggaaguccugggcucaagcaguccuccugcuucagccucccaaagcgcugggauuacaggugugagccacugcacccagccauaguuuugauuuuuuuaaaauuauuuuauuuauaaaugugauaacugguuuggauuucuuuccuacuaugacuuuuuaaagaguuuguuuucuuuuucuucugucuuuuuuuaauagguaauucauuuauuugguuuaaaaagcaaaacuguauuuuaauaaaaacuguauaccaagaacucuuauuccuacccuauguuucuucagccuguucuccuuuccuccuuuagguaaccauuuuuauuuuuauuucuuuaugcagauacuagcagacuuuaguuauguauuuuuauuuccccuuuuguuacacaaaagggaaggugauauacacaccuuuucauuuuccauuuaauaguauguccuagagagcucuuuauaucagcacacagagcucuuuuuucaucuuuuuuuccacagcugcauaguauuuuuuuuuccuaauuacaaaaguaauauauacuuguugaggaaaaaaauuuuaccauuacagaaaguaaaaauuuuccauaauccaaccuuuagagaaaaucacagauauagcuaaauauuuuauuagauguuagauguaaauauuuccauauuuuuucuguacauuuaucuaauccaaaaaaaaucuaauauaaaaauauauuauuuuuaaaauuuucuuuaaauaggcuauuuuacuugcaaacaauaauauaucuuucuguuuuuaaaacacuuauaaauguaaaauuuuauauuuuuaaaaacuaagguuaaaacaaccauguuuggccaggcacaguggcuuaaaccuguaaccccagaacuuugggaggccgagauggguagaucacuugaguccaggaguucgagaccagccugggcagcauggcaaaacccugucucuaccgaaaaauacaaaaauuagccagccgugauggcacccaccuguuuucccagcuacuugggaggcugaggugugaggaucaccuaagcugaggagguugaggcugcagugagcugugaucgugccacugcacgccagccugggaaacagagcaagacucugucucaaaaaaaaaaaaaaaaaguuuuguugcccuuucaauuccucaguuuuuuaguuuauaauuaugucauccaaccaagcuguugucaguaguuaucucuggaggauagaauuuugggggcuuuacugucugcauuauauauuucuguuauauuuuuauuuuauuuauuuauuuuuagauagagcuuugcuuugucacccaggccggagugcaguggcgcgaucuuggcucacugcaaccuccgccuccuggguucaagcgauucucugccucagccacccagguaguugggauuacaggugugcaccaccacacccagcuaauuuuuguauuuauaguagagaugggguuucaccauguuggccaggcuggucucgaacuccugaccucaagugauccacccgccuuggccuuccaaaguucugggauuacaggcgugagccaccacacccggcccuauuauacuuuuaaaaaauugaucauuuauuccuuuuguaaugagaaaaguaaaaguuacacaauaaucaaaagcaagaaauaguuuccccuguaauuucagaaauuacauuucauaagacgugaaauaaaugauuaguugguuuugacuuuuacaguuuauuccugugacuucauuuaaaaauauuaguggacauauucuuugagugguucauccuaccacagugauguauaguuuuauuuucuuuuuaugagauggggucuugccauguugcccaggcugcucuccaauaccugggcucaagcaauccaugcacucuggccucccaaagugcuuaacaacaaaauaaguuagacacauaacuuauacaacuguccuucauuuauuuauuuauuuagagauggagucugucucugucacucagccuggaguacaguggcaccuucucagcucacugcaaccuuugccuccuggguucaagugauucuccuaccucagccucccgaguagcugggacuacaaguguguaccaccaugccuggcuaacuuuuuuauuuuuuguaaagacaggguuuugccauauugcccaggcuggucuugaacuccugggcucaagugaucuguccaucuuagccucccaaacuuuugguacuaaggggugagccacugugcccagccaauuuuuaaugacuuuaaaauuuacaaaucauuuauuuuuauuugugcuuuuucuaagcuaugugaauuuugaccaugguuuguuuauuuuaugcaaauccucugcuacucuaccacuuaggacacucucucggcauuuuuuuuccuaauaaaccaugaggugucuuagcuauaucugaaacagccaagaagguguucuuaccgucagauugugucucucaggcugcuguccaucauccuuuuaguguuauuaguuguauucuaggagagccaguuccuagugaugaagaacccugaggaaagaguagaacaaaaggaaaaauaaggcuguuuuguucggauuuuuuaguuguguuaaauaaugcagcaaagagcuccuuaaaacugaaguccaguugauuagugguaauagauaagaauuuuuuaaaaaacuauuuacacauuccuuucuuaagaaauguuaacucgauuacuucugcaaucaguuuaacaacuuuuauuuuuuauuugcagaaaccuuauuaucuagguccuguuguugaaaaaagagcggugcuucucugugaugguaaacuaaggcucaguacaguucagcagacuuuuggccuuucucucauugaaaugcuacaugguaggucgugcucagaaauugacccuagcuaacauccuugccucccccaccaucuguuuuaacuaugccgguaaugaaaaugagggauaccaaccauucaguaauucacuggauaguuaacaaguaaucuauuauuauuauuauuauugagacagggucuugcucuguugcccaggccagagugccucggugugaucauagcucacugcagccucgaacuccugagcucaagcaauccucccaucucagacucccaacuagugagaacuauagguguucacuaccaugcccagccaaguuuuguuuguuuguuuguuuguuuuuuggagauggagucuugcucugccacccgguccuggaguacaguggcgcagucucagcucacugcaaccuccgccucccggguucaagcaauucuccugucucagccuccugaguagcugggacuacaggcgcacgcugccaugccuggcuaauuuuuuguauuuucguagagacggguuucacuguguugcccaggcugagcucaggcaauccgccugccucggccucccaaagugcugggauuaaaggcgugagccacugcacccagccucagccaaguuuaaaaaaaauguuuguagauaacggggucucacucuguugcccaggcuggucuugaacuccugaccucaagugauccguccaccuuggccucccaaagugcuaugauuacuggcauaagccaccacacccagccuuaacaaauauuauuaauugccuacuauauacccaggccuaguauaggugccaaaacauauggaaaauaugcacccugcccuuagggaacuuacagccuagcuggaaaaguuaaauguacauaugaaaaaauaagaaaagacuuacaaagcaguguauaacaacugcaaggaaguaacagaaagccucauuuauuucuguugcacuaaaauguaaagaucauagcagcauugcagaauguuucuuucuuucuuuuuuuuuuuuugagaccgagucucacucugucacccaggcuggaaugcaguggcaugaucucggcucacugcaaccuccgccuccuggguucaagcgauucuccugccucagccucccgaguagcugggacuacaggcacaugccaccacgccuggcuaauauuuuguauuuuuaguagaaaugggguuucaccauguuagccaggauggucucgaucuccugaccucgagaucugcccgccucggccucccaaaguggugggauuauaggcgugagccacugcgcccggccuacagaauauuucuuugaggaguugccauucuaauauggaguaaacauggauguucaaaggauauuccuaaguggcaagggacugagucaugccagauucaucagauguggagcaugguuguuuucuuaugccucauucuuguaacaguagccaccacauugaacaucaaauaucauuucauuuuuuccccuuuuucuccuaccugacccuaaguaauacccagucuucccaauaccccauucucuguaaaaucuuacaaggauugaguugaauauuaucaacuacuauauuccuucacucagaaaaaaaaauuuguagucauauguuucaucauaagaauaauauauacuaaauugccuguguauuuauuuuuauuugcagauucccacuggauucuucucucugcugacagugagggcuuuaucccguuaaccuucacagccacacaggaaauaaucauaagagauggcagccuguccaggucagaugucuucagagacucuuuuucucacaguccaggugcuguuucuucucuuaaagucuuuacaggccuugcugcccccaguuuagauaccacuggcuguuguaaccauguagauggcauggcuugauaucugcaguguccuugcuguguagcucuucagaugagaccauuacaaacaaggccugcuugacacuggacacucgccaaugagacucccacugcacucaggcgaagcgcuugccauggucggcucuccugguuucccccuguuuccccugagcugaggcucgcugcuguguagcagagcucagucuuuauuagauggcuccgaaagugguguuuauguauucaugacugugugguuuugacuaagggcagaauucucagaacaaaacaauauuauggugccauauggaugguguuuuaugguuucucugaggcuuugugucccuuguccaaagcugcauugaagcugucuuaggagcacuuaaaagauaccuuggcauuguuauaggucuuuuucuuggcuucaagaggagguugaggagucugcuggggggcaugugcucuagcauauuaaccucaaaccagcaagaauuagcagagcuccaaggaggaccagagacccacuggcuucugcucucaggaacaggaaguggcucugauguugccuggaccucccagaauuuaaaccaaacccucuugcuuccuuaacaaauucuggcugacgaagguccagguacucuuaaaaacuggcccugggaaaauuuugaaugaaauuucaagggaauuuguccccucuggguuccacuugagguugugccgaugcugcuaccacacugucgagcccagguaaguccuacugcaggauuuugugcuguggccacucaugagugucccugaaauaacuuuuuuuuuuuuuaaauccaguuuugggaucacgcaacuuuccuauuuuucucccaguagucagcucccuuaguuaacuugucacuuuaauuugauauuuuuauuuucucuccuuuuaagucuuagagaccagcagagaaucugugagagaaaguauuucaggaaguuagaaauucaaccgaaucugagguaguccuaaaaagugccauuuuguuucacuuaugggcuaaaguaccagcuuagucagguaagagcccugacccacuucagaugguaacaccacuucucacugccuucagauggaaucacagauuucagucacggcgcauaacaaauugaucagugaguggcuaggcaucugcagauaaauuguuucagccauagaagcuccauuagcacauaugcuuccuuuuccccccuuccuuuaaaaucaucuggaaagaaacuauuuugugcccuuggggacuccugucugucuguuacaguuuaccaagauggagcuggguuaggaaagaagugagggcccauuuugugguucaagugcacuagacagcugcugggguaggaagcacaggcaaugucuguaaucagcugugggagagcagugacugagaacagucugaggccuggcuccacuuggaaguaucuggggugcgaugaaaucacaauuaucuugaagccuaaagagggaacuacaagacuguuaacuaagaucaaugugggcaccuaaaaggguauguuaaaaucaccauuucucaggucaaaauacugugaauaagucuucaauaaaaucacuaaugguuauuguggcuguu

SEQ ID NO: 192343 - RNA, 20643 nt, Homo sapiens
aaauccgagccucgcgugggcuccuggcccccgacggacaccaccaggcccacggagcccaccaugccgcgcccggcccccgcgcgccgccucccgggacuccuccugcugcucuggccgcugcugcugcugcccuccgccgcccccgaccccguggcccgcccgggcuuccggaggcuggagacccgaggucccgggggcagcccuggacgccgccccucuccugcggcucccgacggcgcgcccgcuuccgggaccagcgagccuggccgcgcccgcggugcagguacaggcgggcggcgggagggacgcgugagcaucgaacgaggagaagcccagggcauccaccaagcgcgcuucaucccggccucaggccgaccguggugcgggggaaagaggccccucccggaugaauccugugggggaaacugagguccagagaaggggagggagaugcccaauaucacucauguguccaggcuagagaugugggucuccugaagcucucacuccccugugauucggccaggagcacagggcagcuggggagcgcaggggcugcugcccagcggcugcugcuaagcuccgucccaguccugaccucuccauucagugagcaaacccuuccugagacucugcuguuaguucucuuggaaucucuccaucuccauccaauaucagggcgugaucuuuccuccccucccacaguccucaggcugccucagacuggaagguaagggaugcgggugugagaccaggaggagauccgaggagccguaggauaccccaggaucaagacacucugggucuuuggcgaacaauucuauuucucuuuuuggucagcaauugauuccugaagcagagcaaagcucauagugcagcgaagcgggcaggucgucugacacagccccugacagcacaugaagggaaacugaggcauaucaaguugaagggacucugugaaucaguaucagaggccacaauaaaauucagggcuccgaaaucccaagcaaggucucuuuccacugccccagccuaccaaccucuuaauaugguuuacauaagauuguaucuucauuuccaaaaagcgcagcuucagucuugcuaaaaagagucugugccaggccauuucuggguaugcagucucauuuggccagccacgcugcaugccucaggcugauuucaauugucuauccccuucugcaucuuucuggauaagcugagaaggagcucaagggacucuuuccugacucaaauacucaguccccguauuugaaguggcagauuugaaauggcaaaagcauugcugcuaaggcaggagguaccgggguccacagggcuagauucagcugguggcugguugcuccaggccgggaauugagggaaagccuuucuucuggaaguuaaucuuacucuaguccugaccugccucccucugggaugggacuggaagaggaaggagagauucagcaccagguggccaugucccccuaagcuuuacuggucuuucauuaccuagaguccgaaccugaucaugaaugauaacccauuaauaaaugcgagauuccacccuguuccaaauuaucuccuuuuagcaaccagaaauugcuaagcuucgcuauggauuuuuauuucuagcaggacuguaaggacucagugguauuaugaguaugggaacauuuuaggagauucagauucuuucuuuguucuugggaaucaaauugcugcuauuuaguaaaugggagugagauucaaaaacaacuaaugauugaugcggaguaccagucaggaaggaaccagauguucacagaauuuucugccaccauggucaagccucagguauuaguuuucuauggccacuguaacaaauuacugugaauuuagugccuuaagacaacacacauuuauuaccugagaguucugugggucagaagucugacccuggucucacugggcuaagaugaaggugucggcagggcuguguuccuuuugggaggcucuaggggagacugcauuucccuucccuuuccaccgcaugaaggcugcugaguuccuuggcuuauggccuuuuucuuccauuuucagagccagcuaaagcagguugaggccuucucccauugaguuacucacauuucuuucaucugccucccucuucuacuuuauaauuacauugacucacugaauaauccaggauaaccucuuguguagagcucuuugacuuaaucacaccugcaaagucucugcucuuugccacguaaaaguaacaugucucuggaauuaggacguggacgucuuuggcgggggacauuauucugcauaccacaccccgaauagaggauucggugugaauaaccaaguggagaaggaaagaaucaugcacguuuaguuauaagaacauagccaugauauuuauaaggacaccauuugggugcuggugaaagcacugucaauuacagaguucauaucuucauguuacccccaccuuuucuuuuucuaauuauacaaaaauacuuugacccaucuccaggaaagauuuucaacauaauucuucuuccuagcucuagaucuaugggacuuuccaggaaugaaguaaaauucuggagguuuuuuuuuuuuuuuuuuuuuuuaguauuugaagagauuuauucugagacaaacaugagugaccauggucugugacacagcccucaagagguccugaguacaugugcucaagauggucagggugcagcuuguuuuuauacaauuuaaggagguaugagacaucaaucaaauacauuuaagaaauacauugguuugguccuaaaaggugggacaacucaaagccggugguggugaggggcuuccaggcuauagguaaguuuaaauauuuucugguugauaauugguugcauuugccuaaagaccugggauccauagaaaggaaauguucagguuaagauaaaagacuguaaagaccaauguucuuuugaagucuuauaguggcuacccuuagagacaauagaugacaaauguuuccuauucagaucuuuuuaaaaaauuauuauuauuuuacuuuaaguucugggauacaugugcagaaugugcagguuuguuacauagggauacaugugcgcuggugguuugcugcacccaucaacccaucaucuagguuuuaagccccacauagauuagguauuuguccuaaugcucucccuccucuugccccccacccccugacaggcgcuggugugugauguuccccucccuauguccaugaguucucauuguucaacucccacuuaugagugagaacauguggugucugguuuucuguuccugugucaguuugcugagaaugacggcuuccagcuucauccaugucccugcaaaggacauggacucauucuuuuuuauggcugcuggaguuguuuuuuuuuuuuuuaaagaaagaaagaauuuugauuccuuuuuuuuuuuuuuggcuuuuagagacugggucucauucuaucauccaggcuggagugcaguggugugauuguggcucacugcagccuugacucucuagcuuuaagcgauccuccugccucagcccccuaagcagcugggacuacaggugccugccaccaugccuggcuaauuuuuaaacuuuuuauagagaugaggucucccuauguugcccaggcuggucuagaacuccggagcucaagugauccuucucccucagccucucgaaguguugggauuacaggcgugagccacugcgccuggguuuaauuccuuuugacuuaacuaaaugcaugacauacagcauauuucagggcggugacuuaaagucaacaagcaggauguuuacugaauacaugagagaauguugauuuuuguggaggaaaauguugccucagagagagguaacugggauucaguagcaagcucccagggacugggagucaggaaaccuggaguccaauccaugcucuaccacuuucuaguucucacaccuccuugaaccucagguuucucaccuguaaaaugaauauaaaaaccaccucugcaccuccagccucacagguugauguguugguaccuugcgauuccuaaaguguuacugaaaggaagauuuucuuuuuguuaauuaaauaccuccaagcagcaggcuaaaaacaagaagauaauuuucugcuuuuaaaagaaaacuagacagagacauaagguaggcuguuccagguaaggcuuuaauuuuuuucuauaaacugcuuagucuaggcauuaauuuugaaucaccuuuuuuuccuacuaaguauuaccuuccuagaguagcaucaacuucugccuccuuauuaggaaaggaaagagccuugagugacacuucaugccccaggaccucauuuccauuuagggcugcaugcguguguugggugagaagggggaaugacuugaaaaagaaguuuagggcugggcacaguggcucacaccuauaaucccagcacucugggaggccaaggugggaggaucaccugagguugggaguuugagcccagccuggccaacauagugaaaccccgucucuaugaaaaauacaaaaauuagcugggugugguggcgcacaccuguagucccagcuacucaggaggcugaggcaggagaacugcuugaacccaggagguggugguugcagugagccaagauugcaccaccgcacuccagccugggugacagaaugagacuccgucucaaaaaaaagaaaaagaaguuuaauaauuggcuuuuuuucuugucucauccugacuuguggauuugauuuuuguaucgaggagagagggugugcaaacagggguugggggaaacaggaaagaacaggaaagaauagaugaacacuaaaauguacugugauacuaaacuguuagguacuuuuguguagaaaagagauaaauucuuugaaggugggaaaucuggcuaucugguuuauaugcuuuuguagcuccagggcuucauacauguaggcccucaaaaaauguuuuuggugaaugaauaagucaaaagagagaugaccaagagaguuaguuggggcaguaggguagauaccagaucacaaucccugcuucuuacgagacaugcucaugaagcuggaagcucacuaaacagauacaagauuaaguuggcaucccucauucuacuuuuuuuuugagaugaugucuugcucuuauugcccaggcuggagugcaauggcaggaucucagcucacugcaaccuccaccucccggguuuaagcgauucuccugccucagccucccgaguagcugggauuacaggcacaugccacuacgacccgcuaauuuuuguauuuuuaguagagacaggguuucaccaaguuggccaggcuggucucaaacuccugaccucaggugauccucccgccucggccucccacaguguugggauuaccaggcgugagccaccgcgcccgggccccucuuucuacuuacuuuuuuuuuuguuuuguuuuuugagacggagucucgcucuguugcccaggcuggagugcaguggcguaaucucagcucacugcaagcucugucucccagguucacgccauucuccugccucagucucccgaguagcugggaauacaggcacccacuaccacgcccggcuaauuuuuuguauuuuuaguagagacgggguuucaccgugauggucuugaucuccugaccucuugauuugcccgccuuggccucccaaagugcugggauuacaggcaugagccaccacgccuggcucuacuuuaaauuaguucagggcuccagugagcccccaaauucacuaaacaggaaagauggccagauggagggagaauucagggauacucuggagcaguuuucagccccuuggaaguggaguaaaagaggggggccaccagaagagccccugagugccuugccucagacuaccauugccugaggcuugggcacagugguuggcagugaggcugucccugagggcccaaggccuuuuacaugguucagggacacauuguccaauugcuccagauagccaagguacuuaagaaauguguagaaucuauuaauucccaggaaucaugagggcccuugggagcaaaagcuuaagcagagggaugagguucuaagugaaauuucaggauucagccagccugcaggugagguauuuggggaaacuucacaccuccaggugaauucucacuagggaauucugaaguccuuggugcuuucaacaccccgauggucuuggggaaggucgcaggcaguggugauguuggggucaggagaugcugccuugccuggccuccuggaaucccagaguucucuggaagugaggauuacugcauuucuaauuguggucugaucauugcuuggucuuuugcagguguuugcaagagcagacccuuggaccugguguuuaucauugauaguucucguagcguacggccccuggaauucaccaaagugaaaacuuuugucucccggauaaucgacacucuggacauugggccagccgacacgcggguggcaguggugaacuaugcuagcacugugaagaucgaguuccaacuccaggccuacacagauaagcagucccugaagcaggccgugggucgaaucacacccuugucaacaggcaccaugucaggccuagccauccagacagcaauggacgaagccuucacaguggaggcaggggcucgagagcccucuucuaacaucccuaagguggccaucauuguuacagaugggaggccccaggaccaggugaaugagguggcggcucgggcccaagcaucugguauugagcucuaugcugugggcguggaccgggcagacauggcgucccucaagaugauggccagugagccccuagaggagcauguuuucuacguggagaccuauggggucauugagaaacuuuccucuagauuccaggaaaccuucugugguaaguuggucagucuuugcuuccaacuagaaaggauguuauauucagacauuguguacccagagaaaagaguauuauucuuuuuugguggaaauuuaaugaaaaacuuaaauauauccaaugcgugugugugugugcacgugugcaugcgcgcgugugugcgaccaaccuaaacacacucuauugguuuaggaauauagagcugcauuauauggaacuugguuugcucauaaaaucuucauguuugcguuagaacugugaaggucugcaaauauccaggauaaaugacccugcuguucccugucagggucaggaaaaacaaaacucaagaugccucuccuguccccucugccccaccacuacauuuuuuuccccugauacauauuuuuuuaguuuuaccaucucuagaucuaacagaacucuguuuguucuccugcagaagacagggagaagcgucuguccuugggagagucagcaggccucuauuccaaugucaccgucagcccgagugugcauuuagugaaugcucugguuuucagacugggcuguuuaucugauuacucuuuguugaagaacaggauucagggaccaggcagauuaggguuucagcucacuugaaagaaagcaagaugaucuuaagaaaucauucuguuaacucugcuacuccuuccauccuuuaggauggaauuugaauaaggacaugcuaauuuuauuggaauuuuuagcaugaauugaccaaaucuaggacuacagauccauucaaugcuggaguuuaauuuuagucacugaucagaauuaugaucugugggacucaugcuuuauuuuuuuaucaucuggagauaaucuuuuguucccucuaugugaauauccaagcaguuguggacaaauuucuaguucaggugaauuuuuaaacauagauaucuuuuugcaauauaauuuauuucacacuuauuuauucagcaugcauuuauugaucucugaugauacaaagauaaagguaaucccuccauaccauuaaguaacauucugggggugggggugagacaaacaaaugaaccaauaauuaauuacaauuauacauuucaaggagacuuuuaaucuagguuaaugugaaacgcagccaucaaugguuugucaggaaaagggagaugaagucuugcucuggggcaacguuuggccucauugcagucagacuuggcugggauccccuugucuuuccugucccaggacacugggcuuucacaagccaucacuggcuuugguggcaucuacuuggcauucguuggcuuccaaaaagaaaguggcuuucuuucucccaggaaaucacccucccacuccaugcuugugggugagagccucuccaucaacaugcuggucuguggcaaaguuggguuucaaagcuagcaccugggguugggcuucgaaggcuauaaaguaacaaguggugaguggcaaucuuuuccuucugguacaaaagaccugcuuguucugggggaaaaacguccucucuauggaaaaaagacugagcggcagcuuguuguagucaacggguuggaaagaucauuccaugaaaaggcccuucuugggaaaauauuagccuuguccuguugccaagggcaguggagguuggguuaccugccacaggagggccagccuccuucaacaggccuccuugguuucucagaaaugacuuaauucauugauucaucuuucaaaagaggucacuaggaaaaaaauauccaaugagauauaaauggcuccaggagcaauaagauggagauguaguuuagcuaauguaaucucauuuauuuuguucuuuucuuuuuaccuguuuguauuagcauaugaguucacuauggauuuagcguauggaugacuucacccaccuuacauauucagaagacaguuacccgaacuguccucuaccauuugcauguucaaauauguaccacugcccaccugugaguucguucuaggcuuagacccagacuugugugagaauucuguuuagacauaggcuauagaaccuuggaaaucagauucuggcuacaaugggacaacuagcucacgucacuucaggcugugcauuuauuguucucccauuucuugugguggggaagcacaaaucuuuuuuucauggggaggcggauaagccaaauaaaacauccaauugccuggccuauguaaguguuuggcuucagcuccaaacuccaaauucccuuucucccuugagaaagucuauauagcaagauguguacuuuuaaauuagcaacaauuucuaguuuaagaguagcauugcuaauaagccagaggcagaaaacaaauaaccauuuuuuuauagugaaguaaagauggacucggaaaggagcccagagagcaaugucuauugacaugggagacgguaucugagauguuuccuaagugucagugcugacuguuguaaacuuccucucacagcgcuggaccccugugugcuuggaacacaccagugccagcacgucugcaucagugauggggaaggcaagcaccacugugaguguagccaaggauacaccuugaaugccgacaagaaaacguguucaggugaggccuguguagggggccgugacugaaucaaauacuugggaaccuaugcuccagguuuuggacuggccuugugcuuugacucucugaccccuuuuuaccuaacugccuuuuggcugguuuacugguguucaucagcaguuuucccugaaaaggagcuuagggagaaaagugaaaugauagauaaaucagcuuauuuccauacuuuguaaguuuuaaauaaaaucguaggagaaaaggcuacuaagaaagagguccaggcugagugcaguagcucaugccuauaauucccacauuuugggaggcugagaugguaggauaguuugaggcuaauucgagauuagccucgagaacauggugagaccccaucucuacaaaaaauaauuuaaaaaaaaaagccaggugugguggugcaugccuguagucccaguuacuugggaggccgagaugggaggauuguuugagaccaggaggucgaggcugcagugagcuaugauaaugccucugcugcacugccacagagggagaccuucuuucagaaaacagaacccacacacacaaaaaggaaaagaaacggguccaagauucuuagcccuuuugaggauuugaaaauuuuccuggauuuuauuucauuacaugcaagcuacccucuuccucucuagucauagaugcucauggaaucuagaaguagcaaagaaguuagagggguacucacuggucugguacauagauacauacauggagucaaugaggaaugggaauuauauauuuuuuuguuuuguuuuuaauccuagaaaaaaguuuuugggaggaagaaagcuuagagauaacuuaauuuuauagauaaugaaauugagauggacagaagggaaaaaacuuaccuaugucacagggucucuuagugaaagagccaagaccggaggguugguucccaacucccagcugccccucccuuguuucauuagcucuguguguguguguguguguguguguguguguauaacuguaaguggcguggcccacaauuauuucugccaugcucugcaugcauuuacauuugucccaaucaucuuuugauagcucuugauaggugugcucuuaacacccacggaugugagcacaucugugugaaugacagaaguggcucuuaucauugugagugcuaugaagguuauaccuugaaugaagacaggaaaacuuguucagguaagugagggaggagucuuuacuauugcuacuuagcucucugccuaccuacccggugauggaagggcaggucacauugacugggaaguugguguguuuuccucucuugccaccuugagcuuuucccauuuuuaagucuuauccaaaauguuagaaaugguaacauguauguaucucggcccaaauacauaaauauguugcucauuuccuucucuguagccagccugaacaauccuucccaaaugcuacagacaauucaguagguugaaaucacauaacaacccacaaguuaccuguugcuuacaaagggaaagacaguaacuuuauaguggagaaacuggcagacaucaccuuaacuaagugaucaaaguuaacaucaucagugaugacacauagugacaucauguaugaccugacaugcugugcucaauacuguggacacaacagcacaccuguaguauucuugcuaaaaauucaggauuaugaggaaagauuagaaaaaccugagagacacucucaguucacaaaauaguuuuccaguacuucucagaaacgugaaagucauaaaagacaaagaaagacuuaggaagugucccagguuggagaggacggagaugugaaacugaaugcaauguggaauccuggauuggauccuggaccagaaaaaggacauuaauggcaacauuugaauaaagucuguagauuaguaaaucauauuauaucaauguuaauuucugguuugauaaucauacuaugguuauguaaauuacuguuuggggaaacagggugaaguacaggaauuuuuugcacuguuuuugcaaccuuuucauaaaucugaaauuaucucagaugaaaaguuuaaaaguaaaaaauaguuuaaaaauauaucaguagagaggaaagugcauugaaugaaaaugugugucuugaguuuuuaugcugcucugaaucaaauggucucccucgcgcuccuuucccucauuuaaaaaauaggagaggguugaacuacaauuucuucaaacucuaauucuauguuuuucugaaucuaauguaauuagccacacaacuguugguaucccgcugaguugggauaaguacaauaagccuaaaaggaaugcuagaaaguauuuaugagauacuuagguuauaaaaacucaauacugaugauuuccaaaagcaauuguggaaggucagagaauaauuauuguaugugcaggauuucacuuaacucaguuaacuucuaguuagaaaaaaacagugccaauggcuuugaauaguuuccaguaaguuuuccucauauguuuccagcugcaaauaagguuucuauccuggguaauaaaauacuuuuccaccuucuauuucuuuucuccugacuuuuuguuucacagcucaagauaaaugugcuuuggguacccaugggugucagcacauuugugugaaugacagaacagggucccaucauugugaaugcuaugagggcuacacucugaaugcagauaaaaaaacauguucagguaagauccacucaaaaaauucuuucauacuugggucuuucacaugaaaccaacuugcaacucaccagcaaagagguuuuuaaagguaacuuaagaucaagguucagacauucuaucacacuuuuagaugaaggcacacauugcucagaggguggugagcucacuggagcaaacauagauuacuucagaaaauuacugggaaauagguagggagugggggauaugagaaaaacuaacuaaauguaggguccuuauccaggaaaauuuuauagcucuguacacugaagacuuuuaagcaaagagaaaacuuuaguggaagucaguuggacaguaacuauuuggugugauaggaugaacugaucuuuuuccaguuaaaacuuggccuggaacuuuucuguaguguuaaucuuaaagcuggaugauuuuaguaaagaagacuuugugaaugccugaauuagacccacacagaucuuccaguaaguuugaggccagucacucccuggcaguuucuagacgaucaaucauuggugaaacucagccuuauacguuggccaaugagcccaggccagugcuguuaauccucauuaauuugauuuaaacuuacuggcaggacaggguggcauuuauaaauguaaaaacacuccugagagaaauuccaagcucucaaggugccguuuagcuuuggcauauugaauguguuuuagauuugacauauauuuuccucucccuugaggacauacagacuucaucaagauagacaaagggaaauggcaugucacccaguccccucuuuuuuuuuuuuuuuuuuuuuuuuaaagggaaaccaguaaaaaaauaccggacaccuacuuuguucccaguauggaacuaagcauugggagcauacaaagaagccuaaguuucugccucugagcaaguuaaaucugggugaacagagagccggcuccuuaugaaagcagagacugagccagggagagggacugauggaaacaaagggcuguagaggcuggggaggugggcaucugcgaagggcugguggugggccuugaaggagggugaagguuucaauggagacaaguggaaaguggcacuggcgggggacuggcuugagcugauuuguucagggcaggaugacuaagaaaguugggguggagagaacucaccuauggcugcacuucucaaacuagugacaagugucccaguugguacuuuaagcugccaggaacauugaagaccugggaaaacaaaccaaaaacaaauuuccauuuaaacuaacagauaguauggaauaaagugaagcaaucuauuuuaaaaaaaaacauaaaucaaagaaaauuuucaguuaaggcagacaacacucccagaugccaguauuccauauucuucaauaccuacuguaggccaugcaggauucuaggcauuuuagauacaguaauguaccuuaauacucacagcaacguuaggaggaaacugauucaguaacuugcccaugguuacucugcuagcaaguagcagacccaggguuugaacccagguacuuccucuagugguuacauaggcucuuaaccacuaagccuuacugucuuaauguacaaagcacaggacagugaagagggacagaagagaaagaauacuagugggaaaguuaguuauauauauauauauuuuuuuuucuucucuuuuuugagacagggucucauucugucacccaggcuggagugcgguggugugaucuuggcucauacagccucuaccucccgggcucaagugauucucccaucucagccuccugaguagcuaggacuacaggcacaugccaccacaccuggcuaauuuuuguauuuuuuuguagagaugggguuuugacauuuuguccaagcuugucuugaacuccuaagcucaagcaauacaccugccuuggcuucccaaagugcugggauuacaggugugagccacugugccuggccuauuuauauauuuuaaaguaauagugaauacugcuauaaagcuggggaacauaccauggaucagaucccuucuaauggucugcuuuuccguugcuagugguaggaaggcuuguaaauuaaauguggagccccaaauaagggccaggggcuggaagcauguccauuugccaccuguagaguggguacuaaccuggaaugagggggaaaaaaaugaaacacccugcuauaaggcauuuugcugaaaaaaaaaucuaaauuguagcacugaaagggaauagccauauuaagguuggaaaggcacuuuauguauagauuauauagcgucucacauuucacaagaagcuauucuauaggcauuagugagccacaaaagguucugcccaugaaaugacauuuaagaggaaaauuagagggaaauaaacuauuuugguuccugcaauggcagaggaggaaccuaugucuuccaggaaggcuuucuggauuucaaaggagaauuacuguuuuauuuguccuaggccagucugaacaugggaugaguauggcacuuugcucuccucuccacucaaauuugggcaaacugcauuugucccugaaauguuauuugugauagauaguaaguacuucacucucuaaucauacacaucaucauuacuaacccuguaucauuuccccaucugugcuugugugugugugugugugugugcaugugucuccuggucagucuuuucuguuacacuuuguaagcuaugaaggcaggcacuuggucaauauagugcuuuuugugcagcaucaaacuuagcuccauguaugauuaggucccuaaaacauuacuuuuggugaugaugaugaugauccaugaguagcuggggaugcuagaagcauugauagucaucgggaaaggcuggagguaaguucuggaauauagucaagacucagugcugcccagugcuguggguagaaaaaaaggaaagguacccuuagauaucugugagagauauaaaggaaaggagugugugugaugugaggccaaagggaugagagguaugggaagagaaaacaggcuugcuccugcagcauggggccuguugcugacuacugacuacuacauucucagcacuuguggggaccaaauggaagcuucuccucucaaacauuuguguuuacuuuucuauuuaaugugugaauauuuucuuuccugcaccacgugcggucaguccgugacaagugugcccuaggcucucaugguugccagcacauuugugugagugauggggccgcauccuaccacugugauugcuauccuggcuacaccuuaaaugaggacaagaaaacauguucaggugaggaucagcccuuuaaggcuauuuccuuugguaggaaaauuuuucaggagcaagcuuuuuucuuucugucuaagacacaguugugauucuuucucccugucagaauucuccaguggcucccacuggucuacagaauaaaacaaugauaccccuauaccaggcagccuacccuccaugaucuguuucugucuucucuguuuuucacauuuuucuuaauaacuaaacuuucugccuaagucugaauuuuuuuuauugugguaaaauacacauacaauuuaccauuucaauuauuuucaaguguauaguucaguggcauuaaguacauuuacauuguugggcaaccaccaccaguauccaucuccagaaauuuuuuaucaucccaaaauaaaagucugugccgaugaaacaauaacugcccaucacccgcuccccucagcccaugguaacuacuucucucauccuggcuuuuaaaacuuuucuacuacauuugcccccagauucacugcuucuuccugcauccugguccagccacagugggcucuuugaugguccaggagcaugcccugcacucacucauucccacccuccccucaaugcuuuugcuugucagaauuugcuugccaacauuugguuuuguugaauuaaauuuuugccaauccaguggauguuuuuuucauuuccugguuacuaaugaggugaggcaucuuuuccuggagaguacugccauuuuaacagucuuucauugcauuaacaugguaugucuuuaauuuaauuuaauuuuauuuuauuuuaggucuucuuuaauuucuuucaaaauuguuuuguaguuuucaguguacaagucuuguacuuuuaaaaauauuuauuccuaacuauuuuauuccuucuggugcuauuauaagcaccauuucuccauuucucaacuuucaauuuugcuacaacccagguuugagaaauggaguuugagauccauuucucaacuuucaauuuuucuacaauccagguuuacaauuuucuaugaaguguuguaauuaagacuaucccacugaacccaugcccugcuagagcuuagagacuaucaggcacgacagacacugaacaaguauuauauauacccaucuuauggguacagggauaauggacauguaguugaucuucaauagauacuuccugguuuauugacugauuaacuaagaugggauuuggacuggcugucccuaaaagguucaauaggauucagacagguggauagaugauagauuauauuuaaugaauuuaugaucucccaucccuauauuggaucuuuguaaaauguuaagaguaaaaauguugcagcaaaggaccauuuccuguccucaggcaauagaauuacuccauuggaagaugauacaccagucuucagaccugggaaguuacucuuauuucuauucacaacuuuaggaggagcccugauacugaauaggaauagcugccugacugaauuccauaaagaaauaggaguuacuuuuaucaccucucauauuugguuaaaugucaauacaaacgugaauuuucaguuccaaaguauuuauugguaagaacuaggacucuuacuucaaaccauuaaauagaauaacaguccucuagaggaaaucaggacuuaaccugguuuuuauccuuuuuuuuuguuuuguuuuuugagacgacauuucaaucugucacccaggcuggagugcaguggugcgaucucagcucacugcaaccucugccucccggguucaagcaauccuccugccucagucucccgaguagcugggauuacaggcaugggccaccacgcccagcuaauuuuugugucuuuauuagagacgggguuucacuauguuguccaggcuggucuugaacuccugacuucaagcguuccacccaccuuggccucccaaaguccugggauuacaggugugagccacugcgccuggcccuaguuuucaucuuugguauauuuuagccauacaaauagaggacuauuguccuaguuuuauuuuuauuuauuuauuuuuaagagacagggucuuacucuguuacccaggcuggagugcaguggugugaucauggcucacugcagccuugaacuccugggcucaagugauccuccugccucagccucucgaguagcuaggauuacaggugugugccacuaugccuggcuaacuauuuuacuuuuuuguagagacagggccuugcuucguugcccaggguggucuugaacuccuggccucaagugauccuucugccucagccuccaaaagugcuggcauuauaggaauaaggcacugcaccaggcccauuuuccuuucuuaauuacacaguauuacauaaacauugucuuauuucuauaucccuggccucccccuauaccaaccauguuuuucuaaauuuacuuuauaucaugaauaauuucuggcaaucacaaaaguacagagaauaaaauaaggaacccucacuuaagcaucacucagcuuugacaauuauaaacauuuuccccaauguauccuaagaugaauuuuucugugauaaguauuuucucgucuuuuuguuuguucaucuaucccuuuaccucuuggaaaaugcacuuagguaagucuuaacgguggaaauauucaacuguggauuuccugauuuguuaugauuccuauauagcuauuccuagauaguauauuuguguacugucauugucuucagccacugaggaagcacgaagacuuguuuccacugaagaugcuuguggaugugaagcuacacuggcauuccaggacaaggucagcucguaucuucaaagacugaacacuaaacauauccuuucuggaagguuuucuccuucugccuggagccaaccaagguacuacgaucgagccaaacacuuuaagacauuccacaggcaagugacuuauuuguuagguuuuaauaugagcagugguaauauacaacuuuaaaaaauuuagaguucuuuucuaaugguuuaauagacuguuucacccauucaauauuuacauguaaaagcugccuauuuuguccccuagugcuuuuccauaacuguauaugcuccuaaugaugcucuuacauaacagauggaacauuuaugcuaaugacuccuuaauauggcuuucuuaguucagaaucugaacauguacaaagcaagucagcugauuaauggggugugauaucucagauuacacacaguuguacccuuugacuagccaaguggucaaaaagcagauuuuaaaauguaacaugauacaaucucagaaacuuucaaaaucaguucuuucuucaaaggaguaacuagggaaaaguuucucagaacaguucaaguuaacaacucuguuccuauguaccccagaggaguggaauuuagauugugguagguacaaucuaggcguauguagagacuuuuaagggagguacagauaauuggaaagaaucaauuuccaaauccuucacuugcuuaagacacuacuuggaaucagcuggcauuuucuuuucccgucucucauuuccauaucaccauucuccuaacuucacacaagaaaggcauacuucucauuuacccuagaucuacuaaggugcauuuguuagaacagcagaaucuugagauagccaaacaaagggacaauccaacuaucccuuuaaucaauacuucauaaacacugcuucccccaucccucacacuaagaugcuacuccaauuacauuuuauaugaacaaaaacaucugaagaccacugcaggggucuacuuuuauugugcucucugaagaacaggauuuuugacuuuuagacugaauucaacuuuuggugagaaaacaguuuugcucuuuuuuuucacuucucauaggacauaauuauuuuaucuugugaaguguuugaaaguguguuuauauuuucuaauguguaaaaauaaaugguguuggccuuaacaacuugccacuugaugacauuuuggagaaguugaaaauaaaugaauauggacaaauacaucguuaaauugcuccaauuucucaccugaaaauguggacagcuugguguacuuaauacucaugcauucuuuugcacaccuguuauugccaauguuccugcuaauaauuugccauuaucuguauuaaugcuugaauauuacuggauaaauuguaugaagaucuucugcagaaucagcaugauucuuccaaggaaauacauaugcagauacuuauuaagagcaaacuuuagugucucuaaguuaugacugugaaaugauugguaggaaauagaaugaaaaguuuaguguuucuuuaucuacuaauugagccauuuaauuuuuaaauguuuauauuagauaaccauauucacaauggaaacuuuaggucuaguuucuuuugauaguauuuauaauauaaaucaaucuuauuacugagagugcaaauuguacaagguauuuacacauacaacuucauauaacugagaugaauguaauuuugaacuguuuaacacuuuuuguuuuuugcuuauuuuguuggaguauuauugaagaugugaucaauagauuguaauacacauaucuaaaaauaguuaacacagaucaagugaacauuacauugccauuuuuaauucauucuggucuuugaaagaaauguacuacuaaagagcacuaguugugaauuuaggguguuaaacuuuuuaccaaguacaaaaaucccaaauucacuuuauuauuuugcuucaggauccaagugacaaaguuauauauuuauaaaauugcuauaaaucgacaaaaucuaauguugucuuuuuaauguuagugauccaccugccucagccucccaaagugcugggauuacaggcuugaaagucuaacuuuuuuuuacuuauauauuugauacauauaauucuuuuggcuuugaaacuugcaacuuugagaacaaaacaguccuuuaaauuuugcacugcucaauucuguuuuucguuugcauugucuuuaauauaauaaaaguuauuaccuuuacauauuaucaugucuauuuuugaugacucaucaauuuugucuauuaaagauauuucuuuaaauua

SEQ ID NO: 192344 - RNA, 23459 nt, Homo sapiens
uuaagacucagcagaauucaaaauaugaaaauuuauuuugcauaggaaacaauaaucucugguaaacaucauuacugcaucuaacaaaacaaugccuucaauuaaagggggaaagugaguuuuuaaacauuaggguuaauuuagaagaaaauacaguauauaauaaucucaacaucauguuuaggguaaaaaugcuauaaugugaaaaaagucccuaagaacuggacagaaccuaccuaacaacaccauuuaccguguauguuuucaauagacaaaacauauuuuguaccaaauuccaacagugguaauucuauaguuguggcccuuuaaaaaauggcagcauuguacuugaaucagaaagcuuacugggauuuccucaucgaaaguagagauugcagcuaauccuaguaccuuuuguuaguaauuacuuaaggcacagugcaaaguugaaggacuguuuugguacaaacucaagccagcuacauguaugcuugccuugguauccuugcuagagcacaugcggguauaauaccguauuauacacaacaaggccacccuguuguaucuguguuacaauuaaacaucagucccagaaagugaacccuagucauuuauuauaggugcccaccucugacuuggaacaaaaugccacuccauucauguucauuuuuguccuggagaggauuuauuuccuaaaagauucugaaagccaacaaaucaauguaguucuucauagagaacuuaagaguaaggcucaaaauggccucaaaaugggcuucuuggaugacuuccaacagugacuggccucaacacugcagaugucugagcacuaccauaaccuaacgaagugaggaaggaggaggcaaauugguauuuuuaaacaagaauuuaaguggcucuuucuuucaagucuaaaaaaaccuuuggcuuuaaagauuauaaacugauuuacuaaauuuauaaaagaccuuaauuuagcaaagagcuucuuuuuccuuugguucaguuacucaaaauccacugugugaaggaauaauguauccaucauucagccuuuauagcggucuuccgguagcgaaguacugucacuguuacccauauauuuaaagccagcaugaucacaaaacguagaagaacugaaauaaaaaaaaaaguguauuaaaaacugucuuuacaauacagaccaaaaccaccuccugcucaaaguauaagccuaaauaaagcuucacccccaaccuccgaaaugaacaauuuugguuccaguuauuucuggggaaaugaucucccuaucaugacaauuuuuggccccuuggcccaacuucauaaauaauaauuuaucaucuuaagugcucaauugacaguaauguggcucuggcuaagaaggguuauaacuuuuaacuuuuuuuuuuuuuuuuugagacagucuugcccugucacccaggcugggguucaguggccugucuuggcucacugcaaccuccaccuucuggguucaagugauucucccgccucagcuccccaggcaccugggaugacaggugcccaccaccacgccuggcuauuuuuuguauuuuuaguagagacaggguuucaccauguugcccaggcuggucucaaacuccugaccucaaguaaucugcccaccuuggccucccaaagugcugggauuacaggcgugagccacugugcccagccuaagaaggguuauaacuuuuaaaaaucccuuuacucaucugacguccugagggugcugcugucucagaacguuccauauuaagcaagggugguuuaacauacucuguuaagaucauccugaaaaacuggcccacaggacaaggcauauuuuauauucaaguaaccaugaaaaugugucucuuuguggaaaaauaaauaaauaaauauauauaacuuuaacagugacuuaacuucuacuuuaagguacggauacacuccugauaaauagguuuaaugagauuuaagauaucuuuguguuugaaaaacacauguaagauuuuagcugaacuguuuuuaaaaaguuauucccuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaguuauucccaggccgggcgcgguggcacacgccuguaaucccagcacuuugggaggcugaggugggcggaucaccugaggucaggaguuugagaccagccuggccaacauggugaaaccccaucucuacuaaaaauacaaaaauuaguugggcauaguagcgcaugccuguaaucccagcuacucuggaggcugaggcaggagaauugcuugaacccgggaggcagagguugcagugagccaagaucacaccacugcacuccagccugggcgacagagugagaauccaucucaaaacaaaacaacaacaaaaaaguuauuccuggauauacugaucacuuucaagaacagcugucauagauaagaaauaaaucacaauuagaacaaucuugaucuuuuaauuucuaauguauagguuuugcuguuuacuugugguuugacuuuccuuuccaugcugagaauucaaguccuguggaaagacccaagccugucuuccuucccauuucccacuugaucaaaguuuaugcuuugaccagaacaauuuuaguccuaucaucagagcugacaaaaaguauucgagcaaagguauaaccuccaggaagagacuaacaaacauaucucuguucugaagcacuauuucucaaauaauaauuagcucauuuaaaaggucuacaugcuggggacauuuucugaucuucacaggugacaccaucuguucuaaucauuuuccaaagauguauaauauaugcuugauuugggaguugaaaacagccuaaggaauuacuaaauucuuuugugguuaaccauaguauuuccuccuccaugacagcuuuuucuuuuaaagaaacagaacaaaaacauaguccauuggugacaccacuucccugcuucaaagccuccagagccuuccuacuguuuuguaggcaguucuuguaggcccuggauacuugggccacugccagucucgcauccuuccucuccugaaacccgcuugucacugucccccugcucuccgcacucuagcccuuuguccuucgcucaugaccuucacaaugcugcuccuuguuaagagucuggccuccgcccacauccuuuccucuggcuaaaccucuacucauccuuacgaucacucuucuucaaauuaaucugcccaacuccugcaaacuaggccagguucuccuuagaugcucauccugcccuacucuuccaaaccaugucccauuagaauucaauagggaauugugugauuaccucauguccaauuccacugcuuaaguggaaguuccauggagauaggaaucuauugucuugugcauagucuauccccuguacuauaagaaggagaggcuuaacaauaaaaauggugaccaauaagacuaggaauacauuguugccaucuucuaaaucuauaauccaacagagccaaguccauccauuaaacccuaagacaguuuacaaaugaaggagacacaaauagcacaaaacucaaaaaggaagugagaagauauuuugcuuacuuguaaaaucauugguggucauuaagguugugauuauucuugcuguaaaagaaaacuugcagcaauaaguaacuugccucucggacauuuuggggcuuagcuaauaaugucuuucccuuuuaauaucccaauauauauuaaccauuauuuuuaaauuauuuuuauucuuuuuuuaacaacauauauuaacuauucuugacagaguuugguaguacagaaaaccaaauagugcuguauuucauaauuacauaaaaacuagccaugccggaucaccugaggucaggaguucgagaccagccuggccaacauggcaaaacccugucugucucuacugaaaauacaaaaauuagccagguguaguggcgggcgccuguaaucccagcuacucaggaggcugcggcaagauaaucgcuugaaccugggaggcaaagguugcagugagcugagauugcgccaauugacuccagccugggugacagagccagacuccgucucaaaaacaaaacaaaacaaaacaaaaaacagccaugcauccuaccccaauggcccaaugguuuugaaacugcucaugagggaagguaccuagaagguacucgagcgcugccugcggaaggccggagagacugagcucccuuccacugucucugugcuaaccugcaacccccaacccuccaaaagcaacucucauuuacaaauugagcaucuggguaguuuuauuuaaagaaaggcucccacuaauuaaaaacaauguuuuggccaggcacaguggcucacgccuguaaucccagcauuucgggaggcugaggcggguggaucaugaggucagaaguucgagaccagccugaccaacauggugagacccugucucuauuaaaaauacaaaaauuagcugggugugguggcgggcaccuguaauaaucccagcuacuugggaggcugaggcaggagaaucgcuugaaaccggaaggcugagguugcagugagccgagaucaugccacuacacuccagccuaagcgaaagagcgaaacucugucucaaaaaacaaacaauaaauguuuucgaaucacugguuucuauccuugcauuuuauagauaaacagacugaggcccagaaaaggggaagauuuuuccaagggucuaacuagaacuauuuuguuuaguuuauuugugugccauagcccuuuacuuaguaaacauuuaggaaauuggaguaacaguuuaaaccgacacacaagagcagggaguggcgugacuugggaguuagagaagaccacugccugcagcucaaggcaugccuuuccuagcccaaaaccagccugucaaaacucucugcuaacacauucugcauuuagcacauauugacauagaaguuuuuuggucuaccuuccaacuaaacugcaagccccugaagggcagaggccaaauccuauaaaauguuuuguugacacauuugauaaaccaagacuuuacacacagacaccacauaaauaguuguugauuaaaucaucauuuaaauaaaagaauucaaucauauaaguagacagaagacuucaguuaggaaggcggccaacaaaggacucucagacaaacuuuuuaaaaggcuguuaauaaccacacaucugacaaggguuaaugaccagaauauguaagaaacucaaaugacccaauuaaaaaaugggcaaaccaugugaacagacauuucuccaaagaaaacauacagggccaggugcaguggcucacaccuguaaucccaauacuuugggaggcugaggugagaugaacacuugagcccaguaguuugagaccagccuuggcaacauagugagaccccucucuacaaaaaauuggcugggcgcgguggcucaugccuguaauccuagcacuuugggaggccaaggcggguggaucacuugaggucaggaguucaaaaccagccuggccaacauggugaaaacucgucucuacuaaaaauacaaaaauuagccaggcaugguggcgugugccuguaaucccagcuacucaggaagcugaggcaggagaaucgcuugaaccuuggaggcagagguugcagugagccgagauugcaccacugcacuccagccugggugacagagcgagacugugucucaaaauaauaauaauaauaauuaaaaauuagccaggugugguggugugugcucguacucccagcuacuuggaaacccgcagugagugaagaucguaucacugcacuccagccugugagagagagcgagacccugucaaaggaaaaaagaaagaaagucuugauuuuaagacauaauuaagacaaguaacuuguugaauauaaagaccagcaaccauggauggagacauuagcccuuuaagaugcagaagaaccaugaugaagucuacuuaaaauaucuaaaacuaguaaauccaacuaaugugauagcucugaauuauaaaaauguuucuaccuacauauaccauauauguauuuuagguaguuuuuguaagaauccaaaugaagagugaaaauucuaaaguugagaccaaacaauguggcugccgaaaaucuccaucacuacacauuucauucauucucaaaagccacuguaugauuuucauauuuuaaaaccuguuauauucaaauucuuaagauaaauuaguacauucaauauaaucaaccucuuuauccuuucaaagaagacagagcuaauuaauaucaggccagguuuuuggagaaaaauaggcuuucacuuuuuuuuuucuuggcaacuuggauuuuacagaaaauggagagcaguuugcauuaaaucaucuuuguaaacauggauacacuuaggagguucuagcugaguagccauuuguaaaguaguaaagcgccagggaccauguuacuucaacaccaacuuaacacccuacuacguagacacuuggugcuaccaaaggccuccccaccaugugaguccgguucuuacuugcacagguauaggaagagaggcuccaagucagcgcacucacaguuccugagucucucgucuuccacagacacuggagcugugcaaacuuacuggccgcgcugaugaaaguacauagauucuguuugcagauaaaaugugagaaagucacgagucgauuuguuaaaaaagcaaaagaggccaggugcgguggcucacaccuguaauuccagcacuuugggaggccgaggcaggcagaucaugaggucaggagaucgagaccauccuggcuagcacggugaaacaccgucucuacuaaaaauacaaaaaauuagcugggcgugguggugggcgccuguagucccagcuacucgggaggcugaggcaggagaauggcaugaacccgggagguggagcuugcagugaguugagaucgugccacugcacuccagccugggugacagagugagacucccaucucaaaaaaaaagcaaaagagcacgagauacucaaagcauuuuugaagccaaauuuucaggucaaaauaauaauggaauuguacaaaguugaaaccuaaguuuagugaaaaguaaugcaauagugagacauuuauuuauuuauuuaugacagucucacucugucacccaggcuggagugucaaaauaauaauggauuuguacaaaguugaaaccuaaguuuggugaaaaagaauggaauagugagacauuuauuuaguuaguuaguuaguuaagacagagucucacucuguugcccagacuggagugcaguggcacaaucuuggcucacugcaaccuccaccucccagguucaagcaauucuccugucucagccucucaaguagcugggaguacaggcacgugccaccacaccuggcuaauguuuguauuuuuaguagagacaggguuucgccacauuggccaggcuggucucaaauuccugaccucaggugaucugccugccucagccucccaaaauguugggauuacaggugugagccaccaugcccagacuaagacauuuauuuauaacucacagauuccaccgugcaguggguaacuaauggccagagcuaguuugaaguugggaaugagaaagaaucaaugcuuggccacagagguucaucuaucuacaccuccaaugagaaguaaguacugaggagccaggugcgguggcucaggccuguaaucccagcacuuugggaggcugaggcggacgaaucacaaggucaggaguuugagaccagccuggccaacauggugaaaccccgucucuacuaaaaauacaaaaaaauuagcuggguguaguggcgggcgccuguaaucccagcuacuaggaaggcugaggcaggagaaucccuugaacuugggaggcagaaguugcagugagcugagaucauaucacugcacuccagcccuggcaacagagugcaacuccgucucaaaaaaaaaaaaaaguacugagauacuguguuuuagagcuuggggaaaucuaugcuguucugaacugacaaacaaacuccagcagcaagccgcggcaccucagcccugaauuucuggcuauucugauagucugugugguggugcgcucaggccucugcuauacagugagguaagagauccucacaaauaagccugcugcucugcacagcauccucgacgcugaccaccaccagcccugccagcaucagccucuucagcagcugaaacuccagucucuggguugaguguagaccgaagggagacaaggugacaccugggagaccaguuaggcuagugcagucaccuggguuuguacgagggcaguagaaacagacgaggugagaaguguucagguuccggauauauuucaaaggcaaagccaacaggauuugcugagggagugguaaugggauguggcaaaaagagaaaucuggcugggcacaguggcugacgccguaaucccacuacuuugggaggccgaggcgggcagaucacgaggucaagagaucgagaccguccuggucaacauggugaaaccccaucucuacuaaaaacacaaaaauuagcugggugugguggcacgugccuguagucccagcuacucgggaggcugaggcaggagaaucacuuaaacccaggagguggagguugcagugagccaagaucaugcuacugcauuccagccuggugacagagcaagacucugucucaaaaaaaaaaaaaaaaaaaagagagaaauccagggugauucuaaucuccgguguuucuggccuuugcaguggaagaacagaguucccauuaacugagacacauuaagaugaaggugggagaggggcagggugggagaucagaaacccaguucuggacacgcgagguuggagaggcucagucgucaggcaaggguagccagugguuggcugugcggugugugcuggagcccugggaacacggaagucagggagcugaggaggaaccagcaaggacacagaaaggaucaaggggaagggacacuggggagcacggcuuccuggaagcccggugggcagugauucaagaaggaguccugaucgauggugucaaaagcuaccgagauaugaaugaagaagaggaaugagaacuggccacaggcucuggcgcgaaugaaagccgcuggccuugacaagagcagcuuguuuaccuucugucuccccuggagaaggaaagcucauggggaacacucggucuguuuccugcuggguccccaggaccugugacagugcuggcaccuggccggcacucaacaaauccuugcugagggaauaaauccuuaauaauaaugcagucuggcaaacgugaugauaaaggugcauccaggaugacuugggaggagagaaggcgucacuuggacaaggaagaauuauggagaagggaggcagggugcaguggcucaagccuguaaucccagcacuucgggaggccaaggcaggaggaucacuugaggccaggaguucgagaccagccugaccaacauggugaaaccccaucucuacaaaaaauauaaaaauuagccaggcgugguggcgugugccuguggucccagcuacucaggaggcucaggcacaagaaucauuugaacccagaaggcagagguugcagugagccgagaucacaccacugcacucuagccugaacaacagggucagacucugucucacaagaaaaaaaaaaggaauuauggagaagggaaccgcagggagugcucuugggcagaggaguugaccaagaaccuguggucaggccuguggcaggacuaaagucacccugagagcugggugcagaugcucggaggauggcuggccccaggcagggagaccugugaggagaggggcucuugugcaaucaggagaccuggacagagcagaggagggaggacugcaggggagggcucgcaccagagaaccagccagaacacaggcucggcgggguggcgaggagucggugcggaaugggaagagcuggggaagcuggcuuuguucacacacaucagggucccagaccacauuacaacacacucguguuaaacacaagcuugccugcuagauauucuaccagauucaucuuucaggaacaaagcuauuuuuacaguccugaaguaguguugguuugggccccaaccaagcccuggaaugucuuaucacauuaauucaauuggagacuaugaaguuuuucuguaaaacagucuaauccaggaacaggauuggaaagaagggaugcuuagcugucacggagagcuuuuuuuuuuuuuucagacagagucuugcugucacccaggcuggagugcaguggcucaaucuuggcucacugcaaccucugccucccggguucacgccauucuccugccucacccuccugaguagcugggacuacaggugcccgccaccacacccggcuaauuuuuuuuuauauauuuuuaguagagacgagguuucaccguguuagccaggauggucuugaucuccugaccuugugauccgcccgucucggccucccagagugcugggaucacaggcgugagccaccgcacccggccuugcagaucauuuuuaaguacuuuaaucauuuucuugugaauaaacuaugaguauaugaauuaucaauuuaaccaugaaagcacaguuuaggaccucugggggaacgaucucggguaccugcauuugaaagccaaaaaaauggaacauucuacaauggagguuuuccacugauucaagcagcacccgcuccucucuaggauucugggguuuugcuaccaugugugagcucugaaggcccugcucguucuccugcacuggggcuccacgacccucagaucugggccaccuugugccccggacccugguaccucagagcaggugcgugaggaacacucauugagucagugaaggagggcuaugggcagacacagcacggagccugguguucagcccuugcaugauaaaggaaagaaucaaaauuauauuccaugaaauguuauaucaucaauguuauaguuagaauagaugacuacugcuaagggcacagaacaaacaccuaaaagcuguuguugcccuugaccccugaacuugauucuuuuguuuuguuuuguuuuugaaauggagucuugcucuguugcccaggcuggagugcaauggcuugaucuuggcucacugcaaccuccgccucccggguucaagcgauucuccugccucagccucccgaguagcugggauuacaggcaugcgccaccacacccagauaauuuuuguauuuuuaguagacgggguuucgccauuuugaccaggcuggucucgaacugcugaccucaggugaucugcacgccucggccucccaaagcucugggauaacaggcaugagccaccacaucccuccauucuugacaagccuguaucucaacacugcuagaaggauguuuccucaggggugaaggcucacagcugcuguaugggggcuaauagaacuagaaccaccccaacucaucaguaguaagaccuacugagaacauagagauggcucauuuacaggguugugagaguuggcaaacaaaaauacaggacaucuaguuaaauuuaaauuucagaacaacaacaaauaauguuuuaguacaaguaugucccaugcaauauuuuguuuguuuuuugagaugcagucucgcucugucacccaggcuggagugcaguggcgugauccuggcucacugcaagcuccgccuccgggguugaagcgauucuccugacucagucucccaaguagcugggauuacaggugcccgccaccaugcauggcuaauuuuuguauuuucuuuuaguagagaacaggguuucgccuguuggccaggcuggccuccaacuccugaccucaggucaucugccugccucggccucccaaggugcugagauuccagacgugagccaccccaccucgacccaugcaguauuuuggacauacacguacugaaaaaguguuccuuguuaauauggcaacccuacuuauuugcucucccaagucacaggguugaaauguaacagaaauguaacagagaaucuagucuacuuuccagacaagauguugggggaaaggggaaagaaauucaugagucugcguguggcaggcagugcccugugaccaccaguuaguucuccuccuuuucucguuggguagaaacguucacuucugucaccuuggagaggucuguggucaaacacauccugaaccacccucaggagcccuuggaaauuuucggcccugagccaaguaugaaaaaaagucagccccucuccaggacaaggccaacaugccauuaugaaccuaagaagaagcuaguuaacugaugcucaauucuucauucuaaaacugcuaguggccagcugccguggcucacaccuguaaucccagcacuuugggaggccgaggcguguggaucaucugaggucaggaguucgagaccagccuggccaacacagugaaacccugucucuacuaaaaauacaaaaauuagcuggggaucccucucccucucccucucuuuccacggucucccucugaugccgagccgaagcuggacuggacugccgccaucucggcucacugcaaccucccugccugauucuccugccucagccugccgagugccugggauugcaggcgugcgccgccacgccugacugguuuucguauuuuuuugguggagacaggguuucgcuguguuggccgggcuggucuccagccccuaaccgcgagugaucugccagccucggccucccgaggugccgggauugcagauggagucucguucacucagugcucaauguugcccaggcuggagugcagugacgugaucucggcucgcuacaaccugcaccucccagccgccugccuuggccucccaaagugccgagauugcagccucugcccggccgacaccccgucugggaagugaggagcgucucugccuggccgcccaucgucugggaugugaggagccccucugcccggcugcccagucugggaagugaggagcgucucugcccggucgcccaucgucugagauguggggagcgccucugccccgucgccccgucugggaugugaggagccccucugcccggcugcccagucugggaagugaggagcaccucuucccggccaccaucccgucuaggaagugaggagugucucugcccggucgcccaucgucugagauguggggagcgccucugccccgccgcccagucugagaagugaggagccccucugcccggcagccgccccucugagaagugaggagccccuacgcccggcagccagcccgucugggaagugaggagcgucuccgcccggcagccgcccuguccaggagggagguggggggucagcccccgcccggccagccgccccguccgggagguggggggugccucugcccggccgccccuucugggaagugaggaccccucugcccggccgccaccccgucugggagguguacccaacagcucauugagaacgggccaugaugacaauggugguuuugucaaauagaaaagggggaaaggggaaaagauagagaaaucagauuguugcugugucuguguagaaagaaguagacaugggagacuccauuuuguucuguacuaagaaaaauucuucugccuugggaugcuguugaucuauaaccuuacccccaacccagugcucucugaaacaugugcuguguccacucaggguuaaauggauuaagggcggugcaagaugugcuuuguuaaacagaugcuugaaggcagcaggcucguuaagaaucaucaccacucccuaaucucaaguacccagggacacaaacacugcggaaggccgcaggguccucugccuaggaaaaccagagaccuuuguucacuuguuuaucugcugaccuucccuccacuauuguccugugacccugccaaaucccccucugcaagaaacacccaagaauaacaauaaauacuaaaaaaaaaagaaaacaaaaaugaaucaauuaaaaaaaaaaauuagcugggugugguggcacaugccuguaaucccagcuacucgagaggcugagacaggagaaucccuugaacccaggagguggagguuguggugagccgagauugcgccauuguacuccagccugggcaacaagagugaaacuccauuucaaaaaaaaaaaaauauauauauauauauauaaauaucuaucaaguucucuccaagguagcuuauuccuccuacuuucuuuucaagcauaauacuuaccauggccaggucuaugauccacuucugcagggcaaggaugaaccaagaagacaccaaucuuaccaagugcuaagggacacagcagugggucacccacauccgcgccacccucccaucucacauauacaaaccaagaccacagacagcggcacgcagaagccaggugggugggaggggaggacaugcuaccagaaccugccggauuuggaagggacgaaaagggucgcaagugaacaccugcucagaauucaaaagaacgaaaacagguuacagaagagaaauacaaagacacccacgcucauggacugcucccuaggauugggaacauuccuagugguuucacugcccacugaauucuagaccaugcagacuucucugauuuauggucaaaagcuaagcacuuaaaggagaaguccaacauuauaaagcaggaauguucugcaaaauugcugugaugugaauuucuguuuacugacuuccaccuuuccccacaaacuccacuguaaaaaugauacagcuggggugggcaaugcuggaagucaggcaugugcaccgagcucggugacgccacgggaauagaggccagcuagggagcugaacaagcacccaggagacagcggccagggcuggaaggggacagccaagagucucuggagugcccuugggcaagucacuuuccaucuuuccaccuugauuugcuuaucuguaaaaugccuacaagcacguagcaccgacucaagagacugcuguuauuauaauuucaaacauuaauuaaaugaagauauugaaacagacaaugcccugugcuaaaagucaguggaacuaaauacucacagccugaucaacaccagaagguagcucgaagcuggcuggauagaauccuguuuuuaaaacacuaacucaauuuuuaaaucuaauuuuugugacuccuccccccaccaauucuguucuaucccaccucauucuguguauucugaauauacauuuuauaaaauuugaccaauaguaggagcuccugagauccuacagaugauuuauuuguaggguugccagauuucacaaauaaaaguacaggacacccaguuaaauuuuaauuucaggucgaaaacaaguaacuuuccccaaguagcugggaugacagguaugagacaccacacauggcucauuuuuucucuuauauuuuuggagcgcuagggaaucccacuauguugcccaggcuagucucaaacuccuggccucaaaugauccucccacuucgaccacccaacacacugggauuauaggcaugagccgcuacaccuggccaauaauuaucaguagaaguauaucccaagcaauauuuaaaaguauucauuaggccgggcacgguggcucacgccuguaaucccagcacuuugggaggcugaggcagguggaucacgaggucaggagaucgaaaccauccuggcuaacauggugaaaccccgucucugcuaaaaauacaaaaaauuagccgggcaugguggugggcgccuguagucccagcuacucgggaggcugaggcaggagaauggcgugaacccgggaggcggagcuugcagugcgcugagauggcaccacugcacuccagccugggcgacagagugugacuccgucucaaaaauaaaauaaaauaaaauaaaaauaaaaguauucauuaauaugguaacccuauucuuucgcucuccguaagucacaaccaaugggagauuauaagcaucuugcugauacuacagacucgccaucagcauccagccaugugguaucucccagugccaccagcacccaaauuuucuaaucugcagccucacuaucuucacaaagcuguugcauuuuauuucaaaaguaaauuauguaacucuuuucaucuucaaaguacuguuuaccaaaaccuuuaaccagcugggacugaccgugaaguguugaggugcaguacagcugugcgaucccucuuuccgcagacagaaacugaggcagcagagcuugccacucggggaaacagcagagggucaggacucagccagaacccagcucccuccauagacacaggcugcagagccucgccucuaguaaaaccaccacaauggcccugucauuuacucugcuugacuguguuucugguacuucuagcucuuacaguaacccuaaaacauaggcauuaugaucccaugucacagaugggggacgcacaguuuaugguguaugcugaagccaccccugugguggcagggaccuguccugucuggcuccaggccaacugcuucccaccacuccacacccacauucucauggccugcgggccacaggccuggcucugcccuccuuccuccacucugaagagggcaugggaagaaacagcucaagccauuucacagauguggcaggacaggcugacagcuagugccauucaaaacacuuucuugggccagaaguggcagcucaugccuguaaucccagcacuuuggaaagccaagguggaaagaucgcuugaguccgggaguucaagacuagucuggguaacauaccaggacccaaucucuaaaaaaaauguuuuuuaauuagcugggcauaguagcaugcaccuguagcuccagcuacucaggaggcugaggcgggaagauuccuuggccccagaaguucaaggcugcagugagcucuaauccagccacugcacuccagccugggugacauagugagacccugucucuuaaaaaaaagguuaaaacaucuuguaacuugggcaacauagugagaccccguaucuacaaaaaauuuaaaaauuaacugggugugguggcauucuucaauaguccaagcuacucgggaggcugaggcaggaggaucacuugaucaaggcaaucaagcuugaccgaggaggucaaggcugcagugagcuuugaucccaccacugcaacccagccuaggccacagagcgagaccgucucaaaauaaaaaccaaaaaugaaacaaaaaaaaaaaaacacucuccuggcuuuuuaaggagugugacguucaacuagugagucuuuacaaagagaacugaaaugaagccucacccucauucacaggaagugccacugagcaggaacaggucucugagcugaccaggcucccacugcaagccucugggccaacaacugccccucagaccucaagguuuagccucuaagcuaacgucuugagaggcgccggauacucucauuauuauugcuuccaauccucggaggacauuaucagggcaggaagaaaugucucacaugaacuaaugcaguuggacgaugcugcucuuagcagggguggacucuaccgaucugccuuccacucggccugcuggcaccgcccagggcaugcuggucucggaggagcagcaggggcuguacugagggcaucucugguguacauggacacguuugcauuugggauuuuuuuuuuuuuuuuuuuuaguuuaaccaaaaaauacacaucugguaaaggagccugcuucacaaugcauaccauucacaaauaacauccccguucccacuucuggcucagauucagaaaggauacacagcgauguaaggaguggccugcuucacguucccguuaaaaugaaagauacagagcaggaggaugacaucugaaagagagaggcuccgagugaggggggaaggggagacccguggcaguccgcuggacagggaaggggcuguuaccuugcgcgaugaggaugggguacuccagguaggucagcggcggauacccauaguaacacugguaccgcagaaacaccaggaaucuggagagagaagggcacauguccacacggcugccccaaaacgcagcugucggggccuggcaggcaccagaacacugaggucaguuugccgaauccuugcaguggggguguggacacgccagugucaaagaggaagguuuagaacaaaauagauggaauucaguugaaucaucuguacaauuuuuggagcauccagaacuuacugggcaccgggccacagugcaauacccacgaucucuauagagugccuugagauggucgcuuacaaaggauuuuuacagaaggcaaaucccugagcaagaauaugagacugggccuucugggcccacgcuucuggccugccugccauguugggcucccacugaccccggcagcugccccucagcugcugcacacaucugcccuccacucugagaagcugcagaggcgcaaggauccgaggagccgcaaccaucccuggaugcgggggucuguggccguguuuuuagaguuagaacagcaccuggaugguccaguugccuuccagaagagcugcccgguugagagggcagugggggaaagcgugaagaaccacccucaauuucgcuaagaagacuccggcugugaggaugcugcgaaggccacagggucccacauucucagaagaaaaggcagagcuuccugccucccccucacacccagccaucucccuucaggaccggaaucccuguggucuccuggggcuaccuguuugucucaucacccagcuuuuuggcucccucccucucaccuguguguucagaccacucaggucaggaagaaaggggagccggaaccaugggacuucaacacacaggaggggccccccagggucuccaaucuccuaagcugggaaggaauccuggaaaaguccgauucacaaacaggcugugccucccuggccuguuucugacagugcacaacuuagcugggggcggagucagaggaggucacaguguugcccugagcacgagggccucccacaggccugguccccgagugcgggcccccaccgugcccagcaggguccccacccccagcugccugcaggcccuccgggugcugugcagcugagccaccucccagcuucagggacaagcggugccucugcccugcccugccgcagggacucuccuccugccagccuccugagcagcccccucuguuccccugggagauugagcccaggggggcuggcagagggggaggcugcaccccagccccucuguggggccacagccagccacugagugcugaagaacaaaagcuaugggggucuucaccaucgaaguaagugugugcugaccccugggacgcagccacaguccacaggccaggccugagaaccuggggaugucagagcccguucucaccuucaggggucauccaugcuggccuccacaacuuacagaccacuuggggaaauggaggcccauagacaccaagaacauacaagaugaagagccuggauuucccgaggcugaucuggaugcagccguugcugccccugcagguuuugccgucuacucccugcuuucccugggauucaaacuccccccaucccugcagccuggggaggugggguggggacagugucuuuccuuuaguuuuuaauguuucuuuuuuuuugagauggagucuugcucugucgcccaggcuggagugcaguggcgcgaucucagucacugcaaccuccaccucccggguuccagcgguucuccugcucagccucccgaguagcugagacuacaugugugccacuacaccuggcuaauuucuuuuuuuugaggcggagucuugcucugucacccaggcuggagugcaguggcacgaucucggcucacugcaagcuccgccucccggguucacgccauucuccugccucagacucccaaguagcugggacuacaggcgccagccaccacgcccagcuaauuuuuuguaucuuuaguagagacaggguuucaccguguuagccaggauggucuugaucuccugaccucgugauccgccggccugggccucccaaagugcugggauuacaggugugagccacugcacccagccuacacugguuaauuuuuguguuuuuaguagagaugggguuucaccauguuggcaaggcuggucuugaacuccugaccucagguuaucugcccgccucggccucccaaagggcugggauuacaggcaugagccaccaugccugucccuuuaaaguuucuuuuaauaaguaaucgcuauagugcuuaucauaauaaaaucaugccagccgggcaucugacacagccccauuuguuuccauucccaucugcuccaugcagccauuggaguuuucucccucaacaccuacuagaggguuaaacaaaacguacccccacccaggcugggggacaagugaccuggagcaaggggugggcuccaaaggcauccuacccagaggccaaggcucuacagccuaaggguccaccgugggagggccgcaguccauggaaggcugcaggcagggcagguuggaugaaucuugugcuccaggaggcuccuggcugcagagagcagggaggcagagcccagcagagcccuggaggcaggagaagcagcaagguugggaacuugcgagggggaaggcuccagcuacaaggaaugccccuggguggcagaggcaggucccugggcagaggcuccugcccuucacaccaagccacacuaaaaaggcuuuucuggcauuauuaagacacacuucaugcuccaauugacucagugcucucaaaaccaggcucuuaguuugcucaaauggagacccaaagagggcccgugcccuccagguggcugacugcgacagcccugggguuccuucugcucuaacuccggcugcugccugaucuggucaggggcccgggggcccagcuggcaagcauggccagccccaggugggccucccaggcaaggcugggaagggcaugagggaggcaggcagggagacaggagggccaggaggauggguccugacacagccaagcccauuuuacagaagucugugugccuggcccuggcccuggcuuggaggcugcagagcuggugcaccagccccgacagagcccccuuuaccugcacgugaucaacugcaagacccuuagacaggccagcagggauggcagcaagcugcugccccacccaacccuugagcucccaugcccaggaagauccuuccacugccagaggucuagcuuucacuaaggugagcugggagaggugacagcuggcagaucuaauaggagcccucaccugcguaucucugaggguuugcauuuuucaagcaaugcugcaaaagugguggaaaugcaggccuaggggcuggcggcaggagggaaucuauagacucuacagacagccuggcuucuuuuccuucauggguccagcuucagcuuccccagcucagggaccuagcaaggggccgaggccaaaucccacuccuggcuuucaugcccuuguccccucucccaccugaacagucaccacagccacuuccagccuguguccuuugccacaaccucaucgcuccagccucucugcucccagccuggugguggcaccaaccugaaacgcaugcugcccaccuccccugggugccucucaacccugccauccagccugggaccccccccuccccaccccgcaggguagagucacucacaagccuggaagaggucacagucccucccacugcaagccuuucccaaaaauuuccccucaaagcccccuauuggaugacugugcccagggccgggcuccauagggccggcgcgggguccaaagccugagugggaccccucacccucccacaccugaggucuccucuuucucccccgcaccccuuggcuucuucccauccuguaugccgcaccccccaccccgcccaccaggaaggcuuguguggaggaccaggcuucagaccccacugggugauggcggggggcaaaggggaaggccuggccuggccagggggaaggggcgagaccacuagguugagguauguguuuuccuauuguuggggcucaaaaaugauaccccaaaaguuuggcgcucuggcaugaugaauacuuugaauaggaaagccuuagaagcugccucagaaucaaggauuuaacgaccuuuccgucaccccuucccaacugcagagacucuccaacuuccuuacagaugacuaaggaaacuucuuucuacaagaaaugcaauugucuuaagacccucucccaaggaaucucauuaaauaaccaggaaagauuccccaccaaucaccgggagaagagaagagauucauacauucuuaguucaaccccuuauuucacaggugaggaaaccgaggcccgagaacgagguugacggugcguggugaguuuagggacaaugaauaugacagccucgaggugcaaauggccuugcucagggccagcagguuuugucacuagcgcaccaagggcugccuccgcugggucuguuuucucaucuguaaaaugggcgugcgcaaucaauucgugccacgcggggcuuggugagaaacaauguacgcggguggcggguggccgugggaagagcaccccgagccccuaggcucccuaguucacccucggccgcccagcugcgacgccggcgcgcggggaucauccccgcccuacuucgagccgaggcucuccugggcucccagccggcagcagcugcgagggggcaggaggcagccccggccgccccgggccuuacccugccagcuccagaaguaaacucggaaggcugaggccccgcgcgcugcgcgccgcuagcacagcggagaucugcggcagcuucagcgcggcgcacacgcccagcgugcuccaguuacacagccccagcagcgccgccuccauagcgccacgggcgcgggcaccugggcggccgcagcgagaagggaccgcucagccucggcggcgcagcucugccgaagccuuccgccuucccgggauccgcccgggaccacccggccagggcccgccccuccgc

SEQ ID NO: 192345 - RNA, 23459 nt, Homo sapiens
gcggaggggcgggcccuggccggguggucccgggcggaucccgggaaggcggaaggcuucggcagagcugcgccgccgaggcugagcggucccuucucgcugcggccgcccaggugcccgcgcccguggcgcuauggaggcggcgcugcuggggcuguguaacuggagcacgcugggcgugugcgccgcgcugaagcugccgcagaucuccgcugugcuagcggcgcgcagcgcgcggggccucagccuuccgaguuuacuucuggagcuggcaggguaaggcccggggcggccggggcugccuccugcccccucgcagcugcugccggcugggagcccaggagagccucggcucgaaguagggcggggaugauccccgcgcgccggcgucgcagcugggcggccgagggugaacuagggagccuaggggcucggggugcucuucccacggccacccgccacccgcguacauuguuucucaccaagccccgcguggcacgaauugauugcgcacgcccauuuuacagaugagaaaacagacccagcggaggcagcccuuggugcgcuagugacaaaaccugcuggcccugagcaaggccauuugcaccucgaggcugucauauucauugucccuaaacucaccacgcaccgucaaccucguucucgggccucgguuuccucaccugugaaauaagggguugaacuaagaauguaugaaucucuucucuucucccggugauugguggggaaucuuuccugguuauuuaaugagauuccuugggagagggucuuaagacaauugcauuucuuguagaaagaaguuuccuuagucaucuguaaggaaguuggagagucucugcaguugggaaggggugacggaaaggucguuaaauccuugauucugaggcagcuucuaaggcuuuccuauucaaaguauucaucaugccagagcgccaaacuuuugggguaucauuuuugagccccaacaauaggaaaacacauaccucaaccuaguggucucgccccuucccccuggccaggccaggccuuccccuuugccccccgccaucacccaguggggucugaagccugguccuccacacaagccuuccuggugggcgggguggggggugcggcauacaggaugggaagaagccaaggggugcgggggagaaagaggagaccucaggugugggagggugaggggucccacucaggcuuuggaccccgcgccggcccuauggagcccggcccugggcacagucauccaauagggggcuuugaggggaaauuuuugggaaaggcuugcagugggagggacugugaccucuuccaggcuugugagugacucuacccugcgggguggggaggggggggucccaggcuggauggcaggguugagaggcacccaggggaggugggcagcaugcguuucagguuggugccaccaccaggcugggagcagagaggcuggagcgaugagguuguggcaaaggacacaggcuggaaguggcuguggugacuguucaggugggagaggggacaagggcaugaaagccaggagugggauuuggccucggccccuugcuaggucccugagcuggggaagcugaagcuggacccaugaaggaaaagaagccaggcugucuguagagucuauagauucccuccugccgccagccccuaggccugcauuuccaccacuuuugcagcauugcuugaaaaaugcaaacccucagagauacgcaggugagggcuccuauuagaucugccagcugucaccucucccagcucaccuuagugaaagcuagaccucuggcaguggaaggaucuuccugggcaugggagcucaaggguuggguggggcagcagcuugcugccaucccugcuggccugucuaagggucuugcaguugaucacgugcagguaaagggggcucugucggggcuggugcaccagcucugcagccuccaagccagggccagggccaggcacacagacuucuguaaaaugggcuuggcugugucaggacccauccuccuggcccuccugucucccugccugccucccucaugcccuucccagccuugccugggaggcccaccuggggcuggccaugcuugccagcugggcccccgggccccugaccagaucaggcagcagccggaguuagagcagaaggaaccccagggcugucgcagucagccaccuggagggcacgggcccucuuugggucuccauuugagcaaacuaagagccugguuuugagagcacugagucaauuggagcaugaagugugucuuaauaaugccagaaaagccuuuuuaguguggcuuggugugaagggcaggagccucugcccagggaccugccucugccacccaggggcauuccuuguagcuggagccuucccccucgcaaguucccaaccuugcugcuucuccugccuccagggcucugcugggcucugccucccugcucucugcagccaggagccuccuggagcacaagauucauccaaccugcccugccugcagccuuccauggacugcggcccucccacgguggacccuuaggcuguagagccuuggccucuggguaggaugccuuuggagcccaccccuugcuccaggucacuugucccccagccuggguggggguacguuuuguuuaacccucuaguagguguugagggagaaaacuccaauggcugcauggagcagaugggaauggaaacaaauggggcugugucagaugcccggcuggcaugauuuuauuaugauaagcacuauagcgauuacuuauuaaaagaaacuuuaaagggacaggcaugguggcucaugccuguaaucccagcccuuugggaggccgaggcgggcagauaaccugaggucaggaguucaagaccagccuugccaacauggugaaaccccaucucuacuaaaaacacaaaaauuaaccaguguaggcugggugcaguggcucacaccuguaaucccagcacuuugggaggcccaggccggcggaucacgaggucaggagaucaagaccauccuggcuaacacggugaaacccugucucuacuaaagauacaaaaaauuagcugggcgugguggcuggcgccuguagucccagcuacuugggagucugaggcaggagaauggcgugaacccgggaggcggagcuugcagugagccgagaucgugccacugcacuccagccugggugacagagcaagacuccgccucaaaaaaaagaaauuagccagguguaguggcacacauguagucucagcuacucgggaggcugagcaggagaaccgcuggaacccgggagguggagguugcagugacugagaucgcgccacugcacuccagccugggcgacagagcaagacuccaucucaaaaaaaaagaaacauuaaaaacuaaaggaaagacacuguccccaccccaccuccccaggcugcagggauggggggaguuugaaucccagggaaagcagggaguagacggcaaaaccugcaggggcagcaacggcugcauccagaucagccucgggaaauccaggcucuucaucuuguauguucuuggugucuaugggccuccauuuccccaaguggucuguaaguuguggaggccagcauggaugaccccugaaggugagaacgggcucugacauccccagguucucaggccuggccuguggacuguggcugcgucccaggggucagcacacacuuacuucgauggugaagacccccauagcuuuuguucuucagcacucaguggcuggcuguggccccacagaggggcuggggugcagccucccccucugccagccccccugggcucaaucucccaggggaacagagggggcugcucaggaggcuggcaggaggagagucccugcggcagggcagggcagaggcaccgcuugucccugaagcugggagguggcucagcugcacagcacccggagggccugcaggcagcuggggguggggacccugcugggcacggugggggcccgcacucggggaccaggccugugggaggcccucgugcucagggcaacacugugaccuccucugacuccgcccccagcuaaguugugcacugucagaaacaggccagggaggcacagccuguuugugaaucggacuuuuccaggauuccuucccagcuuaggagauuggagacccuggggggccccuccuguguguugaagucccaugguuccggcuccccuuucuuccugaccugaguggucugaacacacaggugagagggagggagccaaaaagcugggugaugagacaaacagguagccccaggagaccacagggauuccgguccugaagggagauggcugggugugagggggaggcaggaagcucugccuuuucuucugagaaugugggacccuguggccuucgcagcauccucacagccggagucuucuuagcgaaauugagggugguucuucacgcuuucccccacugcccucucaaccgggcagcucuucuggaaggcaacuggaccauccaggugcuguucuaacucuaaaaacacggccacagacccccgcauccagggaugguugcggcuccucggauccuugcgccucugcagcuucucagaguggagggcagaugugugcagcagcugaggggcagcugccggggucagugggagcccaacauggcaggcaggccagaagcgugggcccagaaggcccagucucauauucuugcucagggauuugccuucuguaaaaauccuuuguaagcgaccaucucaaggcacucuauagagaucguggguauugcacuguggcccggugcccaguaaguucuggaugcuccaaaaauuguacagaugauucaacugaauuccaucuauuuuguucuaaaccuuccucuuugacacuggcguguccacacccccacugcaaggauucggcaaacugaccucaguguucuggugccugccaggccccgacagcugcguuuuggggcagccguguggacaugugcccuucucucuccagauuccugguguuucugcgguaccaguguuacuauggguauccgccgcugaccuaccuggaguaccccauccucaucgcgcaagguaacagccccuucccuguccagcggacugccacgggucuccccuuccccccucacucggagccucucucuuucagaugucauccuccugcucuguaucuuucauuuuaacgggaacgugaagcaggccacuccuuacaucgcuguguauccuuucugaaucugagccagaagugggaacggggauguuauuugugaaugguaugcauugugaagcaggcuccuuuaccagauguguauuuuuugguuaaacuaaaaaaaaaaaaaaaaaaaaucccaaaugcaaacguguccauguacaccagagaugcccucaguacagccccugcugcuccuccgagaccagcaugcccugggcggugccagcaggccgaguggaaggcagaucgguagaguccaccccugcuaagagcagcaucguccaacugcauuaguucaugugagacauuucuuccugcccugauaauguccuccgaggauuggaagcaauaauaaugagaguauccggcgccucucaagacguuagcuuagaggcuaaaccuugaggucugaggggcaguuguuggcccagaggcuugcagugggagccuggucagcucagagaccuguuccugcucaguggcacuuccugugaaugagggugaggcuucauuucaguucucuuuguaaagacucacuaguugaacgucacacuccuuaaaaagccaggagaguguuuuuuuuuuuuuguuucauuuuugguuuuuauuuugagacggucucgcucuguggccuaggcuggguugcaguggugggaucaaagcucacugcagccuugaccuccucggucaagcuugauugccuugaucaagugauccuccugccucagccucccgaguagcuuggacuauugaagaaugccaccacacccaguuaauuuuuaaauuuuuuguagauacggggucucacuauguugcccaaguuacaagauguuuuaaccuuuuuuuuaagagacagggucucacuaugucacccaggcuggagugcaguggcuggauuagagcucacugcagccuugaacuucuggggccaaggaaucuucccgccucagccuccugaguagcuggagcuacaggugcaugcuacuaugcccagcuaauuaaaaaacauuuuuuuuagagauuggguccugguauguuacccagacuagucuugaacucccggacucaagcgaucuuuccaccuuggcuuuccaaagugcugggauuacaggcaugagcugccacuucuggcccaagaaaguguuuugaauggcacuagcugucagccuguccugccacaucugugaaauggcuugagcuguuucuucccaugcccucuucagaguggaggaaggagggcagagccaggccuguggcccgcaggccaugagaauguggguguggaguggugggaagcaguuggccuggagccagacaggacaggucccugccaccacagggguggcuucagcauacaccauaaacugugcgucccccaucugugacaugggaucauaaugccuauguuuuaggguuacuguaagagcuagaaguaccagaaacacagucaagcagaguaaaugacagggccauuguggugguuuuacuagaggcgaggcucugcagccugugucuauggagggagcuggguucuggcugaguccugacccucugcuguuuccccgaguggcaagcucugcugccucaguuucugucugcggaaagagggaucgcacagcuguacugcaccucaacacuucacggucagucccagcugguuaaagguuuugguaaacaguacuuugaagaugaaaagaguuacauaauuuacuuuugaaauaaaaugcaacagcuuugugaagauagugaggcugcagauuagaaaauuugggugcugguggcacugggagauaccacauggcuggaugcugauggcgagucuguaguaucagcaagaugcuuauaaucucccauugguugugacuuacggagagcgaaagaauaggguuaccauauuaaugaauacuuuuauuuuuauuuuauuuuauuuuauuuuugagacggagucacacucugucgcccaggcuggagugcaguggugccaucucagcgcacugcaagcuccgccucccggguucacgccauucuccugccucagccucccgaguagcugggacuacaggcgcccaccaccaugcccggcuaauuuuuuguauuuuuagcagagacgggguuucaccauguuagccaggaugguuucgaucuccugaccucgugauccaccugccucagccucccaaagugcugggauuacaggcgugagccaccgugcccggccuaaugaauacuuuuaaauauugcuugggauauacuucuacugauaauuauuggccagguguagcggcucaugccuauaaucccaguguguuggguggucgaagugggaggaucauuugaggccaggaguuugagacuagccugggcaacauagugggauucccuagcgcuccaaaaauauaagagaaaaaaugagccauguguggugucucauaccugucaucccagcuacuuggggaaaguuacuuguuuucgaccugaaauuaaaauuuaacuggguguccuguacuuuuauuugugaaaucuggcaacccuacaaauaaaucaucuguaggaucucaggagcuccuacuauuggucaaauuuuauaaaauguauauucagaauacacagaaugaggugggauagaacagaauugguggggggaggagucacaaaaauuagauuuaaaaauugaguuaguguuuuaaaaacaggauucuauccagccagcuucgagcuaccuucugguguugaucaggcugugaguauuuaguuccacugacuuuuagcacagggcauugucuguuucaauaucuucauuuaauuaauguuugaaauuauaauaacagcagucucuugagucggugcuacgugcuuguaggcauuuuacagauaagcaaaucaagguggaaagauggaaagugacuugcccaagggcacuccagagacucuuggcuguccccuuccagcccuggccgcugucuccugggugcuuguucagcucccuagcuggccucuauucccguggcgucaccgagcucggugcacaugccugacuuccagcauugcccaccccagcuguaucauuuuuacaguggaguuuguggggaaagguggaagucaguaaacagaaauucacaucacagcaauuuugcagaacauuccugcuuuauaauguuggacuucuccuuuaagugcuuagcuuuugaccauaaaucagagaagucugcauggucuagaauucagugggcagugaaaccacuaggaauguucccaauccuagggagcaguccaugagcgugggugucuuuguauuucucuucuguaaccuguuuucguucuuuugaauucugagcagguguucacuugcgacccuuuucgucccuuccaaauccggcagguucugguagcauguccuccccucccacccaccuggcuucugcgugccgcugucuguggucuugguuuguauaugugagaugggaggguggcgcggaugugggugacccacugcugugucccuuagcacuugguaagauuggugucuucuugguucauccuugcccugcagaaguggaucauagaccuggccaugguaaguauuaugcuugaaaagaaaguaggaggaauaagcuaccuuggagagaacuugauagauauuuauauauauauauauauauuuuuuuuuuuuugaaauggaguuucacucuuguugcccaggcuggaguacaauggcgcaaucucggcucaccacaaccuccaccuccuggguucaagggauucuccugucucagccucucgaguagcugggauuacaggcaugugccaccacacccagcuaauuuuuuuuuuuaauugauucauuuuuguuuucuuuuuuuuuuaguauuuauuguuauucuuggguguuucuugcagagggggauuuggcagggucacaggacaauaguggagggaaggucagcagauaaacaagugaacaaaggucucugguuuuccuaggcagaggacccugcggccuuccgcaguguuugugucccuggguacuugagauuagggaguggugaugauucuuaacgagccugcugccuucaagcaucuguuuaacaaagcacaucuugcaccgcccuuaauccauuuaacccugaguggacacagcacauguuucagagagcacuggguuggggguaagguuauagaucaacagcaucccaaggcagaagaauuuuucuuaguacagaacaaaauggagucucccaugucuacuucuuucuacacagacacagcaacaaucugauuucucuaucuuuuccccuuucccccuuuucuauuugacaaaaccaccauugucaucauggcccguucucaaugagcuguuggguacaccucccagacgggguggcggccgggcagagggguccucacuucccagaaggggcggccgggcagaggcaccccccaccucccggacggggcggcuggccgggcgggggcugaccccccaccucccuccuggacagggcggcugccgggcggagacgcuccucacuucccagacgggcuggcugccgggcguaggggcuccucacuucucagaggggcggcugccgggcagaggggcuccucacuucucagacugggcggcggggcagaggcgcuccccacaucucagacgaugggcgaccgggcagagacacuccucacuuccuagacgggaugguggccgggaagaggugcuccucacuucccagacugggcagccgggcagaggggcuccucacaucccagacggggcgacggggcagaggcgcuccccacaucucagacgaugggcgaccgggcagagacgcuccucacuucccagacugggcagccgggcagaggggcuccucacaucccagacgaugggcggccaggcagagacgcuccucacuucccagacggggugucggccgggcagaggcugcaaucucggcacuuugggaggccaaggcaggcggcugggaggugcagguuguagcgagccgagaucacgucacugcacuccagccugggcaacauugagcacugagugaacgagacuccaucugcaaucccggcaccucgggaggccgaggcuggcagaucacucgcgguuaggggcuggagaccagcccggccaacacagcgaaacccugucuccaccaaaaaaauacgaaaaccagucaggcguggcggcgcacgccugcaaucccaggcacucggcaggcugaggcaggagaaucaggcagggagguugcagugagccgagauggcggcaguccaguccagcuucggcucggcaucagagggagaccguggaaagagagggagagggagagggauccccagcuaauuuuuguauuuuuaguagagacaggguuucacuguguuggccaggcuggucucgaacuccugaccucagaugauccacacgccucggccucccaaagugcugggauuacaggugugagccacggcagcuggccacuagcaguuuuagaaugaagaauugagcaucaguuaacuagcuucuucuuagguucauaauggcauguuggccuuguccuggagaggggcugacuuuuuuucauacuuggcucagggccgaaaauuuccaagggcuccugagggugguucaggauguguuugaccacagaccucuccaaggugacagaagugaacguuucuacccaacgagaaaaggaggagaacuaacugguggucacagggcacugccugccacacgcagacucaugaauuucuuuccccuuucccccaacaucuugucuggaaaguagacuagauucucuguuacauuucuguuacauuucaacccugugacuugggagagcaaauaaguaggguugccauauuaacaaggaacacuuuuucaguacguguauguccaaaauacugcaugggucgaggugggguggcucacgucuggaaucucagcaccuugggaggccgaggcaggcagaugaccugaggucaggaguuggaggccagccuggccaacaggcgaaacccuguucucuacuaaaagaaaauacaaaaauuagccaugcaugguggcgggcaccuguaaucccagcuacuugggagacugagucaggagaaucgcuucaaccccggaggcggagcuugcagugagccaggaucacgccacugcacuccagccugggugacagagcgagacugcaucucaaaaaacaaacaaaauauugcaugggacauacuuguacuaaaacauuauuuguuguuguucugaaauuuaaauuuaacuagauguccuguauuuuuguuugccaacucucacaacccuguaaaugagccaucucuauguucucaguaggucuuacuacugaugaguuggggugguucuaguucuauuagcccccauacagcagcugugagccuucaccccugaggaaacauccuucuagcaguguugagauacaggcuugucaagaauggagggaugugguggcucaugccuguuaucccagagcuuugggaggccgaggcgugcagaucaccugaggucagcaguucgagaccagccuggucaaaauggcgaaaccccgucuacuaaaaauacaaaaauuaucugggugugguggcgcaugccuguaaucccagcuacucgggaggcugaggcaggagaaucgcuugaacccgggaggcggagguugcagugagccaagaucaagccauugcacuccagccugggcaacagagcaagacuccauuucaaaaacaaaacaaaacaaaagaaucaaguucaggggucaagggcaacaacagcuuuuagguguuuguucugugcccuuagcaguagucaucuauucuaacuauaacauugaugauauaacauuucauggaauauaauuuugauucuuuccuuuaucaugcaagggcugaacaccaggcuccgugcugugucugcccauagcccuccuucacugacucaaugaguguuccucacgcaccugcucugagguaccaggguccggggcacaagguggcccagaucugagggucguggagccccagugcaggagaacgagcagggccuucagagcucacacaugguagcaaaaccccagaauccuagagaggagcgggugcugcuugaaucaguggaaaaccuccauuguagaauguuccauuuuuuuggcuuucaaaugcagguacccgagaucguucccccagagguccuaaacugugcuuucaugguuaaauugauaauucauauacucauaguuuauucacaagaaaaugauuaaaguacuuaaaaaugaucugcaaggccgggugcgguggcucacgccugugaucccagcacucugggaggccgagacgggcggaucacaaggucaggagaucaagaccauccuggcuaacacggugaaaccucgucucuacuaaaaauauauaaaaaaaaauuagccgggugugguggcgggcaccuguagucccagcuacucaggagggugaggcaggagaauggcgugaacccgggaggcagagguugcagugagccaagauugagccacugcacuccagccugggugacagcaagacucugucugaaaaaaaaaaaaaagcucuccgugacagcuaagcaucccuucuuuccaauccuguuccuggauuagacuguuuuacagaaaaacuucauagucuccaauugaauuaaugugauaagacauuccagggcuugguuggggcccaaaccaacacuacuucaggacuguaaaaauagcuuuguuccugaaagaugaaucugguagaauaucuagcaggcaagcuuguguuuaacacgaguguguuguaauguggucugggacccugaugugugugaacaaagccagcuuccccagcucuucccauuccgcaccgacuccucgccaccccgccgagccuguguucuggcugguucucuggugcgagcccuccccugcaguccucccuccucugcucuguccaggucuccugauugcacaagagccccucuccucacaggucucccugccuggggccagccauccuccgagcaucugcacccagcucucagggugacuuuaguccugccacaggccugaccacagguucuuggucaacuccucugcccaagagcacucccugcgguucccuucuccauaauuccuuuuuuuuuucuugugagacagagucugacccuguuguucaggcuagagugcaguggugugaucucggcucacugcaaccucugccuucuggguucaaaugauucuugugccugagccuccugaguagcugggaccacaggcacacgccaccacgccuggcuaauuuuuauauuuuuuguagagaugggguuucaccauguuggucaggcuggucucgaacuccuggccucaagugauccuccugccuuggccucccgaagugcugggauuacaggcuugagccacugcacccugccucccuucuccauaauucuuccuuguccaagugacgccuucucuccucccaagucauccuggaugcaccuuuaucaucacguuugccagacugcauuauuauuaaggauuuauucccucagcaaggauuuguugagugccggccaggugccagcacugucacagguccuggggacccagcaggaaacagaccgaguguuccccaugagcuuuccuucuccaggggagacagaagguaaacaagcugcucuugucaaggccagcggcuuucauucgcgccagagccuguggccaguucucauuccucuucuucauucauaucucgguagcuuuugacaccaucgaucaggacuccuucuugaaucacugcccaccgggcuuccaggaagccgugcuccccagugucccuuccccuugauccuuucuguguccuugcugguuccuccucagcucccugacuuccguguucccagggcuccagcacacaccgcacagccaaccacuggcuacccuugccugacgacugagccucuccaaccucgcguguccagaacuggguuucugaucucccacccugccccucucccaccuucaucuuaaugugucucaguuaaugggaacucuguucuuccacugcaaaggccagaaacaccggagauuagaaucacccuggauuucucucuuuuuuuuuuuuuuuuuuuugagacagagucuugcucugucaccaggcuggaaugcaguagcaugaucuuggcucacugcaaccuccaccuccuggguuuaagugauucuccugccucagccucccgaguagcugggacuacaggcacgugccaccacacccagcuaauuuuuguguuuuuaguagagaugggguuucaccauguugaccaggacggucucgaucucuugaccucgugaucugcccgccucggccucccaaaguagugggauuacggcgucagccacugugcccagccagauuucucuuuuugccacaucccauuaccacucccucagcaaauccuguuggcuuugccuuugaaauauauccggaaccugaacacuucucaccucgucuguuucuacugcccucguacaaacccaggugacugcacuagccuaacuggucucccaggugucaccuugucucccuucggucuacacucaacccagagacuggaguuucagcugcugaagaggcugaugcuggcagggcuggugguggucagcgucgaggaugcugugcagagcagcaggcuuauuugugaggaucucuuaccucacuguauagcagaggccugagcgcaccaccacacagacuaucagaauagccagaaauucagggcugaggugccgcggcuugcugcuggaguuuguuugucaguucagaacagcauagauuuccccaagcucuaaaacacaguaucucaguacuuuuuuuuuuuuuugagacggaguugcacucuguugccagggcuggagugcagugauaugaucucagcucacugcaacuucugccucccaaguucaagggauucuccugccucagccuuccuaguagcugggauuacaggcgcccgccacuacacccagcuaauuuuuuuguauuuuuaguagagacgggguuucaccauguuggccaggcuggucucaaacuccugaccuugugauucguccgccucagccucccaaagugcugggauuacaggccugagccaccgcaccuggcuccucaguacuuacuucucauuggagguguagauagaugaaccucuguggccaagcauugauucuuucucauucccaacuucaaacuagcucuggccauuaguuacccacugcacgguggaaucugugaguuauaaauaaaugucuuagucugggcaugguggcucacaccuguaaucccaacauuuugggaggcugaggcaggcagaucaccugaggucaggaauuugagaccagccuggccaauguggcgaaacccugucucuacuaaaaauacaaacauuagccaggugugguggcacgugccuguacucccagcuacuugagaggcugagacaggagaauugcuugaaccugggagguggagguugcagugagccaagauugugccacugcacuccagucugggcaacagagugagacucugucuuaacuaacuaacuaacuaaauaaaugucucacuauuccauucuuuuucaccaaacuuagguuucaacuuuguacaaauccauuauuauuuugacacuccagccugggugacagagugagacugucauaaauaaauaaauaaaugucucacuauugcauuacuuuucacuaaacuuagguuucaacuuuguacaauuccauuauuauuuugaccugaaaauuuggcuucaaaaaugcuuugaguaucucgugcucuuuugcuuuuuuuuugagaugggagucucacucugucacccaggcuggagugcaguggcacgaucucaacucacugcaagcuccaccucccggguucaugccauucuccugccucagccucccgaguagcugggacuacaggcgcccaccaccacgcccagcuaauuuuuuguauuuuuaguagagacgguguuucaccgugcuagccaggauggucucgaucuccugaccucaugaucugccugccucggccucccaaagugcuggaauuacaggugugagccaccgcaccuggccucuuuugcuuuuuuaacaaaucgacucgugacuuucucacauuuuaucugcaaacagaaucuauguacuuucaucagcgcggccaguaaguuugcacagcuccagugucuguggaagacgagagacucaggaacugugagugcgcugacuuggagccucucuuccuauaccugugcaaguaagaaccggacucacaugguggggaggccuuugguagcaccaagugucuacguaguaggguguuaaguugguguugaaguaacauggucccuggcgcuuuacuacuuuacaaauggcuacucagcuagaaccuccuaaguguauccauguuuacaaagaugauuuaaugcaaacugcucuccauuuucuguaaaauccaaguugccaagaaaaaaaaaagugaaagccuauuuuucuccaaaaaccuggccugauauuaauuagcucugucuucuuugaaaggauaaagagguugauuauauugaauguacuaauuuaucuuaagaauuugaauauaacagguuuuaaaauaugaaaaucauacaguggcuuuugagaaugaaugaaauguguagugauggagauuuucggcagccacauuguuuggucucaacuuuagaauuuucacucuucauuuggauucuuacaaaaacuaccuaaaauacauauaugguauauguagguagaaacauuuuuauaauucagagcuaucacauuaguuggauuuacuaguuuuagauauuuuaaguagacuucaucaugguucuucugcaucuuaaagggcuaaugucuccauccaugguugcuggucuuuauauucaacaaguuacuugucuuaauuaugucuuaaaaucaagacuuucuuucuuuuuuccuuugacagggucucgcucucucucacaggcuggagugcagugauacgaucuucacucacugcggguuuccaaguagcugggaguacgagcacacaccaccacaccuggcuaauuuuuaauuauuauuauuauuauuuugagacacagucucgcucugucacccaggcuggagugcaguggugcaaucucggcucacugcaaccucugccuccaagguucaagcgauucuccugccucagcuuccugaguagcugggauuacaggcacacgccaccaugccuggcuaauuuuuguauuuuuaguagagacgaguuuucaccauguuggccaggcugguuuugaacuccugaccucaagugauccacccgccuuggccucccaaagugcuaggauuacaggcaugagccaccgcgcccagccaauuuuuuguagagaggggucucacuauguugccaaggcuggucucaaacuacugggcucaaguguucaucucaccucagccucccaaaguauugggauuacaggugugagccacugcaccuggcccuguauguuuucuuuggagaaaugucuguucacaugguuugcccauuuuuuaauugggucauuugaguuucuuacauauucuggucauuaacccuugucagaugugugguuauuaacagccuuuuaaaaaguuugucugagaguccuuuguuggccgccuuccuaacugaagucuucugucuacuuauaugauugaauucuuuuauuuaaaugaugauuuaaucaacaacuauuuauguggugucuguguguaaagucuugguuuaucaaaugugucaacaaaacauuuuauaggauuuggccucugcccuucaggggcuugcaguuuaguuggaagguagaccaaaaaacuucuaugucaauaugugcuaaaugcagaauguguuagcagagaguuuugacaggcugguuuugggcuaggaaaggcaugccuugagcugcaggcaguggucuucucuaacucccaagucacgccacucccugcucuugugugucgguuuaaacuguuacuccaauuuccuaaauguuuacuaaguaaagggcuauggcacacaaauaaacuaaacaaaauaguucuaguuagacccuuggaaaaaucuuccccuuuucugggccucagucuguuuaucuauaaaaugcaaggauagaaaccagugauucgaaaacauuuauuguuuguuuuuugagacagaguuucgcucuuucgcuuaggcuggaguguaguggcaugaucucggcucacugcaaccucagccuuccgguuucaagcgauucuccugccucagccucccaaguagcugggauuauuacaggugcccgccaccacacccagcuaauuuuuguauuuuuaauagagacagggucucaccauguuggucaggcuggucucgaacuucugaccucaugauccacccgccucagccucccgaaaugcugggauuacaggcgugagccacugugccuggccaaaacauuguuuuuaauuagugggagccuuucuuuaaauaaaacuacccagaugcucaauuuguaaaugagaguugcuuuuggaggguuggggguugcagguuagcacagagacaguggaagggagcucagucucuccggccuuccgcaggcagcgcucgaguaccuucuagguaccuucccucaugagcaguuucaaaaccauugggccauugggguaggaugcauggcuguuuuuuguuuuguuuuguuuuguuuuugagacggagucuggcucugucacccaggcuggagucaauuggcgcaaucucagcucacugcaaccuuugccucccagguucaagcgauuaucuugccgcagccuccugaguagcugggauuacaggcgcccgccacuacaccuggcuaauuuuuguauuuucaguagagacagacaggguuuugccauguuggccaggcuggucucgaacuccugaccucaggugauccggcauggcuaguuuuuauguaauuaugaaauacagcacuauuugguuuucuguacuaccaaacucugucaagaauaguuaauauauguuguuaaaaaaagaauaaaaauaauuuaaaaauaaugguuaauauauauugggauauuaaaagggaaagacauuauuagcuaagccccaaaauguccgagaggcaaguuacuuauugcugcaaguuuucuuuuacagcaagaauaaucacaaccuuaaugaccaccaaugauuuuacaaguaagcaaaauaucuucucacuuccuuuuugaguuuugugcuauuugugucuccuucauuuguaaacugucuuaggguuuaauggauggacuuggcucuguuggauuauagauuuagaagauggcaacaauguauuccuagucuuauuggucaccauuuuuauuguuaagccucuccuucuuauaguacaggggauagacuaugcacaagacaauagauuccuaucuccauggaacuuccacuuaagcaguggaauuggacaugagguaaucacacaauucccuauugaauucuaaugggacaugguuuggaagaguagggcaggaugagcaucuaaggagaaccuggccuaguuugcaggaguugggcagauuaauuugaagaagagugaucguaaggaugaguagagguuuagccagaggaaaggaugugggcggaggccagacucuuaacaaggagcagcauugugaaggucaugagcgaaggacaaagggcuagagugcggagagcagggggacagugacaagcggguuucaggagaggaaggaugcgagacuggcaguggcccaaguauccagggccuacaagaacugccuacaaaacaguaggaaggcucuggaggcuuugaagcagggaaguggugucaccaauggacuauguuuuuguucuguuucuuuaaaagaaaaagcugucauggaggaggaaauacuaugguuaaccacaaaagaauuuaguaauuccuuaggcuguuuucaacucccaaaucaagcauauauuauacaucuuuggaaaaugauuagaacagauggugucaccugugaagaucagaaaauguccccagcauguagaccuuuuaaaugagcuaauuauuauuugagaaauagugcuucagaacagagauauguuuguuagucucuuccuggagguuauaccuuugcucgaauacuuuuugucagcucugaugauaggacuaaaauuguucuggucaaagcauaaacuuugaucaagugggaaaugggaaggaagacaggcuugggucuuuccacaggacuugaauucucagcauggaaaggaaagucaaaccacaaguaaacagcaaaaccuauacauuagaaauuaaaagaucaagauuguucuaauugugauuuauuucuuaucuaugacagcuguucuugaaagugaucaguauauccaggaauaacuuuuuuguuguuguuuuguuuugagauggauucucacucugucgcccaggcuggagugcaguggugugaucuuggcucacugcaaccucugccucccggguucaagcaauucuccugccucagccuccagaguagcugggauuacaggcaugcgcuacuaugcccaacuaauuuuuguauuuuuaguagagaugggguuucaccauguuggccaggcuggucucaaacuccugaccucaggugauccgcccaccucagccucccaaagugcugggauuacaggcgugugccaccgcgcccggccugggaauaacuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccagggaauaacuuuuuaaaaacaguucagcuaaaaucuuacauguguuuuucaaacacaaagauaucuuaaaucucauuaaaccuauuuaucaggaguguauccguaccuuaaaguagaaguuaagucacuguuaaaguuauauauauuuauuuauuuauuuuuccacaaagagacacauuuucaugguuacuugaauauaaaauaugccuuguccugugggccaguuuuucaggaugaucuuaacagaguauguuaaaccacccuugcuuaauauggaacguucugagacagcagcacccucaggacgucagaugaguaaagggauuuuuaaaaguuauaacccuucuuaggcugggcacaguggcucacgccuguaaucccagcacuuugggaggccaaggugggcagauuacuugaggucaggaguuugagaccagccugggcaacauggugaaacccugucucuacuaaaaauacaaaaaauagccaggcgugguggugggcaccugucaucccaggugccuggggagcugaggcgggagaaucacuugaacccagaagguggagguugcagugagccaagacaggccacugaaccccagccugggugacagggcaagacugucucaaaaaaaaaaaaaaaaaguuaaaaguuauaacccuucuuagccagagccacauuacugucaauugagcacuuaagaugauaaauuauuauuuaugaaguugggccaaggggccaaaaauugucaugauagggagaucauuuccccagaaauaacuggaaccaaaauuguucauuucggagguugggggugaagcuuuauuuaggcuuauacuuugagcaggaggugguuuuggucuguauuguaaagacaguuuuuaauacacuuuuuuuuuuauuucaguucuucuacguuuugugaucaugcuggcuuuaaauauauggguaacagugacaguacuucgcuaccggaagaccgcuauaaaggcugaaugauggauacauuauuccuucacacaguggauuuugaguaacugaaccaaaggaaaaagaagcucuuugcuaaauuaaggucuuuuauaaauuuaguaaaucaguuuauaaucuuuaaagccaaagguuuuuuuagacuugaaagaaagagccacuuaaauucuuguuuaaaaauaccaauuugccuccuccuuccucacuucguuagguuaugguagugcucagacaucugcaguguugaggccagucacuguuggaagucauccaagaagcccauuuugaggccauuuugagccuuacucuuaaguucucuaugaagaacuacauugauuuguuggcuuucagaaucuuuuaggaaauaaauccucuccaggacaaaaaugaacaugaauggaguggcauuuuguuccaagucagaggugggcaccuauaauaaaugacuaggguucacuuucugggacugauguuuaauuguaacacagauacaacaggguggccuuguuguguauaauacgguauuauacccgcaugugcucuagcaaggauaccaaggcaagcauacauguagcuggcuugaguuuguaccaaaacaguccuucaacuuugcacugugccuuaaguaauuacuaacaaaagguacuaggauuagcugcaaucucuacuuucgaugaggaaaucccaguaagcuuucugauucaaguacaaugcugccauuuuuuaaagggccacaacuauagaauuaccacuguuggaauuugguacaaaauauguuuugucuauugaaaacauacacgguaaaugguguuguuagguagguucuguccaguucuuagggacuuuuuucacauuauagcauuuuuacccuaaacaugauguugagauuauuauauacuguauuuucuucuaaauuaacccuaauguuuaaaaacucacuuucccccuuuaauugaaggcauuguuuuguuagaugcaguaaugauguuuaccagagauuauuguuuccuaugcaaaauaaauuuucauauuuugaauucugcugagucuuaa

SEQ ID NO: 192346 - RNA, 198919 nt, Homo sapiens
cgccccucuccgcgggaggcgucggggcccgcggcuggguggcggguaguucccgccggcugugcgcgcccgccucggggcucgcucugagaggacgcggcggcagcggacucggagcccucggcgcgcaggcgggcggaccggccgagcugcgcggggcugcgcgccgccccugcuccgccgccaggccccgcgcggcucccgcgcccggcgcuccccuuuguccgcgggccggagcggcggcggcagcggcgguguccgagcggcggucggagccugcugcggcaguugaggcggcggcgccccugcggcugugcgccagcgcccucgcgccgaggcgaugccggaccagaucuccgugucggaauucguggccgagacccaugaggacuacaaggcgcccacggccuccagcuucaccacccgcacggcgcagugccggaacacuguggcggccaucgaggaggugaggcggccugcgcggcggcuccggccgcagguaucccgcgccccagccccgcccgccgcucccgcauccgcaucccgagaaaacuuucuuugcuccgaagccggacgcggccgggccaacccugcccgagacagaagcccuuuguucccgccuagguggcucggaggagaugggugauggccaccuugggccucuuuaagaccuccccucucucggccucguggcccucgcgggguuccgcggccuggucuuuuccccgcagcgcggccaacuuuguccagagucgggguccgcggcgagcgggggaucccgcugcccgccgccgcccgccgccgcccggggucuuugguacccggugcggaccuuaucaacuuguucuugaaguggaccggcgggggcagcuccgcgcuccgagcuccccgccgcagcccccgagcgccgcagggcccccacccucggguccgcggguccggggcaucccgggcugcccgggaaggcgugcccgccucagccagggcggccuggcugcgcuccacccgugcccggagaaggaacugcgggcaaggugugugagagucggcgcuucuggguccaagaagccuccaggagccgcuccccgguuaccugggucucaccugcuugaacccggaaugccgcccuucccccucaaccuggaaaaggccugguuuuaguaaagugcucucaaggugcaaagucaucacgccuagcugcuaagcaguacgcucuccagguccuggggagaggaacacguaggaacgaagaagcuugguugaaaauuaaagccguggggaaaggggcagagucugugaguccaggggccaccguuggcugugguuugaggcacauccucaccugcaguccuccuuuuccuuacccaucaaacgggauuaguaaugcauccuuuccaggaucagagacugugugaagugcuuagcacucugcucggcucagaauagguuuacaagucacacguguggcaauagugaaucugugauuaaaugucucugggccaggaugucagguuacaguuuuaaaauuggguauugcagguguuuuagcagaagacgccugggcuagcaggagugugugugugggugggggggugggugucaccaaagagcuuuaaaugaagcaauggcguuauuuuuuuuuucugguuuuuuuuuuuuuuucccauuugaacaaagcaucugcuauuaggaauugcuugaaaaaaaauccagaauguuuucccuuaauggaaaaauuuuuucuuuguagcuguaaacagucaauaaaagggagucaaaaguaacauucagcauucugaauccuguuaauauaacuuggguagccuuccuucucuccauuuaauuuggcggaagagagcugcauguaaaccuuuccuaugaauucggugauuccccagaucacuuaauucuacuuuuagcagcaaggcuuacagaugaugccuucaaaugaggcagauggggaugggugaaugaaauuuuuuccuaagugccaguuaaaaagcacgguguuuugagaauacaccauuaauaauguuuauggaaugauugcaaccaaaaagguagcugaauauuucuuaagggaaggaagcauugugcaugaugucuuucuuuagaaagcuugauuauguuuaaaguucuguugcuuuuccccacugcaguuugucaguuaaauauuauuaacacuggcagauguuggaaagccaagcaaacaagaauugcuauuaaaauuggcauaccuuucucugauuaauuuuaguuuacaguguauaauuccaaagcucuuuuuguaugcugugcaggagauuacccuagagcucaguuacugagcagauuacaaagagacuggauuuggucauuucauuaaauugcaagcuugcuucaugcugccgucuaagcccaagaauugguucaagucucaaaauggaaaaauuaaaaucauuucagguuuauuucacuuuaagcaaaucuacauacaugcuaugaugaugguaugugugagcuugguuuuauaacuaaauuugaaaguuguucacuuucugagguaaaucaauguggauuucuuuaaauaaugcucuuucccaggugucuaauguucgugucuauuaccaaaacuuguucuauguaugguuuaauaacaauugauguguacaguauuuugguuuuaaacaaaaaucuucucauacugagacgaaacaugagaggguaucaugacauaaaguuacucauuuaacaaauaaauaaaauuugcaagcucuuggucuuauguuuaaacaaaugaaucacggaacuagcaaacuaauuuuauauuuauuuauuuauuuguuacggaguuuugcucuuguugcccaggcuggagugcaauggcacaaucuuggcucacugcauccucugccucccagguucaagcgauucuccugccucagccucccaaguagcugggauuacaggcaugcgccaccaugcacagcuaauuuuuuguauuuaguagagaugggguuucaccauguuggucaggcuggucucgaacuccugaccucaggugauccaccugccucagccucccacagugcugggauuacaggcgugagccaccacacccggccagcaaacuaauuuuaaacugauuaaccuuuuugaaucuguuauuuccaauguagguucuaucugccaaagaaucauuuuacaauuaaaaugugcuguuuugauuugcauacuuguugcuggaauauuauuauaguaacuguugggcccuuauccuguacuaugaaacucacagguauugaauucaguccuuaucucugcuuuauaggcgaggaaauugaggcucagagagguuaaguaauuugccaaagguuauagagcucugaaguggacuuugaacuuggcuccugcuguuuucagaaaccaugcugcuuccuguuacuuuucuuaaugccgaauucucuaaauuacuccuuugucagauugaccuggguucaaguucaggcucuacagcuugccagcugagugaacuugagugagaugccuaacauuuucuuauuuuccucagcuuuaaagucugguuaauaauaccuaucaacuucagaggauuguggugaggguuuaggaagauaguacauagcacagaagcugccagacaauuaguuaccagauuauauaguuagugaguccacaggccccagugagggcuuuuggagugaggaugggauuuacauggggggaagugucagggaaauggaugaauggcugaaugggugagugaaugaaacacuaccguguaucuguuaacccauguguuuuuuuuuuugagauggagucucgcucugucgcccaggcuggagugcaguggcucgauccccacucacugcaagccccgccucccagguucaugccauucuccugccucagccucccgaguagcugggacuacaggugcccgccaccaugcccggcuaauuuucuguauuuuuaguagagaugggguuucaccguguuagccaggauggucgauggucuagaucuccugaccuugugauccgcccgccuuggccucccaaagugcugggauuacaggugacccauguguauuuuuuaaaaguuuguugucaggccaggugcgguggcucacgccuguaaucccagcaguuugggaggccaaggcgggcagaucacuuggggucaggaguucgaaaccagccugaccaacauggagaaacccugucucuacuaaaaauacaaaauuagcugggugugguggcgcaugccuguaaucccagcuacuugggaggcugaggcaggagaaucacuugaacccaagagguagagguugcggugagucgagaucgugccauugcacuccagccugggcaacaagagugaaacugcgucucaaaaaaaaaaaaaaaaguuuguuguccuggcagcuggugagagcauaccuguauuuuauaauuuuucacuugaccaccuucucugguucaagucaucauuuuguacaauuuuagcaaacuuagcaaagucuggugcugcaaccagagucugcccugugcuuuuggaaauaauggaaaaaauaagcaguuguggcagaaauuugaaaaguaaggguuuuuuguuccuuuuuuuucuucuuuuuuuuucguuucuucgagccucugggcacuuugaaauauucucaaaauagggaaaaauuguauacauauuuggaauauucauguuuuuaguuagacccuccuuuauagcaccauccauucugccuuacguauuuggcauugauguaguuuuaaaaauaaauuugauguugacuuguaaguauuaaaauuuaaucuacuuccuuccggggccauaauucucuacuuuguuguccuugguuaccuuggcaaucccauugcugucauaagcacaggguucuaacugcagggguggggugagcaucugggccugcaggcucccaggggcccugccguccaugggaccagaccccuccuagcagcaacagugggaaccagggcuacgugcuuuuuggcaagaaugugauucugaauguuagcccuuugugacuuguuugaaaaacaguuccuccaaguccccagaacagauuauugcugucuucagaaggacaucaccuucuugcccagagcauucauguuuuuggaagugagccuugaugggucaaacagggccaccuuuuaaacuguguucugaaauuugaauuucagaaaauuuugaaucacuuaaggaagcagccauuuucucuucauaugugagccuuccucccugcccccuggugaaugcugaauucaguuucuuucuuaggcucaagaguagaaguacugaugccacuccucacggguuccagguccugccaugcacucaggauuccugaguccuucagugugcugggcugugugugagguggcaggaauagaacaccaagaagaauauguccucucuuuggagggaccuacaguccagcaagaggaacagaauccuguaaacaaaucagugcaguaaaaucugaggaccacaucuguaggaaugcuuggaguccuguggaugugcaagggugcagguggucccagggcguggggcuguggugagggagggccuuauaugaugucguaccguugagucuugaaguccaggcaguuaccuguggguuaccaaaugcuaaggcacuaagcugguucauucuggucuucuguaccugccucccugccuuagguaaauauugaucuacuccugaggugguggccagcucggcgucugcgguaggauuuucacagucaccuggucucuagagggcugcucagaccaagaauuuggggugauccucaauucuucccaugcaccccacguuuccaggcaccggugccuuccuuuguggagcauauacaugcauuccaggcccgcacugucugaugaggcagccuaagacaaauccagcucucagccgccacauugcaaguacucaguagccacacguggcugguggcuaccauauuggcucagcaaccaccgggagagccaucaccuggaaacuugcugaaaugcagagccccggguuccacccaggacaauuuuuacagcaucuccacguacaccacaggcacgugagagcuugcgaagcacuguucgagacggaaccccggcugcacacuggaguugcuugggcguuugugaagcagagcugccuggcuccacucccuaaaauucugacuuaaauuagucuggguggggcuucgagccuuggcauuuuuuaaagccuccucccaaauaggguugauaaucacugauaaacagacaguuacguaacaaccuuaggcaguugauacgugcuguaaaggaaagucaugcauaacauggggauagaaagugguucuggagaucaggaaaccgaaaucaggaaaagccucucugcagaggugacauuugagcaggcuggaaugcagagaggaagccagccacagaagaugugggaauagaacagcuugggaaaaggcccugaaaugccaaugggcgggaucauggaaggacugaaggaaggucaggguguguggggaggagugggcgaggaagagaaggaugagagacgggcagaggggugggcagugccaggucacagagggccuuguccaucuuggggaaggaauuuggauuuuguucuagugugaugggaagcuguugaaggguuuugagcagggaauaacaugguccgauauccauuuuaaagacuucacugugguucuagggaaaacagacuagcagggcaugaaaggaaagagggagaccaguuguggggugaggggcuauugcagucaucuaggcaagaggucuuggaugaggagguagcaggggggguggugguaaguggccugauugagguccauuguacaagaagagggguccaaaccuacugauggauugucauuauugugugcuaguggcauagagguagacccaauagaacuccugccccaaacagggcaacagccaagcucaguucauccaagcccccugaacagaccuuccagcauccccauggugaagcuguugcugucuagagcuacuuagugucagaauccaggccagcucugugcugcuugaugugacugguuauaggacuuguguugggaccaguuccagggucaaucaaggaaagauugaagcauagcugcauagacuggggcccagggaaagagagaagcauggcugcauagacugagacugagggaucugcucaugcgacccucugcuguuucuaugcagacuacagcaggugauacuuaugggcauugucagaugccugggaugcuauccccauuucagcuccccaaacacuccucuuucuuucccuacuaaagagaggugacguuccgugauaugaaccuaccuccuuugcuuacgccuuuucuguguaauguggccuccaaguggauugcuagggcccuuccagguacuuuuuuucuuuucuuuuucuuuuuuauuuuguuugagguggagucuugcucgguuacccaggcuggagugcaguggugcgaucucgguucacugcaaccucugccucucgaguucaagggggauucuccugccucagccuccugagcagcugggauuacaggugacugccaccaugcccggcugauuuuuguauuacuaguagagaugggguuucaccauguuggccaggcuggucuugaacuccugaccucaggugauccgcccaccucggccucacaaagugcugggauuauaggcgugagccgcugcgcccggcugccuuuccaggugcuuuuauaccauuaucguuuuuaucaugucaacaaugucuuggaauaaacagacuaccaacccgagcuggaauacuugggcuguauuuuuaugaugauggucauuucuaugaagggauuugacugauuuaguuucuucacucauaaauguauauugggccccuaccguauguugucacugccaggugccagggauguaaaaguggacaggauggccuggacgucuaaaaaaaaaaaaaaaaaaaaagugaacaggacuagcuccuuccuuagaaagcacuuaauagucucauguuuuaugugcaguucuguuucauccuuuuaaccuuguuugugccauggcucccuuugacacucuggcgaaggugaucugccucuucagaaaaauguuuuaaugcagagaacaaaauaagauuccgaaggaaacuaaucacagucaugcauugcuuaaugacgaacaugcaucguuaagauuucuucauugugcgaacauccuagagugcacuuacacacacccagauggcaugcaggcaccuaggcuauauauuaagagccuauugcuccuaggcugcaaaccuuacagcaugccacuguguugaauaccgugguaacugcgacacaguuacaguauuuaugugugguauuuguguaucuaaacauagaaaagacaguaaaaaucccucuuauaaucuuaugagaggucgucugugugguucauuguugacugaaaugucacuauguggagcacgacuguauauugaaauucaguuaggagaauauuuuaaaaauuuuuaccaugcucauaaugcuucuuuacuaaagcauuuaauaacaagauuuacuggugggucuaacaaauaccuuaauuuugagguauugaugaauauaaacaauacgagauauuucuaauaaagauaauguaauguucauaucuuuuauugcaaguauugauaauauuaccauguguugcuuacauuuguaauugaaagauacgauaaauuucaguuagacccuaaugaaaauacagauaauuuuuuuuuuccaauccaaguuuauggacccccuggauucagacagagaauuccaggcuugaugguaagauuuguuuagcuaguuuuuuuuuuuuuuuuggagugauggauucuuuaaccacucuguuuguuaaauauaauuauuauauuucauaauuauuauacuguccuugccaugaauugguucuaagagucuagcugagaagaguugcacccuaggccaguguuagaauuaugaggcgcuaaagguguuuagaagcgcucuuggcggggagccauccacugugguuuuacauccguggggugcccucuguucuuucaggguuauggcuuggcagcuucucaucugaucccacaggucaguucauauacuugugcaugccucaagaguucagcagagcugcacauuggaccuucugaguccuguaauuaggauucugagcuggguagguccuacaacccagcucuccuauuugugccuuucuuguuugugucacacggcauguacugccuuugacucugcagggcaaguuccauugugaagcaccagaagauucaugggcaccaccuacccagaauuuuaagggagacuuugcaguguguguuauuuucagugaggguauggauuugaaaugcugcugcuguugcaagaguguguuggggauauccagagugugggugaagucaaugucaguucauauuuuuuuuuuuuuuuuuuuucugagacagggucuggcucuguugcccaggcuugagugcaguggugugaucuuggcucaccacagccuugaccuccugggcucaagcgauccuccugccucagccuccuguguagcugggacuacaggugugccccaccaugccuguuuaauuuuuuuuuuuuuuuuuuuuuuuuugagacggugucucacucugucacccaggcuggacugcaguggugccaucucagcucacugcaaucucugccucccagguucaagugauucuugugccucagccuccugaguagcugggauuacaggugccaaccaccacacccagcuaauuuuuguauuuuuaguagagacgggguuuugccauguugggcaggcuggucucgaacuccugaccucaagugauccacccaccuuggccucccaaagugcugggauugcaagugugagccaccaugcccggucccugauuaauuuuuguauuuuuuuguagagaagguuucaccaugucauggcuggucuugaacuccuggacucaagugauccuccugccuugcccucccaaagugcugguauuauaggcgugaaccaccgugcccagccucccccuugucuuuucuaacauuuauggggcacuuauuaugugccagauaugcuuuaaauucuuuacauauaucaauuauuaacucauuuaguuauuaucaaaaugcuauaggggccagcaaaauuaggccacgguaccaaguucauggagcuuggaggugaugaagccaggauucauucaaaucaagcauuuugacaccagagucugcuauuucuuuuagcagccaacagccucuguagagcccgugcccaccaaggcccuugguguugcagccucuguggccagcaugcccucccuugcuguuaguguuagaaaguugcagcuauugcauugcucgagugggugcuucuggcaaauccuuguugcuucucguuuccuguuugccucaucuguccuccuugcugcagaaauuguucuucuuuccucuccucacugcucugcugacaugcccagccccacggagcagaguggccaggggcauugcucacacccuggcaggaggccuucccugcuaacaguguuaauaacgaugucauuuuuccacuccaugcugaagauggcuuugucaauaaaaucaggcaguugaugaagacaguucccucucaugaugaauucacuugucuuuuaggauucuagccaggcagucaggauugucgggaccucuuuccccagcuucucagaagaaaucauguucuucuuagagguauguuuuuguuuuuuguuuuuuuuuuugagacggagucuucgcucugccacccaggcuggagugcgguggcacaaucucggcucacugcaagcuccgccuccuggguucacgccauucuucugucuccgccucccgaguagcugggacuacaggcgccugccaccacgcccggcuaauuuuugguauuuuuaguagagacgggguuucacuguguuagccaggauggucuugaucuccugaccucgugaggcacccaccucggcuucccaaagugcugggauuacaggugugagccaccacgccuggcuuuuuuuuuuuuuuacaugaaaaaauaaugaugacaaugcuuuaauuucauuucucugagcuuuaauucuguauuaaggacugugcuguguuuuaaauugaugauuugauccccucaacaguccugagguuaguccuauagugacaugccuccagguuccacaucccacaaccagcauuugauagaguaagaaucccagugcuguggaggagguccuacucuucuugaucuuuuaaugccccaccugucagucuccugcugggcucucuguugccugggaagauuucucuguagguguuccugugaguuuccuuagugcagguuaaugaugguuguugaucaccugcaguccccauugucacugaaugugauugccuggaggucaucagacacuaacuccuggggaggcacuuaacaucagaaguguuuauuaacuugaccuugaccaauuggccuccuuagagcugaggggccaagaacacugucacugugugacaaggacuaggagccacccagacccauagaguauucccuucguuucagcaaaucuguauuuugaggcugccacugaagggugaaucauggauguggcgugucuaggcagacuuggguggagaggagucagcucccuguuaacagaggacuuuggagagguuuugaaaggaagggagaauguugaggccuuguacuguauuccccugauagccugaaucuguugucagcucuuggaccuuggagcaggugacuucacugguccugccucaguugcgucauuuguaacauggaggguuggaugcgaugaguccagucuuuccagcucuugaccuuccaugucugcugcugucugcaacacuuccccugccucuugccacccuugcuuuuuuuggcugucgucucuguuuuuuucuuuaucuugacuauuuauauuuauacuuuucaagaaguuagagcuaagagugaacguuaccucuuucauccccuucuuuaaagauucccuccuuggagauaucacuggaguugauguggugguugguacuugagcuggaaucccaaugggugccuugcugguuugagauugggccgaaugaggccguguuguuugccaucugucuugccucagagcaguauuuuuugcagucuuugcugcuuucguuggucucuuaauuaaaacuuuguugugcuuugcuucucuggugaaaagcagguuguguuagugaugaucaugggguuuuguggucauugaguaauguggacuguugaacuucaagaaaauacugauuuucuuauauccagcgagcuuccuagauuuuguggggaaccaguguucucaucauuggaagaugugcucucuagugugaagcagugauuuucacauuugcccugugauucgguuguguuuauguuguggagcagaaagaccuagccagggaguuaggagagcgggauuggaguuguaaggucaaccuuauugugaccuugagccaguuaacuguguaucuggucuguaacaugagagauuuggacuagauguucucugaccauccucccugaccuaaaaauuccauaguucuuuguauucauauauacuggaugugaaaagucccuggaauaaauuacaggaacaaaaaucagccaggaauggcuaguugauaguccugaaaagacaacaucauugcugaaucauaucuucaaguugaauuauuuauuuuugaaaaaaccuuucuauagcauccugagaaacuuauuucuuauuguuguugcuuuuuuaaaaaaaaauugagauagaauucacauaccauagaauucacuuaccauaaaauucaccauuuuaaaguguccaacuaagagguuuuuaguguacucacaaaguuguguagccaucaccacuauuuaauuccagaucauuuucaucaccaaaaagaaaccccauacccauuaggagucauucccuagucaccuguacccgaguccuuggcagucacucaucuacuuucugucucuauggauuugccuauucugguuguuucauauauggaaucaaacaauauguggccuuuugugucuggcuuccuuuauguagccuaauguuuuuaagauucauccaaaucauaacauggauuuguacuuuauuucuuuuuauggcugaauaauauucuaucaaauguguaugauacauuuuguuuauucauucaucaguugauggacauuuggguugccuccacuuuuaggcuauuaugaauaauccugugaauauucuuguauaaauuuuuguguagacauauguuuucacuucucuuggguauauaccuaggaguggaauugcuaagucacuuuaacuuuuuaaacuuaaacuuuuuaaagucaguuuaacuuuuugaggagcugccaaacuguuugccaaagaggcugcaccacuugacauucuuaccagccauguguaaggguucugauuucuccacauccuugacaacacuuguuauguuugucuuuuuuauuacacccaucuuagugggugugaagugguggguuugauuuguguuucucugauggaugacuaaugauuuugaguguuguuuuauaugcccauggcuguguguaucuucuuuggagaacuaucuauucaaauccuuugccauguuuauauuggauuauuugucuuuuuauuguugaguuguaaucugaacauuagacccagaucagauauauaauuugcaaguaauaauuuccauuuuguagauuguuuuuucacucauuugaugguguccuucaaaggacaaauuuuuuaauuuugaugacauccagaauagucauuuuuccuuugguugcauaauacagucacaaagauuuacaccuauauucuguuuuauaguuucaguucuuacauuuaggucuuugauccauuuugaguuaauauuuguauaugaugugagguagggguccaacuucauucuuuugcauauggauauaucuaguuguccuggcaccauuucuugggaagacuuuucuucuugaauucucuuggcauccuuuuuaaaaguugauuuacuucugauauaugaguuuauuucuggacccucaguucuguuccauugaucuuuaugccuauccuuuaugcuaguaccauaaagccuuaauuaacuguaggccuuaugguauguuuggaaaucaggaagugugagucuuucaacuuuguuuuuuuuucccaagauuguuuuggcuauugaggcucccuugcauuuccauaugaauuuuaggaucaacuuuucaauuccugcaaaaaagccagcugagauuuucauugagguuauguugacacuguaguucaauuuggggaguauagacaucuuaacaaucuaucauaaccucuucuaucuaugaacuuggaaguuuuuuucauuuucuuuucuuuucuuuuuuuuuuuuuuuugagacggaauuuuccucuguugcccaggcuggagugcaauggugcaaucuuggcucacugcaacauuggccucccaaagugcugggauugcaggcaugagccacugcaccuggccucauuuucuugucuuuaauuucuuucaguaauguuuuguaguuuucaauguacaaaucuuacacuucuucuguuaaauuuauuccuaaguacuuuauucuuuuugaugugaguggaauuguuuucuuaauuucauuucuggauuauucauugcuaguguauagaaauaugguuacuuuuuguauauugaucuuauggccuacaauuugcugaauuuguuuauuggcuuuuauaguuuuguguauuuguauguguauuccuuaggauuuuuaauaugcaaaauaucaucugcaaauagagacaguuuuguuuauucuuuaauaagcugagcaccuuuuauuucuuuuuuuuguuuuuuugagacggagucucgcucugucgcccaggcuggagugcauggcgccaucucggcucacugcaagcucugccucccagguucacgccauucuccugccucagccucccgaguagcugggacuacaggugcccgccaccacgccuggcuaauuuuuuuuuuuuuguauuuuuagcagagaugggguuucaccauggucuugaucuccugaucucgugaucugcccgccucggccucccaaagugcugggauuagaggcgugagccaccgcgcuggccuauugcuuuuucuuaucugauugcuggaucaguucuuaaucaucuuuaaauucccaaugauuugcacagaauaggugcucaguaacuuuauugaugaacuucgguauuaaaaaucaguuuuuauguaagcugcaguuucuuguauuuaauuuguuuuauucuuuauuuggccucugggcauguugagaaaauaggaagauuugcuugcuuggucuuuaguugcaaaggaaguuaguggaaauguuuuugcauuuguaaauggguuuuagauauuugccuugucuggccacggugcuugguagucacucaggaggcuuagagccaggccucguguguucucugcaaccgcaaacccuuuccaagcugcuguuucugcuggugaguguggcugguguuuugguugcuuucuaucaacauugccuugauuugguccccacaggagacugcucacuucuugacaaaagguaauuauugagauuccugguuuucuucucaccuuguaaauucucuuguuuuuguuuuuuggcaaauaggaaugagguguguuuacuacuggagcaucgggcugucagaacccguagcuuugguuugccuuggucgcagccugccagguugcauacuuuugauuuggaagaggugccgguggguguguucgcuagcaggaaucacccacaguaaaaaucauggguaggagaaauggccguucaccuuuucccaucuuccuuccuuccauugucuacacuccuggucccaccuuuuccuuggggacugggaugcuuaugcuggaaccuaaucaguguccaaagcuuaaaauucuccucuccuccucacuuuuuuccucuuuguuuucucuugacuuucauugccuuggucuauuuccagacccuccaaggccuguguuuucucuuuaaaagauccuguuccauccagaggagacucaagagucccacuuuaauuugggauuuuaggcagaggccuuccugcaucucucaagucacacuugcaagcgacugcuuuggugaugacauuuaaaguuggccuccuuuccuaccacucugacuccccucaauuuucuagaacuggguuuauuguucuauauuuuaaaauugauuuauuaucuucuauagcaauguuggaaggagcuuaauuuuggaagugcacaguucucuuuauggucaaagcgaaguaaaggagauuugauugaucuuaugacaaaauugcuuuagucauagcugauaggaaaucucuuaagggcccuguuuuauuugcucuuuuaauuuaugaaccuucuuggauccuucaagcaucuguauacuaagccaguaaggccuuaucuggaacaugcaggcuucauuuuugccccuaauaugccaugaaaugcuauaggguucugaugcuuuguuagauuuugguguaaauuagggaguaacagugucagcaaauguguauuucagaaauuuguuaauuuuuuuuuccaaaggaaaauguacuauuagcuggaauaaccuggcagccauagggcguacauuagaccuggaaguaaacaaaaugacccccaaugaaguagaaaguaagcuacuauaaauuauagcccauuuuguuucccuguaggucagggccaugucauccucaggcuuccagaaaagaccauguugugaaauaggaacaacagagacccagugcccuacagcuaaggccaaugggagggaggggaagagaggaguuagaccagcuuagaagggugggggcccccuucuacucuggaauccuugcaggucucacuaagccacagcagagcauguuuauugauguuagguuggucauuaagaauagucaaaaucagcguccucugauuuggugcgcugggaugcacguaauccacugaggauaguauccaugaaaauaguuuuugaacuuugcuuuauaaauuuugaugagcuugaguucacugagaaaauuaauuucuguagaacaauuccuucauuuaauguuggcccaaaugaagcauuuaguauggaauuugggccuugguggaauuuucugggacacguagccuaaugugaggacaaccauugcugagcagugcgagggaagggaggauugccuagugagugacuggugccgagcaagaggcuuccugcuugaccucugaauacucuggcgcuuccuuuuuggggucaggaagcuuccaaauccagagaucccccuguuugcaguucuuaguuuuccucugaaacccccacaccagacugagugugccuaggguugggacuagguauuacuucucuuugaaucccaacaugaugccuagcauacauaauucucagaaaauguuuguugauugucaagguccagcuaaucuuguugauuugugauuucauaccuuuuucuuucaaaggauugcuguaugccuggaaauaaauccauuuugguuugcaaaaucaagguugucgugucauccuuugaaacaauuagagaagcaggaaaaucuucuaaggaugaucgaaaucuccacucuauaaaccaucccaauuaauaucugauuucuucuuugaaaaacauaaucauauccuuucuucuguagaaccuucccuaacacuccucauuuaucagaacaaauuucugaauucuugaagcaauuaguuuuugacucacuuuauguguccuuuuuuauccauccaucuguccauuuaucugucucuguccauccauugauccaucuuugggacagaccugggaugucugugcucagaagcagagugcucuacaucugggaagcacaguggucgugcccacagcugucaggcuccuugcaugcugggcugugguccuggcuucucuugucuucuguagagugggagucucaccaaaggagggcaugggagggcuagcuugagucaaggugcguaaguuggaacauugcagaugggguucaggguacccaggguugucccuguuuggucagggcagggucagcaaagcuccagccuguuuuuguaugcaaaaaguguaagcuaaaaaugguguuuaugguuuuuagggguuguaaacaaaaucccagaagaagaugcaacagagaccguguauaugcaaccugcaaagucuaaaauauuuaucaucugcuccuuuauagaaaaaguugucccaagccugguuagagcucugagugaguguggguagaucugucucacagaucuacucugucccagagucugucucagcuaggccagaauacugaguugugaggaaccuuaaagacacuugucuaguggucuguaggacgcauggcccuguuuagacauucugcuugguauggugacccagggaccugcugcugguagaagcagccuuuucuuccccaggaaauguauacuaaaugaaagcaaguacuuucaccuuuuccucuguggucccgauuuuaccucugaggucaugaguaaguccaggugacaggugggucagagcuggauuauggagggcugagcaugucaguuggaaauugauucagaagguuguggggaaauauuaagggcuuuugcguaggggagugacaugagcauagcugggcuuaggaagucuggccuggcaugguuugggauccugggggagauggagcaggcuggaaagguuaggggcagggagaccaauaggaagcauuggccacugccgugggaagugguuguaggggucuggauuagggcauagggaauacaaaggaagggacguauuccagggaaguuaaguggcaacuccucaucuucuaguuugugcugucaccaggguugguugguguguggcuggcacacucaggccggccuucccccuucccuuccuccuuucauagagcaacugcuccauaccaggccguggguucugcggaguuccugccuggaaggcgcccaugagcuggaggaaaggagaaacaaugguucugccagggaggagaugacauuggauaagcuccuugaaggcggagguuguguccugugugcugccucaugcgagcuagucucacccuggggcacguaagaggggcucagaaggucaguuguuugaagucccacagcuggcuggccacguagacgauaaugcuguacaccagaaaucaacauuauaauaaaacucuuaaaaauccaaucuuaucucuacuuuuaaggaaccuaccauuuacaaauaaaagaucacccacuuauuuauucauucagugucuguuuucuguaaagcacacuguauggcuguguacccuuaugcacaguaauugccaaaaugccuauugcagggagcggggucaccucccugaggccaugcagaacucggcaugggucuacuuuccgccccucuugagcuuuuauuuccccaaauaccuuugccucauuucuugaucugaggauguuccauaaugacuucaagggcaccuuccagcuuggggauucuguaauuuuaaaguccagcuugcugaagggcuuugugguaaagggggaguugggaggaagccucacugagguuguccugcucuggaugcuggccucugcacaaagguccuuucaggcugccguggggaggacuguccuaugucacuucuucuucccucuuaagcccuggaggggaggacuugggaaacaggucacagggagccuggaaaaacaaagaacacgccguccguccacucaaaacauuggcaaucuagcaaacggugugcucuucccuggccuaacaucaucggugugugaucucucucccagcacucacccagggaccagaaaggcgggaggucuggagagagauugcagguggcuuccuuggucagucaggaggcauucccuucuccugcaugcuggaggggugcaccaugggccugggauaggcuguugucaguggagcagaggugucgcccagccagaaggguaagggagcucagauccaguccagguguucggguccugcucccuggcgagaaggaaguaugugugagagaguauuucagauccuccucuccuguggcucuggaauccugcucaucugccauccggcgucuccagcccugcugugcuugagaagucuucauuucucacuagcagccuccauuaucuccacuuccuccauuauccccacuuccuacauuuucagggcacuuggccucugcuguacccucagcccccaauccuaagggcaugugcucugugaagugggggacuugggguugugcgccccugugcccugcagugccugacgcaugaguguugugcugacccucccucagugucguucagcagugagccuccucuaaagcaaguucaccauuuacacgguggacuuguuuccuguguuuguguucuuauuuccuaaaaccgaacugcaaacuccugagggcaggaucucuuuuuucuuuuuuuaaaauaagcucucauuuguauuuauacuuggcuauuuucaaacgcuauucgggugggacagggcucaugcacauuuuacagcugagaaacagcaucacagagguuuaacggcucuguaaaauaagauaauugguaaguaguagcccugagacuuuaaccaggaucuuacagcucuuguucaaugaaugaucuuucuguaacccagaaccagcugaguauuugggagguccucaguaaccguuuuauugaguuaaaaaaauauguggguaagguauuugugaguacacgugcauauacaaagauucuaugugcuuagaaacuucuuugaccagccucuucauuugaaaagggauuucaagguucauauaugcauuguuuguugcauguuacuuucuuuggaaaugacuagugaggacagauaacuuagaaauauuugcauguuacaucagaagagaguuaauaguacugguuacuguuaauacuagugguauuagcuguuccagcaaaagguacugcuuauuuauaauaaccagauaauagcagcgagaucggagaggauagucuagauaacauuaugaguguaucuauaauuauaauugaaauggaaugggggugaaucuuuuaauaugagguuuuaagaauucuggaauuuuagugugagacauaauucaugguguaugguugauagggacauacucuuuggccauauaaccuugaagaaguaauaaucuugaauuauuuaucauuggaaugaaucauccuuuugagagaaucauaucuuccuucaguguuaaaaauauacuuaugucaucugucauggugaguauuccaguuacaaugcauauuucuuuuuuucacauccugccuacucacuugguguuauccuugagaagagaaagauuugagaugauggcuaagugguucccagucuuugagucuauaaucacauucccuguuuuuucgcauuccuuuugguugcuauguuuugguauuuggucuuuggucucuuucuuuggggaagagugauuggguggccacaggaggaguaaacccauuugggagcugauaguugauguauuuuuguuaugcuuggcagagugagcggcccccaucuuccugagcagaguucaugugugauauacaaaugaauggucucuuuccaucuggccgucacagaggcaagaaacuguggugccucuggaucauugaauuucucagacucucaagggacagcagaaugcguaugugaacuggcauacccaaaugcaaauuauuucuggugauaccuaauauauguaaauguaugcugcucaguuggccaagaaauuaugaacggcacucuuccuaaauaaugcuauauaacugaaauuuuaguuuuauugucacaauagugaaguguguugauaguccuauuuccugucaaauuucugugacauuuccagcagcuucaagcaccccucacgggccaacuccccagagguggaagauccgguaucucaggagggagugcugccgggcuccauuccgaaagccacaccugccuuguuaccacguagggaucuggcaguugaaggcuaggggcggaaaguggacaaucaggauagagacaggacucggcagagaagcggaguuuuaguacagauguacuaaacaucuguacagauguggagccccccccgcaucaucacacuuaacuucaggaacaaagaaacccaacagauuuaaagauaguagggcauaccugcagggcugguggcggggcagguggccggugcugcuuccaugguggacuucgcaguugcccuggggaugcugaccccuggacuggacuuugcucaguggugcccgccacagugagccucagccccaccucuguugucuucacccuuugaccucacuugagccuggacugagggauuuccccugucgaugaaccaaccugaguacugugcauccagccucucacugagcugggaaccaggggcagcuacaaaggagacaggagaaauagccgucccccuugggcacugcuggccuggcaggagaggcccagcaugugucuagggaggagcggagcgguuguggccagcauugagcuggcugcuuuucuguaggagccugaaucucagucgagccuggaaggacaugcagguguuagggagccaggauugccugcguuaggcacggggcugggcacacagagcacuggagggaauugguugaguaagugauggaguaguugauagcaaagggagacuggagagagcauucugcagggggacaaagugccugagccuaagagggggagacaggcugucuggagaacaugaagcaagugccuggcccuggaggugugugccccuccuguccccuguaaauugugggugggccaggcuguugggggcauuugugggccuggagugaugcugauuucugcagcccuggcgguugucagugugggcugggguagagauguguguuuguguauggagcaaggaagguccuagccuugcucaagagguaaagaagcugcugguugagaacagcuucaugaauucugcaagaagagaugaugauguuugcuucuuuuacauacugcauuaaaggucccagacacuggggcauuugcugaugucaguaaagagggaguccuggauuucuaggcacucacaguuucagaauaaacacauauguaaacagcugauuaccauauggugugauaaaugugucaggauacagaggcaguugcuauuggcaacaccaaaucagucauaaccuucaggagugaacagggcuuguuugcucagggucuggccagggacccagaggaccaguguuggggacccagaggggcugcgugggccugcugccacugcgagccuguguuacaagacugagcagugcagccgugacucuggcaggcgaguuucccaagccgagguuucuggaagccacagccugagcccagggccuggaaccugcaggcaaaaacugugcugagacugauuccccaguggucagccccacagcuggacugcaagcugcuuucccugggcagacucagccuccugcaggaggggugugggagggaaggagcaguaucugugugcagaccuggguucccccagaacugagaugcuggaugaggugccugcauccccugagcugcuuggcgaggaggacgguccauguuuuccaucacagcugggaguaagagcagauaugugcaaggcaaggacguuguuucaccuuuugaaggaagguuguuaggaaaacgccugcauuuucuaaucacuggagaagcccuuuuaagcagaccagauuuauaaggguuuugaugaaaacagugguuugggagcagcaaugucuuuaauagcaacaaagcccagagauggggucugccugcacaggagcaugggccaggggguccugugugaccuuggaggugugugagggaggcccugggcugguuccauggcagggcacaguccagcuucuugcuuccuggcagcacaaaccccugccuguuucuggcggggagaugcugcccaggcucggcugcuuugcgguucuaugucggucacuuuccccaggccacuuccuuccuuuuucuucuuaugccagccugggcaagaggaauuugugcuuccugccagcaggauggaugggggaaaggcaguggcuggguguuucucucugcuggaaggguuugcuggggugaauccuuucccuucacucccuccuguagccaggaccuugucaccuccagggagcaggugacaguuuccuugacuccucaccagguuuucaggcucugcccucuuccucuccccagccaagcuugccucugaccucagccaggaggaacuugcucuagggcuuaagucaggucacaucuaacuuuaagacccaguuuuagcaucugguauggaggcaacagccugggcuuugacagacuuggguuugcgucaugacucgguaccugcuacccguucgcugagaugccagugagcagucgcuggucauguuacauagcugccaccucccggaggccagcucuguugugugugcaugcccauugagaugcccgggugccgccacaccccuagccugcgccugccuguucuuccuccugucagagggcccuguucuugcucauagacuccugcacagcagcgggccugucugucugccuggcccuugggugucccuggcaucugcaugcuguguucccaugguccuucugcuaguuggagcccuugugccaugccuuccuuuggagacucuccucucugugccgucucgcaugccauccuugagguuuuagcucugucaccuggcagccuggcccuucccugcagcaggugaggacugagagcugggcugugccccucccacccacuugacccagcggacacuuugggaaguggcaaccauaagucugccuggcuugcuccaguugcccaucuuguccugugagugaagcuccugcuuccaucucucuugaucuggccccuucucuccauuccuccagcugcagugggugccccugucauuugucagccagagcauucaacagccucugcucccacugaggucauggugauugucuuaaagauuugcucuuuagcuucucagcugaagacacguugguggcuucccugaccuuuuggaaaguaaccagacucuggguccuucuccuuuguugaccuggccccugccucccucccaccccaucucauccaugccuguccucugugucaacacgccucacugcccugcgcccgauccuuuuacacagguggucccucuguuuguagagucgcccugcucuucguaucucccugccuguucugugaaguucagcccagugccccuuccuuggaggccacauuagagggcccuccucugcuggcuuugugcccccguaccccuuucgcagcugacuguccacauuauacugucuguaucuguuauuuacugucugucuuugacaaacuaugaucuuggaagugcagagaacuugucugauuuguuuaaccaccucacuuagcacauaacuugucauauuuuuaauuuauuuucuaucuccccuucuccccauuagaucauaagcuuccugggggcagggauuuuugacucuuacuuagugaugcauccucagcacccagaauugcacuggacacaucauauauguuuaauauguguuuguugaaugaauaaaacugacaggcaacuacagcuuagauugcagggagugagacaugcuguugccggagcucuggugucauugguucauagaaagcuuguuucucuggccauggggacuugauucuuagaggguaaugguucgaaaguugaauuagugaguguaaauccuuaaaaaaguaaaaauauguuugugcccuuguacagaggggcugccuugcccuucuggaagaaggaauuccacguuagacguguucccagcugcaguuuuguucuguaucuauugccagcaggaauccaaggauuuccuuuauuauuuccaaauugcugccucuuaggaauggagaaugcugccagucugugcucuguguuuuuuuugcucagugggaccaaaguaguuuugugguagagagauacagagauacggcuuugagacaguuugagucaucuaauuacuguccaggagggcugggagguuaacccuggugguugcuuuggugauagugaucgaugucugugugacaauuauaaugaaggcugguauuaugccgggacuuugaagagucuaucagauagugaaggaauugcgaagccguacuauguugaggucuccagaauaaacauccucagaauggaagguccagaugagaagguuaccuugaugagaggccuuuaugcuuuuugugcuauuuuccuuuaugggcucugguaguucuuuaguguuuuauaaucucuuuucagagaaagcuuuuuguaaauucuucagauuuuacuuuuuaaguaacacuuacaaaaguuguaugguggcuugggaccaauacacuuugcaggaaaugcagagauggauaagaaaugguucauucccuucaggaccucucguuauagcuuagccuauguagugauuagagcaucugcuuugaagccagcuggaccuggacucagauauagguuuugcuaauugauaccuguguggccaugggcaaauaugcucauuuacucauuuguguuuaacaaacacuuauauugcacuuacugugugccaggcaguaagugcuuaacacauguuaaauggauuuaauccuuacaacaacccuguggcuagguacugucaucauccccauguuuaaagaagaggggagugggcugggcaugguggcucacgccuguaaucccagcacuuugggaggcugggguggguggaucaccugaggucaggaguuugagaccagcuuggccaacacggugaaaccccaucuuuacuaaaaauauaaaaauuagcuggucguggugacaggcaccuguaaucccagcuacucgggaggcugaggcaugagaauugcuugaacccgggaggcggagguugcagugagucaagaucgcaccacugcacuccagccugggugacagagcgaagcuaugucucaaaaaaaaaaaaaaaaaaaaaggaagaggggagugguucacagaggugaagcaauguucccugggucacugagcagagaagucacaaagccugggcacucuggcucgaguucauuuuucuucuugacgcuauuugugcugccucucagcuuccuaagcuugagcuuccuaaacuguaaaaugggaggcagcaauaaccagacugccuagagacaggcuggugugagaauucagugagaaaacccggggagaacauuuagccagagccugucgcauggcuggggcucuggcuaguggagggagaggagacagcacacagauugcaccagaacaagguaauggcggcgcguggccuugcaggggccuugauaauaggaggagcucagaagcagggagagaucacuuccugcuggggcagcugggacauugucaugaaagaccagggaggggacagaugggacaucugggacuucacagccaccuggggaagugggcacuauccccauuguguggauccagaagcugggcuguuucuaaucaguuaaaaugaguagguagagccaaggugaaggaagauggauuuacucaggguucaguugguuggacuguugaauugagcugggggcagguggaauaaagucuggucagccacucuggggccgaugcacaggggcccagccuggagcccacuuccggccuugcgaaugcuucaguggcuuugcauauugucucuuuguucucacucuuuagaaauguucucccacaccuuccuuccaguggauuucuagaaauacccuauuuuucaugacucaccaauugaacacauccuguuuggggaagugauaagagaggaauuugagaauggcauggaguugacuccuaaugaugacuggugcaaggaguagacggcccagccuucugcuugcucugccucucaccugugucuccagacgagcugaauuucuccaagugccguguuucacuguccccgcccgacauaugccaacuggagcuuuuccuguccuguuguaggcggggaucuguguguggcuacagagugacuaaugguagaauuaaucgaguuagagauggggccuguaguuuugaaccugaugaguuagaugaccuuuuggaccacacagauggcuggucguccugugcaccaguguggcagggauggagcuugugccagcugccccgggcagaguuguuuucuuuuuaagagguagccaaggcagccuugccucucaggacccagcccugguggguggcaccccagcccuucccuuuccagggcucugauuuuccucauggcuugcuguuauuucacucgcagaguucagauguuguucauuccagcagaggccggauguguaaaucauccugcagcaguucugucuuguauggccggaggcuccuuggugggcugauuggaaagcccaguacauuagggagugaagggagugaaguaaagagaaauggaggagggagaacuggagcuggggcacgugagcugcugugguagcgugcgggaggcaggggaguucagaccacgucucggggccaggaguggcugacagcugaggugucgggcuggguagggcagagugagccgcauggccuggcagcugugaugggaacauguaagaaguggucaggcugcuguuguuuuagaugucugaacccugaggguagaacucggagaacuugguugguggaugcagccggcaaugccuucccaugaauggcaagggcagugggcuuaggcagauggagcugcuccaccuggcaguuuagccucccaggggacuucuggcaagguccggagucauguuugaucugccaggacuggggacuggggugcugguggcaucugguggguggaggccaggaugcuacuacacaucccacagugcccaggacugcacccaccacaaagaaguaccuugucccaaguguguccgggccugauguugagaaacgcugggucaaaaggcuucaggugaugguggacuuggagggccggucagggagggacaaagggauguccuuggcaccuggacugcuuuggggccccuguuuccugcucuuggugggccugagucucucuguaaguuuugcaguaugaaguugaccuggauguuucauaagcagaggcuuguagguaaucaagugccacgaaguaaagaucauuucgggccacuugaauauauuaaguucgucgacaucuucaaagaguuagauugaaaugcugauccucuuauauuccugacauauucuuauccuugccuguauuauuuuuuucuguuuuuuaaccuguguugugcaguaugccagaugaacuuuuuaggguguauauuuugauaucuuacuuuuaugaagauuaauaaaauuaaaauugucucuguacugauguaaagagcuugaacuuaauuuaguuuuauaauugucuguauaaacauucuuaaugucuaaagaggauuuuuuaccggagaggcaaagggaaauaaaaacuugauaaaauuuaaaaaauuaaaagcaacuguuaucuguuauuguauguauguauguguaggugguuguguguauguaugagagacacagacagugcauuuuacuuuuuuguuuuuuaaagauccugccuuuaaauuuggaacuauaauuauuugucagcacaguuaaauuuuuuuuuucuugcuuuucuuucucuuucuccuuuccuguguuggagcaaaggugcuguguguugucuacuucagguuucuuuuuugagugaaugggacaaggacagggcaauaucugagugucagaaagaucccccccgaggcugguguggguaccaggcagggcugggguacggagacgggcaggcggaccaggcaggggcuagugaaggcaggacgagguccaaguugaggccauggccaaggggaggggaaggcaggaacagcuuggagaaauaggcaagagggacaagucucugaccucuuggcugugcgggcugggaauccaggaaaacacugguuucuggcuugagugaguggaagcuuuuuuaaaaaaagagaguuaaaaaaaaaagcccuguuuuguacacauuuugaugguuaauguugcuuucugacuuuugcuuuucaaaaagugaaaauggaaaaguuuaacagggccucaacuccugaggcuggauuaggacauuucucauuuacauugugacuuuuagaugaaaacauaauugauaccuuugaaaagauuaagaugguucugccuauuuucugaaauuuaggaagcacccacugggucuuuuggucuuuuuuuuuuuuuuuuugacagauucuugcuuuguugcccaggcugggaugcaguggcaugaucucagcucgcugcagccucgaccuccuaggcuccagcaaucuucccaucuuagccucccaaguagcugggacuacagguacaugccaccaugccuggcuaauuacuuuuauuuuuauuuuuuguagagaugagggucucaguauguugcccaggcuggucucaaacuccugggcucaagagauccuccugccucggccccucaaagugcugggauuacaggcaugagccaccgugccuggccugcucugguugaaggcuagauucugagcgaccaggagacugagucuuuucuugcucaccugguggaguacauuguauacaguaggugcccauguuucuucuuuugauuugcagagcaguugucuugaggaaaaccagugagaugaucccaucucuucccaugauuuugagaguaugaucucugucccaauucagaagagcccugaggugagguaaagauguuagaggugaguggcauucugugucugaccuguggcuccaguguguggauccgugggcuggcgugucucacauguguggacugggguuucccucuuccacagggagguggucagugugugggaggagccauggcucuggccuccgacugcugggguuugaauuuagggugagcacuuacuaacacuguuagcugacccgcuaccuacugaucuucacacggaugagcuuauugauggugcacacagaugacagguuuagauuguaugcugguuccuuguauuuguucuguuuuuaaaaccucagcuccucuagucuuugguagacacucuuauguuauaucuugggcaacuuaguuccucuuucuggagccucaguuuccccaucuguaacaccagagagcuggacuuaggggaaccgcuugauauuugacaauacuccaggcuuuuguaaacaaauuguccacagcuuugcugagcuacagccacauccgcuugaaaaagcauugucuuaccagccugugcagaauccagaucacuuucauccaccuucccaugggggcugcuccaucccuugucuuacuggaaaugucuuucucaagggucuuuucugguguacaggucucccuggagauggaaaaccauagcacugguuuaaguacaguguuuuguuugcauggggaggagaggcugaggcaacagccugugaguucaggaguaauaagguguuuguuucccuuuuuggccaguuuuuuuuugguggcauaauuuacauacaaugaaauuuacccuaagaguacacuuugaugaaucuuacaaauguacaguuguguaauccccaccauuaugaccuaaaacaccccgaaagcuucccucuugcuaaccugacugacuuggugguucugguggcuuuuuuguagauugccuggcauuucuacauagaugauuuugucuucugugaacgcuguuugccuccuuccuuccugaucuguuugccugcuccugcuuucucuugcuguacuguguucccugggccucccgcagccuggagggguagagaaagaguggccuccugcccaucccucccagccccucucugucccguggcguuagcagcaagcgcuuuguagcugccuguuaguggguugccuucuguuccuaguuugcugguuuuuuugucaugaauggguguuuaauuucaucagaugcuuuuuccgcacugacugagaugaccauaugguuucccuuuuuuagcuuguuaguguggugaauuacauuuuuaacacugcaacuacucuuugguguggaagccuuaugugugggguaagcacagauuuggugucaucauguugggauuugaggauuagcuguucugcacuucauaaggauauaguacauucaguuauugacagcagcuaggcuguguagucacuccuguggggcugauuuguuuaauuaugauuguugaccuuuuuacucuuucauuauauuuuggguagaaugaaaucauguguguggugauggagggguggugguggggggagauaauaacaaacucuucuguagccugaacucauuacuucuuauaacccauagguguagguaccauuuucuuuauuuuaugaaugagaaaauugagguccagcuucuuggaagguaagagaaaugagucccauuuccccuaauauuaaccgagcaccauuuaugugccggccauuuggacccaucuaaggggcacaaaaccauuguuuuuuguuguugucguuguuguugaaaccacuguaauggcagcaucuuuuuuuuuuuguuuuagaugaggccucacugugucgcccaggcuggucaguggaguggucacggcucacugcagccuuggccuuucugggcucaagugauccacccaccucagccucuugaguagcuuggacuccaggugcacaccaccaugccccaguaauuuuuuuguagagaugaguuuuugucauguuuaagugacuuucccaaggccuuguagcugguaagaaggaggucuucuguuucuaaguugaauucuuuucccuguccugcuacuuuuggggugguuuauggaaagaaauuaagucagggugaaaaaacuagucaacuucuuagagcaauguagauaagauuuucacaguugaucuucacagacuuaucuaaauacugaagccccauuaucccugggggguauguuccaagacccucgguggaugccugcagccagcuaauauugaacuaguuugccuucaaucacgacaugucucuguucaugucaugucuuccucccauaauuuuuuuuuuuuuuuuuuuuuuauuugagacagggucucacucugucacccaggcuggagugcaguggcgccaucacggcucacugcagccaccauuuccugggcccaggugauccucccacauccaccuccccgguagcugggaucacaggcaugcaccaccaugccaagcuaauuuuuuguagagaugggguuucuccauguuucccaggcuggucucaaacuccuggacuggagcgauucaccugccuuggccucccagagugcugagguuucaggugugagccaccgugcccagccccucccaaaaguuaaugauuuuuccaucauaacuaagcacuugccacgcaccacggccguagcuuuugcaguuugagaugugaaggcaaagcuagcaugaguuuauuuuuuucuucuuuaccauuucaugaauagaagacccacuuuucccuuagaucuuagcaaccucagcauaggaauuuuuccuuaagucaaggaguuucaucuuuuuacuuaaaggaagugcuguaugauuucuccuuggcauaucugcauuaccagcaucuaggguucuugugcucugggaccauuauuauguaaaaaauaaggguuacuugaacacaggcucugcaauacugggacaaucaucucauaaccuaggcagcuacuaggugacucaugggcagguagcauggaccuugugguucugccagacaaagggaggagucacgucccgcgugggaggcaggacggugugagauuucaucucuugacauagaacagcaagcaauuuaaaaguuaugaauugcuuauuucuggacuuuucuguggaauauuuuuggacugugguuaguggaaacuguggaaaaugaaacuguggauaagaggguaguacuguaucuggaugaguccaaaaacacauucuaagaugaaauauuauuagcucacauauuuaucuuuuaggauacaaucuuucuuaauuuagcaugugugcuggaagauauuuugucaguauuaaguaaugcugcagaauuuugguugaacuguugugcauguagaacauuaauucuuuguuuuccugauaguuuuuggugagagguuuucugggaagucauuguccuauuaccacuuugcaugcuaaacuggugcgauuaugaguuccuuauccauaucaggguuggggauguacauacauacaugaaaaucaaacuggcugggugugguggcucaugccuauaaucccagcacacugggaggccaaagaagcaggaggaucacuugagcccaggaguucgagaccagccugggaaacauggcgaaaccccaucuuuuacccaggcaugguggcgccgugaucgcaccacugcacuccagccuggagucucaaaccaggcucaaacaacaacaaaaaacuaauugcuuuaaguaaauguucaugccucaccaaagauauguacuguaauuuuccuauuguggauauguauauuuucaacuccuccaacauuagugaguauaugccagacacugugcuaagucaaggaaagcgaggagaaggaaagggauggcauuuugaucuggaccugaaagguugaaucuaauaagugagaagagaacucaggaccuggcagguggaggauuacaugguugcacauguuagggucccaauaaguuuaggggagcauguuagacagauuaagaacuuuguuaucaggcggacacaugugaauuucacaccugguuuuacuacuugguaacuguacuucugggcaaguugguuagcuucuucgagcacuaguuuccucaugugaagcaaggaggagaaggcauaacauguaccucacaggcguucguuguguuugcuaucuuggaagagaggggggaggucugugcucugugcuggaaugaaacuuuuuuuuuauuuggccagacagugaugguaggcauucuuuggaccgugaucuuaggggcgcaugcuuuggcgguuuacagauagagaucugaccugguccaugggaagugcagauucaguuccuugcugacacugucaggagcucuuccaucaccuagccuugugccagcacacugguggugcuugguaaauguuuguugaauaagugcacuaagguuucacuguaaccucuagugaucugcuucuagaagccuuuucuucugguagggucacaccuagaggaauuggaugcuacaaacugugauagacccaguaccauacucuagcugcugugucuagcuugacagggaugggcacuugcggugcccucagccuggcuugaaguugacaucuuguauugggcggugugugggcucuguucccugagucuucauccugaaacugcuggggcugauagcuggucgcgggaucaccuuucaaaggaacgcaguccagaggccuuugcuuccucaggauggauucaaggagagaauccucagcugaucaucauuuuaucccauuuuuucuguuuccuuuacuguuccaacuuuucuuucuuuucucaccuccuuuauggaggaaaauugccgucuggggaagcaugaugcuggggaaguagguuuugauuguccgaugauugucaggugagacuauuacacguguucagaccauuggguguaagacauuggugcacauuagcuccugcuuugauauaacugaggcccaguaacaacaaauuuuugcucaaaaaaagaggcauaagcagcguugugugcuuucuuuauuuuggccuacccugcaugauggcuuuaaguauuaucgggagaagaagcauacggauuaacaaagauguguacuucacuuuccaagaacaggaauguuuugcccuagugagccuugaagauuuuuuguuuuguuuuguuuuguuuuuuugagacggagucuugcucugucgcccaggcuggagugcaguggcacaaccucagcucacugcaagcuccgccucccggguucacgccauucuccugccucagccucccaaguagcugggacuacaggcacccgccaccacgcccagcuaauuuuuuguauuuuuaguagagaugggguuucacuguguuagccaggauggucucgaucuccugaccucgugauccacccaccucggccucgcaaagugcugggauuacaggcaugagccaccgugcccggccuaaagauuuuuuuuauaaugugcauuuuuguccauagauuacaaucacuguuguuuaggaacucagacggaaaaugugacugagucagagaaguaacuguuaaaauacaacuuugcuuacaauaucugcuuucuguacgucaggcagaugaauuguauuaaaauacuuccuaggucuaguuugguggaaaccaaagauauaacuguauuugcagggagauuggagaaugagauagcguuuccacuuacagaagcuuguuuuaucuuaccuagauuaaguugaggcagaaugcauguauaaccagggcauucugguacguagucacucauucaucugcucauuuauucaguagcacuuugcuuauuuacuaugcuaguugcugaggauucuaaauaugggccuuccaggacucacaguuuaguugugagggaccgauauaaguaauuaggaaauaguguaguaaaaauagccagcaauuuuuguucccuccccagaauaaaugugcuguguguguguuaguuuuuaugaaauauguauaugaaguuuucuuuugggaauuagugggaacaugauauguauauaaacucaucauuaaaauaauuugaauaucagcugggcacguuggcucauaacgauaaucccagcacuuugggaggccgaggugggcggccuauaauccuagcacuuugggagaccagucugggcaacauggugaaaccccuucucuaccaaaaaaaccccacaaaaauuugguggcacgcaccuguggucugagcuacuggggaggcugaggugaaauaaucacuugaacccgggagguggagguugcagugagccaagaucgcgccacugcacuccagccuaugugacagagugagacccugucucaaaacaacaacaauaaaaagaauuugaauauguucagacuuuccaccauacaguaccuuagcaagguacacugagauuaggaauaaguuaaaaugcuugucuuuggaagauuaaguggauguuaaucuaagcaaaguggauucuguaaaacccugaaagaaguuuuugaguuucacggugugaacagaacagagaacccuugaugagaacacaugcguagcuccuagcacagagugugcgacacaguuaauguccacgggaagagcuugacacaaacuuaaauaccaaacuuaguucagaagcacuucgcauuaagcuccugugccucaguggccuggcacuuacuggacugaaggacagaaucacuaaccugggcuuuuacuaccauugcagcccagugccagugacacuuagggacucuucccugagcaccuucccagguacccagaaguguuuguaggaagaacaggagauggauuuaauguggauuuauuuacaguauaugagaauacaugaugugaaggcaaacccuuuucauuagauccuuucugaggcaucauaaaaaucaugguuuuaugguuuuuaugauuugagucuaagaaaacuuaguuacuuagccuuucugcggagaauaauugcuuauuugacagggugacacgauggugugugagcucaguugcuuuuagccagcacuacuugaaguccucccgucauauaaaagguaaaagucugaaucaugcaggccuagguuugguugugaacuuuuaccucuuacugguaguguggccuugggcaagucacuuugauacccacuuuguaggacugcgguaagaauaauauuguuauuaauagagauuccaggaacuuguagcuugauuuuggaugcagagagcugggcuccucccacacaggagcuucugguuugagaaccacagcuagcaauggcuuuguugaggaggguguuggugugacuaucgaauugucagugccaguguguugcugccguggcuguugcauuugaaugggcucuggagacaccuggggugggugggggcugccugacacggagccagccugccuggccacuucuucggcucugugcuuacuugggggcauucacugugcuagguguggaggguucuauaaaaacaaacccuaaaagauuagucauacauuuacuguuggucauuucucaaagugaugacguuaccuucuguaaccuacacuuaguuucugagucuuuuugguguguguugcucgaauaucacuauacaucuuccugacuucugaaucuaaaagagcaccacucuuucucuuuguuucuucagucagaaaauaccuacugggugcuggugcugcguuugugaacagagcacacagaaaucugggccugggggcgcuugcaggauucugcuugcuuuccuuccucccgucucugcagucugacgcugugugccaugcauuagucgguucgucgucugccuccacuagagugucauggaugcuccugggggacagagccuuuguuuucuucgccaccagauccccagugcccagagcagugccugggacagaacuuguucucaauaaauaguuuguuauuguuguuguggggcuuggaugcaagaggagugagccccacauuugauuauauaauaauuaaaaccuuaaaaacaagcauacgauggggauggcuaucuaaguuuagaagguucugugaaaaggacaggaggguggugugaccccguugggggaaggagcucuguguugacuggcaggagcccugguuugggaguguuggcuuuaucccugaucagcugcuugacuucaggcaacucuuuacauuugagugaaaaaaugaauggggauucucuguaugguuucuccaaacccguacuccuuagacauuuaaaacagguggacggaaccaacuuuucauuucaccugacuucucaguaaccacuuauuacacugagcaaacuagugugaaaauuuuauuuuauuuuuaaauuuuuuacagacagggucuugcucuguuaccuagacuggagugcagaucauggcccacugcagccucgaccuccuggacucagugauccuccugccuuguucucccaaguagcuggagcuacaggugugcgcuaacaugccuggcuaauuuuuuaaaacaauuuuuuguagagacggaguaucaccauauugcccagacugguuuugaacuccugggcucaaacaaucagccuuggccucccaugccaggauuacaggcaugagccaccacgcccagccccaccugugugaaaauuguaaucauucaccugugcauaaaguugcauccugcauucagaauaaagagaaccgugagaggucuucaauuuagucaucuuuacuacaacuuucuuuccuuuuuuccuuaaugcucuugaucuuucuugucacaucuaaaugguuuaauccauuguggcucgaugugggagaggcucauuccugggauacuccuggcuucuacacaagccuguguacugcugcauguggagaaauuguccagguuuuuuguuuuguuugagacagagucuugcuccaucaucaggcuggagugcaguggcaugaucuuggcucacugcagccuugaccuccuggacucaagcuauccuccuacuucagccucccauguagcuggggccacgguauauacuaccacacccagcugauuuuuuaauguuuuuguagagauggggucuguguuguccaggauggccuugaacuccugggcucaugcagucugccugccuuagccucuaaaaugcugggauuauaggugugagccacuguggccagccuguccaguaauauuuuuaauugaggagaaaggucuucuuccugacagcagucugucugcucgugaguuuugacggcacaagcugcauggaucugguauugggguggcagcagcuggaaauccuaaugaggaugaacucuucgcuccucaauuaaggagacugacuugcccuucaccagaggcugcugucuuggaacugcucccaguccgcagaugccuagggagucccagacgguccccgguccucauuugcacgaggcgaaucaguuuagcaauuugccugccuaauaggauauugcccucauggaccuuauuaccucaugcgcugcuuucgguccaucgucuagcuuuuugauuugagugcuucuguggauuugcucgcugcgucuguuauuauagaaggguuuuuaaggcagccauguggaugggcaguggguuccaggguucagauccuaccucugcugcucacuagcucagaugucuuugguccucagauuccucauucugaaauuugggaaugauacucagucauuaauuaagugaaacagcguuuagaaagcgccuaggcuggugccagacgcggaguagguguucagugaaugcagaagcuauuucuguuauuuuuugcacuugcuaacaguuccuauccuuagauagucucugucuuuaaacuucaugugccucggguuuaaaaucugcugcuaaacucagcugauccaggaaacugccacuuuuuggcccuauuucccgcucuccuccucugccccccacacugauaaccucuuuaugauguauccucccagcucucaggcauaauuaugcuccacuuauccagaggucagacuuuuagcaaccucugccaucuggaacauguccaggaacuggaagucaacagaaaaggccuuggagcucagcuguccucgagucugggacagacgcuagguggagaagggguggcugauggaaggggggcggcugacagcagcaagagauggcaggugacccagaagacgaacucagcagagcagggccaucagugugguggccagcaguucugcaucccacgcuaaccacggaggccacgcaggccuguguuccgagugggaaucuuuggugcucccaacaauacugaguauuuaagccaaauuauauucagcauuuguuaauaaaagaggaaaauacaaaaucuguuuuauaaccaagaugguuuuuagaaaacccuuugguaucuuggugucauuuuuuuuuuucuucuggguaauuaguguauguguagcucuuuauuuuucaagcauggggaaaaugccagcguagagaggauagaacacgggcuuuggagucgcaguccagggugugccucuuguuuauucugccaccuccuugcuaguugaccccagugagagucagcguuuugggucucgguuucuuccucuguaaaaccucagagguguguucagaauaaacacaccuagaacuaggcaagacgcugacggugaggucuuagauacccaggcccuggcugggcaugggaauucacugcuucuacuguuuacucugcuuguaacuuucacuccuaucuaccagccauuugguaaauuuccuuacaccauuugacauguagguuguauauuucaauuagauggcaguucuuuauggccagggacccugucccugaaccuaguuuuuuagugucucugaagucuuccugaugucgacucugaugugagcucaguguuagguggcaacgaggcuggcucugugucuaccugucauggaagcucuccauguccccaaauccagaaggagguaauuuguguaaaauaaugcuguccuuuaacuugcguaaauuccucccaacccgaauacauaggaugcuagaauuuuaggucuagaggagauuuuauuuuagcauucuccuggacaaauugcauguuuuguggcugggcugggcauguaggggcugagaggcugucuuguggcugaggccacacagccagucugugguggagcuaggcuggcccucuuggggccuccuuagcuccaguuucuuuccucugucagacagcaauggccucaugucuuguucuuccugcugcgagcuuuagccucaaacuccaccuugaauguggagugaacuuggagugaacuuugucuguggcucagccugcccguggccugucugucugccccauucugcccucacgucucuagagaggacagcaaugccuuccccauauauguucauuucucugaugauuguagugucuaauggguuucauucugaugaacuugagccccucacuugggcuuguucuuugcucugauggggaguaauuugagggacucucaugacgccaugccugcuccagacaaccccuaggagcuugcaaagauugcccuguaggaggaauugcugauguccugugaauaauuccugggaaggaaaugccaggcugacccaucacauagacugcauagccaugacuuagcaggguggagcacccacacugucguguggacagaaaguucacagccugagugagacugggcgcugggcugagauugcuggcacgggucuccuggagcugcaggcaggcaugcccgggcuggcgggggagcugcaugcacugccacccccagaggagggcagggccguguggggauacugcagaggaugaccgaggggcaugauuagagagaggcuacccugaaaacacucugcuaggcuuccagauuuuuguuuugggcugguccugcucaggaucugugagaaguauguaggaacauugggccaccgucuccugcccaucaaaaggcuacaugccauguggaaggaaggcagggcuuggggucaaaucuggguauacaacucuucccuucuuuccauuuucuuacuuggaauauuuacuuacucacuugaguuucaguuuuaucaucuguaacaugaggaaaauaauaccuaccucaauugcuuuguaggguuucauaaagcuaaaauaauacccaugaucuccuugggggcagaaacugccaggaucauuuuuagcauuuaacacgcugccugacacaaaguggucauguaacauuuguuggauaaaacuccacaaacuguaaggaauguuacacacaugguaauuauuacuaauaauucagcaaaugguauuuaaccacagacuuccugccuaggcaccagggaaagaggggaaagaacacgacaugugaauacacagcugucccuagggcuccuggaguucucgcggugccccaggugccaugcaugacuuuaaagaugggaguggggaugcaggaugccagacauguggcccuugggugggaauugggaccccagaucuuuaaucacuuaagccuugggagguguaaaaguguuuucccauuccacagaggguacaaaaggauacagggcacauugcacggcccccagggcaaaugcaguguggugugcucuuucauuuaagccgaggccacaaguaacuaucggacaagguuggaagcagaaagcagugagcacccagagaggaacaggaguaggcuguggagcucaggagcucugaaucagagccaggguggagcggaggugucucagccccugagauguugcagucuuccuguuaaucugccuuguggaauuaagcuauaccugcgggguccuagggaugugauucagcacaggccaccaugggccaucugugagcaaagugcugagcccaccaugguggaaauacagaaauagacaagacucggggcuugcucccggggaacuuaaaacagugaacuaugaaacgaggcguggugaaagucaauuucuuacagagauaagaugggaacccggagugggcaggcucaccaaggagguggcauuuggguggaucuugaaaggucuguagaguuugaauuggagacagauuagaggugagaaaacacacugagguguggaaacccacagguucuucagggaauaaguggacgggaguggagcguggagggcugguaaacagaucgcgaaggagauuuugaaaggaggaacguggccagagcguugucacaucaggaguuuaguccgcaaguagaggugggcccuguggcuuucccucuagucacuugucuuacagagaaggggacugagguugugaggguggggcuggcauuugacuucgucccacuccuucccaucuucugggcuccaucugcuugguacucacguguaacagccuuaggggaccugcccucccugugggggcccagaccuggggaaucugguugagucuggcugcucagugggucugggcgcaaagcauguggagaaauugagaagcucgaagcagaacagcuaaucccugauguccgucggguggguuuuguaugcuuaauaaguaaagauaacgugcauuuuacacuuuacuaaaacgcauuaccucaucugacuuuccuuuucccuccaucccagcuggugaguuggggacucagugacccuugggagaaggggaagggagcagcuggggggcgcaccuuguugaauucauggggucuuuccuggggaccuucgguuuugugaugaggaaguggaguggcuggaggacaucagcguggcaaauggaaugccuucaggaaugacgcaaggggaagguggcuguggcugagggugaggaacagcugccaggaaggaagacugaaugugaguuuucuggcagugauggauggagcagagaugggccugaggccacugacagggagcuuuaggaaugagaagccugugcccacauugcuuuuuuuuuucuuuccuuaauuuuuuuuuuuuaauuaucaucuguagcucauugaauuuaguucaucaguuauuugaaauaaaucagauguacuugggaaguacuggccaguagguguuagaguguuagccuguacaaaaccuucccucugggaaaugcuggaaggagagccuucgugucacaaaagccguuaacacacacugugaggugccuuggagagaggucacucaggccagggagggcaggcgugccugacaccagcugcuaggacugcauuggagugaggccacucagccuugaaggucaaagagcagaugacaacugagaguaauugaugaaccagggacuguaggaagagucauuuuaaauaaggccuuuggggcugugcgcaguggcucuugccuguaaucccagcacuuugagaggucgagauggguggaucacuuuuggccaggaguucaagaccaggcugggcaacauagcaaaaccccaucuuuacuaaaaauacagaaaauuagcugggcaugguggcacacgcccagcuacucaggaggcuacggcaggagaaucgcuuaaacccaggagguggagguugcagugugcugagaucacaccacugcauuccagccugggcgacaaagugagacccuauuccccuaacacccccgccccccaaaaaaagccuucggaagacaguuaaagaauuuaggaacacggccgggugcaguggcucacgccuguaaucccagcacuuagggagguugaggcgggcagaucacgaggucaggagaucgagaccauccuggcuaacacggugaaacccugucucuacuaaaaauacaaaaaaauuagccaggcgugguggcgggcgccuguaaucccagcuacucgggaggcugaggcaggagaauggcaugaacccaggaggcggagcuugcagugagccgagaucgcgccacugcacuccagccucgcgacaaagcgagacuccgucucaaaaaaaaaaaaaaaaagaauuuaggaacacaagcagauagugcgugggcccaaucacugguccuacaccaagcaucuugacuauuuaguuguucacugcagcccucaaaagcugcccgugcaucccuaagcccaagccaaucccgaggcaacaaagaaacgaaagucguuuuuuguuguuuuuuaaaaaguuuuuaaagucagcugaauugaggucuacucugcaaacaauaaaauucaccaguuuuuguuuuuguuucuguuuuuuuaaacaguuucacucuugucacccaggcuggagugcaauggcgcgauauuggcucacugcaaccucugcuuccuggguucaagcgauucucgugcgucagccuccugaguagcugggauuacaggugcccgccaccacaccuggcuaauuuuuguauuuuuaguagagacagagauucaccauguuggccaggcuggucuccaacuccugaccucaggugauccgcccgcguuggcuucccaaagugcuaggauuacaggcaugaaccacugugcccggccaaaauucacguuuuaaaugugcaguuuaguggguuuugugaaaucgucuaagcacccuacagauguaacguagcagagugccgucacgcagaacuccccucuucaguugguucccccauuccugccuccugucaucucugcgcugcuuucuguccuuacaauuuugccuuucuuagaauuccguauaaauggaaugauaggguauguaaccuuuuguguaugauugcuuuugcuugaccuagugcccuggagauuacaauguuacauguaucuuuagaccacuccuuugcauugcugaauaauguucuguuguauggauacagaguaaguucccccuuagcugcauuuuacucuccaagguuucaguuaccugaagucaucccagguccgaaaauaguacauacaacgagauauuuugagaaagagaccacauucacauaacuuuuauuacaguauauuguuggccgggcacgguggcucaugucuguaaucccagcacuuugggagggcgagguggguggaucacaagguugggaguucgagaccagccuggccaauauagugaaaccccgucucuacuaaaaauacaaaaauuagccgggcgugguggcacguuccuguagucccaguuacucaggaggcugaggcaggagaauugcuugaagccaggaggcagaggcugcagugagcagagauugcaccacugcacugcacuccagccuggggaacagagggagacugucucaaaaaaaaaaaaaaaaaaaaaaaaaaaaauauauauauauauauauacacguguguguguaugcauauauauaguauauuguuauaauuauucuauuagucauuguuguuaauccuaauuaaugugccuaauuuauaaacuaaacuuuuuuuuuuuuuuuuggaggcagagucuuacucuguugccuaggcuggagugcaguggcaucaucccagcucauugcaaccucugucucccggguucaagcaauucuccugccucagccucccaaguagcugggauuacaggcaugcaccacuacccccagcuaauuuuuggauuuuuuuuuuuuuuuuuuuuuuuuuuaguagagacgggguuuuaccauguuggucaggcuggucucgaacuccugaccccaagugaucuacccaccucagccucccaaagugcugggauuacagguuugagccaccguccccggccuauaaacuaaacuuuaucagagguauguguguauagaaaaaaaaaacccaguauauacaggauuugguacugucugguuucaggcauccacugggagucuuggaauguauucccugaagauaagcgguacuacuuguuaucaguucaccaagugaugggcauuuggguucuuuccaguuuuuggcuauuauggauaaagcuucuaugaacauuugacuacaagucuuuguguagguagacacguuuuauauuuugacuucgggaaauaccugagagugcaauugccguguugugugcuaaguguguguuuaacuuuaucaaaugcugccaucccauuuuccaaaguggcugcaucauuuuucauuuccacuaaccacguaugagaguuccaguuccuucacuuccucaucggugcuuggcauuaucagccauuuuacuggguguguaauggaaucuuauugugguuuaauuuauauuucccugguaacuaaugaaaccagaaucuuggccauuguguaucuucuuugauguuaugugucuauacuuguaccauguaaguugguucucagaucauacaaugcaucaugagaguagagauucuaaugaguauugaaugucucuuaccugaagggcuguucaggagaaauggacuauuuaaguaacaauaaucugaaacaagauucugaaagaugugcucuguggaauaauauugcacauauuccuagaagcugggauaaaucauucacacagaaaaaacuggaaggaucuagcaauuuacuuaaauucuccuauggaauuuuaaaaagauggccucauauugccuuguuacuauggaaugguugauuugauguaaaugcacacugcagcuuaaugaaguagccucucugguucuguguguccuugccguggauucggcagauggugucgucagagauuauggaguucaagccaccuagcuuuacagaggugaagggaggugccugaguugaugaagggagucgggggcagagcuggugccagcaccauguggugcuccagagguucuucaggggucugcuugaccuguauugcuuuuaucuuuaaaauuuccaacaguuguuaaaaaguuuucugaaaagauuuauacucugauguuugcaucacauagcagggaggugaucucaccagaacauuuugaagucuugguaaacauugggcuggggggcacaagaucgucugauuuauuuguaugcguauugguagguagcaugcuaggcauugagggacuuaagaacugggguuuauaagcagguuauaaacuacaguaccuccagugaucuggcucuauagcuuaguuguuuuuaaugcccuguuuugaugaaggaaccuguguagacuuaaaguuguagaaugaccagugcgucacuauauuuucccuagucauugacauauuugcacguucagacauucauagaaauggcaggagaaaaacuauucuaggguccccugcaaaaaaaaaaaaaaaaaaagaaagcaaguaauucuggcagcccaauuaauucauuuaaugaauauuuauugagugccaaccaugugccagcuuggggugaugaagauaaaaaauuagcaugucagugggcgccaggauguuaaaaguuggaguuuagcacgaggguguauaugcaugugcugccuucacuuaaaugucaggcaaagcggcagugucaacuguacauaaagaaauuagcguuuaacaugcugugccaaugaugaugcuguccaugggcugagcagucaauauauguuucagaugcuucuugucuaacauaucugagauaaggacugcaaggagauauuagauguuguuagugguagagaguugaaacaaauuucuuacuauuccaaagcuuuuggauuuuguuuuuaaaaaagaauguggccaucuguuucuauuuacaugugcaaaucagaauugucucugucuuguguaacuggaagaguauugaaaugaaagugcaggccacuggcauccaacugccaauuucaaaugaaugaaaacagccucaguguucucauugauuccauuuuggggaugugaugguaugcauuugagcaauuuguauuccagcaagagaccuuuuuaauccauuuccucugugugacagaggaguuggguuuuaaaaaagcacugaccgagagucaguaugacugucucuuagccgcuuguccuguccacccucaguccuuguuccucuccuuccugauccuccugcugcagccaagggcugggagggggcagcacagcugauggacucauuccaaguccuuggcuggagugccuccugccugcuaacagccugucacuuucuucaggaugugccuguguuaccugcuccagggugucuuucccuaacagccugucacagggcguuugguagaaacuaaagagcagcagaggaugguuucauucauuccauguucguggaguguuuacacgugucgggcauuccacuggugcuggagauucaaaaaucagaaggugcgggcccccauccugaaggagugacaguuuguccuuguuccuuaggguucagcuaaugaaaagucucaauugccuugggaaauuugaagucugaaagcagggacuguuuuauaguagucucaaacagugguaggaaggauauaccuacuuaguaagcauuauggaaugaccauaggugccuaaaacuuuucccugcaaaauuaaaauagcuuuauuuucuugguuuauuguuucuuaacuuuuuaacaggagauuaccuugaacaaacuaaugaaccaguacaugaugucggaaagaacaggcuaggagaaugugaaagugugguuguuuuguuuuguuuuugagacaagguuucucucugucacucaggcuggagugcaguggcacgaucuccauucacgucaaccuucguuucccagguucaagcuauucuccugccucagccucccgaguagcugggaguacaaacucacgccaccaugcccggcuaauuuuuuuguauuuuugguagagaugggguuucaccacguuggcuaggcuggucuugaucuccuugugaccucaagugauccgcccgccucggccucccaaagugcugggauuacagaugugagccacggugccuggccugaaagugguuuuuaagcaaaaaaagagaauacaaagguggcauuuugguuuauccuuaccuauguggccuuggaaaaauaccuuugugaguguuacuuucuauguuguugcaauaauauugccuguguuaccaacugcccagguuggagagucaugugccauaaucugugugaaagcacuuuuagaagugcugugcaguuggaagccuguuauuacugcuacccccacaaccagugcugguaucaucacauuuguacccugacuuugggguaggauauacggacauacacauuucauuucuuuccaucuauuuugagaaaucuaagccagggaaaugcaguggaauucuucauuaaaaauuaccuuuggccaggugugggggcucacgccuggcugggugacagagcgauacuucaucucaaaaaaaaaaaaaaauuucuaugauuaccagcuauuuauuuguaaaguugaaauaaaugcuauucacaguauugauaguaaucaguaguuguuuuuuuuuuuuuuuuuugagacuuuuggucaggagucuuacuuuccuuuaaaaaauaccucacauauguuugaauguaauuguaagauuuccuucuuggaaagauaacuaaaaugcaagcuguuuuaaaggugguacuuucauagaauuuuguaucuagaagcucagaggagaaguggcucaccuaaggccccaauccgaguaggugacagucuccauggugcccccgccgccacacucaucuucucauuuugcacaaugcaugauuuucaguccccacaacaaaugcaaaccuucccggguccuggggcaguguggcuugagcaggcgaaacccccggaagcugcugacucucuuguggcuguugcaacuucuuuagaucucuugaggaacaguaaauauuccacagaucagcuucagagcagacagcauucuggcugagaaacagaugaucuucacuuuuacuuauuuauuucucucgcucucucuccucuucacuucucaaacuaaacauagcagcauuacauguagucuuugcuuuuaggacucagcauuuuagagucuguagguccaugcuccugauuacagacuggggucugcagcccuccagugauauuccucggauugcagccaguuucgcggggccagaccaggacccugggccugcucuucggccuuucucuguggugucugcaggccugacuguccccuuagcagggaagggaauugcucugggccgugguccagcccgugggacggagguucagccucuuccccuuacuugcugcugcccagggagcccuuccccucgcuuccucucuuguucuguuagcugggguuucaaauuuucuuuucuuuggauggaaaacaaacaaagaaaguaaaacuaaugggcugaagcccuuccuuggggagaaacauucaucccucaacgcugagaauaaauggccuuugcugacccuagcagcacagccaagggccgccaucccugccuguugcugcacuuccccucccuucugcgccauccugcaguggcagggacccugcccuuccuugcgucugcccccgcuuccugcgcccugcucuccugccaggcugcccaggcuggggugccccucucugcaggcucccaccccucagccuggcuuguaccucucaaguccuccucuuguacuccugcucccugguagguggaugcuaucagagggcacaguuuucagcccaaaaccuuaaggaacaaaaaugaacagcaccaucugcaucucuuuggcccucgccucugucuccaccuugcuccuuggcgcucucaggcccccugccccgaggcuggaccgcuguugggaguguggcaccaguggguggacugcuuuccauugagggcagcagaacccagccuuguguguguguuuuagcgcagagaucuucagaugaacucaucugaggccgacaggcaaaguagcccugcacaucuggggccagggauggaggccgaugcuaaaugccccccaugucuccucagcucccuugcacccugaugagccccugcaguguccugcauaguccuugggcuaaguggagccgaguauggaacccaggucuaaaauugggaauggcuguccagugucugcgcaucgcccccuccccuaucugggaaacucugugguugaggaaccccacuuacaaggccccaggcaggcuggccucuccccgagucaggcaccagucugauggccugauggcucugcuauggaggugggaggggaaagguccuccaccaaccuggggacucuccaacugucaaggcaacaaucacuguauugaguagcuauuacugcccgcauuuuaaggauaggaacacugaggcccaggugaucaaguaauuuguguguggagaugugggaaugaaagcucauggucuucaucuguagcagugacucccgcaguaagccugggucaugaggaugaggugggauccagaaucugcugcugggggcgggaaggaugccuggcugaucccugugcaccuucgggcccucccucagcucauucccccucucccaucaccucacugcuuggauuguagaaaaaugaaagguucaugccuagagaugaccaauuuugggguaggagcugcggguggagcggggcccaugaccucugugugggagaagcuggagaggggcacggggcuggccaggcucuaaaaggcacaugaccuuguuugcaucgucacacuccuuuuuuagaaaacaaucucugcugcauacagagguuggcuuugugcagggccccagcaauccuggugguuccuuccugccuuucuucucccuucccuauucuggguuuuucuccucccugcuucccauucuaccauaggggaauggggucaagucuuuuggaugggaaacaggaacugagaaguugaagauggagaaaugaaagacuaaagauagcaggguuuuaauuuucccucugaaaagcccaggaagagccccggauuguguaaccuggacacaugcaaaugaugacccugccccuacucuaucugcuucuccgccacccuggcccuucagaagauucugaaacaaggaauugguuacccagggugguuagggggguugugccugugucccuggugaacuuuagauucuugugccccuggugaacuucaaaugcuagugugcugggagccguaugacagccccuugggguggcaggagcuggcuuguguggaggagagccacuggcagcuuucuuggugaagggguggacagcacucuugguguggaaguagcagcccccuugccuguagcugggcugggguuaguggaacaggguuuagagaaagcagggguaaugccgggugguuauuuuccccaaauguuagagaaagccagcgcuucuggcucuggaagugaggcuguugggaagugggagggggagcacagcucuggaagcugccuuccguccucccuccauuggcuggagcucucccagcauuucaucgguucaaagccaaacacaugauuuuggacaagucacuuaaacucuuugagucaguuucuucuccuuuaagcuggggaaagagguggugauuucacaagugguuguaaauauugcaguaaagauaauggaaguaaaagugcucuguggaguguaaauugcuguaugguaguuggaguugggcccuaggugugauuuuagaguacacaccuacugcugccuugguaacuuaaaaguauuuaucucaaaugcuagugagcugagcugaguggcacaguaggccuuucuuucccugggagcacuuugggagcuuuggagguugcccagugcugcccccaaccuuuaacaguguggccgaguguaggagggagggggcagaguuccuucuggcuggacugccacaugcaggggagaggccccgcugguggugucccaggugggagaggggcagaccugggguuaccucagucaggguaggugaggaggggauggguggacaccccgguggccacuccuacucaccccugcacuuaagaccugggguuucaugcccugcuccuuuaacccucaguguucaagagagaggccaguuggaccagagcgccucaccccaccauuugccaugugccccuccccguggggagucagaaacaccugagcacaccaggaaaaguuuugaaaaacaauguuuuuagagacaggguguugcuacguugcccaggcuggacucaaacuccugggcucaagcgauccuccugccucagccuccucaguagcugggaaugauaggcgcgugccaucaugccuguaugaaguuuugaaaaauuuaaauguugauggaaaaaaaaauguauuaguggaaaugaaaggcugguauaagcuguaaagucuuuuuguucuuagagauuuuuuucucauucuaaacauuaucagaccugaaaaguauuugucguaaugacugagacgguccugggguaacagcgucuucuuaacggccacuuuaauuggcguaguuuacaccuagccucuccgagaacuggaggacacugguaaucacuauuagauauugagugcugacuguauggcagacacauaagcauuggugaucuccugugaggcagguauuguuauucccaauuuauagaugaagaaacagaagucagugagguggaguccguuuuugaggucacgcggcuaguaauuggagccugguuuagaaccaagucagucucauuccagaauccagaaccagugauuuguaacugaugcacuugucuccaaagggauccagcacuggguuuucucauuuuuaaugcauccauuccuuaaagccucuguucacagucacaagguguacuuuuuaaaggaacacagcacacaaaugugaccgcuaguggacagcaguggcagcccaguuggauggcagagccuggcaugccgacugggacagaagccccagcacacggugugaugauggcgucuccaggcugaccuccauggccucaggaaucaaaguccucagucucuuucacgcgggguucagaaagaaaacucggcuaucuuacaucuccucuccccuguuuauuugacuaaagugaaguucauguggcuugagccucguuuccuggggaaaucagccuggcuuaggauuccauugucuucugggacugggaagauguggaaggcugaccucacgcccagcugaaggucaccuucccagacucugagcucggcugccuucugcaucgccacggcuggagggccuggcccaggccguggcugcaugcuggcuuuccacugucucggugucccugcugccugucaguaaugugcccagcaccuucuggugucauguccccucuuguuugugauucuuuuccugagcuaguccauuuucuaccucgagucugcucuccugccauucccaggggccacagcucaguaaugugggugucagggaaccccaggccaggcccccuugugccacuguggcucuccccaaagcagggcaccaggcuggcuggggggguccugcccagagcugccccacgcugccguguuugugcugcugcugugcaguggugaucuugccaaaauguggcuuuuccuuucucacucccccagagcucccagaaaagucucuaggacuuuucuucccccuaaauaaaagucaggaugugaagccuuuugacagaauuggaguuuacugucaucuguuuccguuucucuaagauagggauccuggcgaagcccaugaaagccauggggcgcucccaccgaagccuccgaggcacagaccucccgggagugccugugggcgcugcuuccuuaaacugcaggaggcugcagccucucguuguucaugcgucguuuuuucauaguguguguggguuuagagcuacauggguucuuuucucacuuaucuguucauaccgcaugacaccguccacuucaggcacaguugacggccgucuggaggucaucagcugagggcacaguuugccugguucuucuauaauagguuaaguauuuuuuucuccauuuuuuucccuuuuaaaaguacugcuagaaggccaggugccgugucucacaccuguaaucccagcacuuuaggaggccaaggcgggcggaucaguugaggucaggaguucaauaccagccuggccaaccuaaggaaaccucaucuuuacuaaaaauacaaaaauuaaccagguauggugguaugcaccuguagucccagcuacucagaaggcugaggugggaggaucacuugagccuuggaaagagagguugcagugagccaagaucacaccacugcacuccacccugggcagugagugagacccugucucaaaaaaauaauaauaauaauaauaauaauaauaaacacaaguacugcuggaacuucuuugcagaaacaacuuguggggaaggagggagguauauuuuaguauuuggccuugggaaaagguuuugcuucugcaggcaugucuuccagagacugggggggcccgugcuggcgucaccacuguccccuuccccaucaggaaccuuccuuccuuggauggcauuuccaguguguccgggccucugcuguucucauuaugaguccccagcucugacggccacuguggcugaugcacaggguguuggagacagugauucagcccagcaggcuguauucaugugcuguuccucuguacacccagagcugucuucucgcucaucauuuauuaaucuuucccaugcaagucauacgugaauauauccuugugguaaaguuuucaggugauagcgaaaacucagucuccugucaccgucuucucuccucaucuaggugcgcgcuauaacuaaguccuuugccucuuccagaguuuuuuucucccuguguaccauuggcccucugcacuuguggguuuugcauccucguguucagucacauagggucucaaggggaaaauauucaagaaaaaauauccaauaaaaacuaauacagcaauuuaaaaaauacaaauuuuggccagacacaaugccuuaugccucuaauccuagcacuuugggaggcugagacaggggaaucacuugagcccaggaguuugagaccagccugggcaacauagggagacgucucugcaaaaaauuugaaaauuagccgggugugguggcaugugccugugcucccagcuacucaggacgcugaggcaagaggaucacuugagcccgggagguggaggcugcagugagccgugaucacaccacugcacuucagccugggggacaaagugagauccuaucucaaaaaaauaaauaaauaaugaaaaauacaaauuuuuaaaaauacaguguaacaacuguuuacauagcauuuacauugcauuagauauaaguaaucuagagaugauuuaaagcaugugggaggauguguguagguuacaugcaaauaugacaacauucuacauuacgaauugagcauccuuggauuuuggaauucaacggaaucccggaauuaaucccccauggagaccgagggacuacaguuuugaguauuuuuguuuuauuguuuaaucugucccuuugacacauuuuugugcucagaguuaaagaccucaauacccugcuugaugggaggagaagagaaaaggguaacaaaguauaggauaguacuuuucauuuucuuuaauucgaaaaaauuaucaaauaauguauucauguuaaugauaguuuaaaagugggaaaacaaaaaauuccuccaacuuuuccuaagacaacaaugauuauuuucuuucuguaucuuuauauacagaguuuuaaguguuugauauaucacuugucuauccucuuuuauaaguauuuuuuucuuugcuuuuacaauuugugugugugugugugucugugcguguaauggauuuaauaaacaagcuugugauuuucauuuauguauuuauuuuuuugagacggaguuucacucuuguugccaaagcuggagugcaauggcacgaucuugacucacugcaaccuccaccuccccgguucaagugauucuccugccucagccucccgaguagcugggauuacaggcgcgugccaccaugcccagcuaauuuuuuguauuuuuaguagaagcgggguuucaccauguuagccaggcuggucuugaacuccugaccucaagugauccacccccccacccccugccuuggccucccaaaguguugggauuacaggugugagccaccacacccagcccauaagcuuguaauuuucuauuucugaaauuggaauuuuuauaaaaacgauugccuuuuuaucuuuuuuuuuuuuuuuuggacacaggaucucacucuguugcccaggcuagaguucaguggcacagucauagcccacugcagccucgacuucccagacucaagugauccuccugcuucagccucaccaguaacugggaccacaggcaccuaccaccacacccggcuaauuuuuuuacuuuuuguagagauggggucucacuguguugccuaggccugucugaaaugcuuaggcucaaguggucugcccaccucagccuuccaaaguguugggguuacaagcaugagccacugugccaguugccuuuucaucuucugcagagcugccuuacuuguguuuuguccucagugcuguuccugugcggguggugggcgucugcauguacacaggccagcuucccucacugcuggggggccugcaggucugggugcaccuuguuacccaggcuagccuuccucugcagaggugugaacucugccaccaccccguucuagucaagaugggaauggaaucucagaaaggaagccaucuaggagaaaaaugaaagaaguguuucucuuauguuugcugccgucaaaguugcuacuuuaggagcucagaaaaacaguuauuuguaagauggauuaaguaaguaguuuaguaagauugcccaaaaccaccucccagaguuagugggaagcgccugaugcuggggagaaaagcccgaggccugagcuggccgaccugcauucaguuuccucugucucuagcuucucucugaugguuuagaaaugguacuaagggauuccuaagucccuuuugcuuccuguggucaaccaacaugcuaggcuaauaaauuacuccugaaguucacuuucauuuuggcaacauuuucugguucuuucgccaacucuaauuucuuuucuuuaaaagaugcuuuaauuuuacuuguauucuuaauaauauaucuuauauauacacacacauagcauuaaaaauuuuuucaaugagauuuuuuuaaaaaauucaacuuuuauuuuagaucgggggguacauguguagguuugcuacgugggauauauugcaugaugcugaguuuuggggcaugauugaucccaucacccagguacugagcauaguacccaacaguuaguuuuucagccucucuccacaucucuccgcucucuaguaguccccaguuucuauuguuuguuucuuuaugucaugaguacucaacauuuagcucccacuuauaagugagaacaugcaguguuuguuuuuuuguuccuguguugauuugcuuaggauuagggccugcagcugcauccauguugcugcagaggacaugauuuaguucuuuuuuauggcugcgucauauuccaugguguauauguaccacauuuucuuuauccaauccacuguugauggguaccuggguugauuccaugucuuugcuauugauacaaaugacauuuaaagaaugauuaugaaggccacgugcaguuucucaugccuguaaucccagcacuuugggaggucaagguggguggaucacuugaggccgggaguucgagaccaaccugccuaacauggugaaacccccgucucuacuaaaaauacagaaauuagcugggcguaguagugcacaccuguaguuccagcuacucagaaggcugaggccugagaaucgcuugaacccaggaggcagagguuguagugagucgagaaugcaccacuguacuccagccugagcaacagagcaagacucuaucucaaaaaaaaaaaaaaaaaaaaaaaaagaaugauuauaaagccugguuuuggccagcacuccaagcgcgccccgcaggccugucccaucguaacgcccucagaagcuuccccugcccugacugcagcccucagcuugccucaguuuguaguuugccaacaagguguauaucccuaaacauaaacaauuuaguuuggccuguuuuugaacuuuuuauacugcauguauucuuuugcucaacauuuuugucaaguucacuuguguugugggguaaguuuguucucuuccguugcuguguagcauucuguuguacgaauguccaucaucaguuuauucauuuuaccaucgacauuucgguuuauccaguugggggcuguuuugaggaguguuaggacagccuguccaugucuucuguuguggauguauauuuacucugaguaauuuuaauuuuuuaagauaauaccaaaacacgcccuucucaucuguccuuaggcacacacuuuccucagcugugacuuagcucagacgucuauuugaucuuaauucuuagcgacaccugcuauucuucaggccuggcuuuauucccacaaggggggagguucguuauugcucuggcuuuaaacggagcccacaggucacagugcaagucuacgcuucccaaaaggcuucuggaaauauuugacacugucauuaaugcucucuguuacuuucugaagagucgaaugcguggugagacaaagcugccaucugaaugucugucugacucuucuuggcaaagccacccugggggcacggaccuggguguguuuuguuuuuuguuuugucuacugucuuucagaaaugucccuucuucucaggcuggccuuucguccguggaacgaggggagaggagauaggacgggagagcggagcaugcuagggcugccugagugcugcaggccucugcucuccccagggcagcaucuucggguucuaagaaggaagccagccucuucccaccccugcugguucgcauugagaacucagggugcuggggacaaaccggugcugugcugccugcagugugggcucccugucagggcugggaggaguggggugcaggggccgcuggugcugugggaggggcauuuugcauggauccuugaggccagggcucagcaaaccuuuucugugaggggccagagauaguaaauauuuuagguuuggcgggccucaaggcgguauguagguacuuacauaagagaggugauaaauaucuacaaauuuuuuauuaaugaaauucaaaauauaaaaauaauaauggaguacaauuuuuugguaaugcaggucuccuaaggggaagagaggaauuauuuugcgggggggagggggcgcgcauaacauuuaucuuaauuaauuuggguucaguuggucuuuccugugacccuguccuugcauucauuggaaauguucgucuggaaacacccuuagcucacgguuggauaaaagcugucccgcaggccgugugugcccacccugagccaggucaucuccucagauagugggcuuggcccgcaccauucagccuguggugacacaggauggaggcccuguaggguucugugggggaccaagaagagguagaggagcccccacauggaggaggguggccauggggugauguugaugcugagcccacgggggaaccauggccagggccuccgggugaccccagaggugguggcaccgcccucaggcgguacaguggggcccaugaacggaggaagagaagcaugggguuggggacauucagaggccacugugcugccuggguggcuguagcucuugcagaagguggcaaggccugaggaacugaauuugaaauuugaaugaaucuuuauagaaacauuccucuguggcuacccuguuggacagcacagguguggaaaaugagugaacagcuuugugguggucucuccugugguggacuucccuuacccacagugugcaccguccccacuguccccacacacuguccccguccccuguccuggcuccagcucagcugagcagcagagauuggaagaggccccucgguaacuugagaggaaccuauagaagaguuugggaacuccaaacagaugcuuuuaaagugguuugaaacaguaguuuuccucagaaauauuugggacacaucccccucucugguuuuugugauaaguucacucuguaaaacuuguuugacaaacugaaggucagcuuccaccuggccccugagaauuaaugaggucuggccaggcggcagcugcagugcaggcccugcuccugucuuggggucucuucgguucuugccuuuguuuguguuuuuuacacauaaguucccgugaaaguugcuuuucccccgcucugagcuggaguggaguuuucguuuggggagcaugguaguugagagccugggucugguuagaauucucagccugauggguagacaucuuugcuuccucgagacucaagcuuuguuauuuuuuguugcucuaagauuucaguauuuuuuuuuaaauuuuugauuauuguggguacgugguauauauuuuuaugggguacaugggauauuuugauacaggcaugcagugcauaauaaucacauuaggguaaauggggcuuccaucaccucaaagcauuuagccuucuuuuguguuacaucucaauuauacucucuuaguuauuuuuaaauguacaauaaauuauuguugaccuuugucacccuguuucuaucaaauacuagaucuuauucauucuguccaccuauauuuuuguacccauuuaccauccccacuuccaccccaccuacccuucccagccucugguaaccauccuucuacugucagucuccaugaguucaauuguuuucauuuuuuuuuuuuuuuuuuuuuuuuugagacggagucucgcuccgucgcccaggcuggagugcaguggcgcgaucucggcucacugcaagccccgccucccggguucacgccauucuccugccucagccucccgaguagcugggacuacaggugcccgccacuacgcccggcuaauuuuuuuguauuuuuaguagagacgggguuucaccguguuagccaggauagucucgaucucgugaccucgugauccaccugccucggccucccaaagugcugggauuacaggcgugagccaccgcgcccggcccuguuuucauuuuuuuuuauggcucuuuucaguuuauuucaugaaggaguuacacuaguccaaguuaaaagcggaccccaaaugguuacauuauacaagcugugagguuuuuaaacuugugacaagggacagaagggaaauucuacucauugcaaggaaauccucacuuaaacuacagugagccacaagcauuuaaaccccaugaaucuucagcugaucguccuuagccaguccaagcucuacgaggaacuggcauaauauauguucuugcaccugucacccuguagcugaauuacuucuccauauucuggaugcucaauuacaguaccauugcaggcaaacuucuuaaacgccuucacugguuucuuuuugguguaaucaucagcgaucccuuggacaguaguaagggccuuccugccguuucucuguugaauucuuauauggauauaauccucagugccagcaggaagcaggucaucacccuuacuugcaucagcaaaggaguuuaaauaguggagguucuggauaguggacauacgauccaauuucuuuuucucgguggaaauggucugcggaagacggcgggcagaggguacggaaaguagggaagcgacggggcccaagggggaggcugcugaguccucggcaguggcucagugacuggggugguuuuaauuuuuuuuuuuagcucccacaaauaauugaaaacauggaguguuugucuuucuguacguggcuuauuucccuuaacauaauaaccucuauuuccauccacaucauugcagcugacaggaucucauucuuuuuuauggcugaauaguacuccauuguguauagguaccacauuuucuuuauucauucuucuguuaguggacacuuagauuguuuccaaaucuuggccauugugaacagugcugcaguaaacacgggagagcagguaccucuuuaguauacugauuuccuuucuuuuggguauguacacagcaguggaauugcuggaucauaucauagcucuauuuuuaguuuuuugaggaaccuccauacuguucuccauagugguuguacuaauuuacauucccaccaauaguguacagggguucccuuuucuccacauccccacaagcauuuguuauugccugccuuuugccuauaaaccauuuuaacuggggugagauuauaucauuguaguuuugauuugcauugcucggaugaucaaugauguugaacaccuuuuuguaugccuguuugccauuuguaugucuucuuuggagauaugucuauuuauaucuuuugcccuuuuuaaaauuggaucauuagauuuuuuccuauagaguuguuugagcuucuuacauauuuugguuauuaauuccuugucagauggauaguuugcaaauauuuucucccauuuuguggguugucucuucacuuuguugauuguuuccuuugcugugcagaagcuuuuuaacuugauaugaucccauuuaucuguuuuugcuuugguugccugugcuuguggggcauuacucaagaauucuuugcccagaccaguguccugcaguuucuccauuucuuauaggaguuucauaguuugaggucauagauuuaagucuuuaauccauuuugguuugauuuuuguguauggugaaagauagaggucuaguuuuauucuucugagcauggauauuuagucuucccagcacaauuuauugaaaaaauuguccuuuccccaguguauguucuuggcacauuuguaaaaaaugaguucacuguaaauguauggauuuauuucuggguucucuauuccauuagucuaugugucuguuuuuaugccaguaccauacuguuuuggcuacuauagcucuauaguauaauuuaaguaagguaaugugguuccuccaguuuuguucuuuuugcuuagaauagcuuuggcuauucugggucuuuugugguucuauauaaaucuuaggguuauuuuuucuauuucugugaagaaaagcauugguauuuugauagagauugcauugaaucuguaaaucguucuggguaguauggacauuuuaacaauauugauucuuccaguccacaaauauggaauaucuucauuuuuuuugguguccucuucaauuucuuacaucaucguuuuauaguuuucgcuguagagauccuguacuucuuugguuaauuccuagguauuuaauuuuauuuguagcuauuguaaaugggauuauuuucuugauugcuuuuucagauuguucacuguuggcauauagaaaugcuacuaauuuuuguauguugauuuuguauccugcaacuuuacugaauuuaucuaucaguguaaccacccaauggguucaccuugcccgcugcugccuagaccaagcugauuuaucaagacaggggaacugcaguagaggaagaguaauucacgcagagccagcugugcaggaaacuggaauuuuauuauuauucgaaucagucuccuggagcauucggggaucagaguuuuuaaggauaauuuggugggucagggccagugaguugggagugcugauugguugggucggagaugaacucauaggcagucaaaacugucguuuuguguugagucaguuccugggugggggccacaggaccagaugagccaguuuauugaucuggguggugucagcugauccagugaauacagggucugcaaaauaucucaagugcugauauuauguuuuacaauagugauguuaugcagccuccagcugcaugacuccuaaaccauaauuucuaaacuuguggcuaauuuauuaguccugcaaaggcugucuaguccccaggcaggaagagggguuuauuuugggaaagggccauugucaucuuuguuucaaagcuaaacuguaaguuccucccaaaguuaguucagccuaggcccaggaaugaacaaggacagcuuggagguuagaaacaggauggagucaguuaugucagaucucuuucacuguaauaauuaucucaguuauaauuuuugcaaagguaguuuuuucaguucugauaguuuuuaugauggcaucuuuagguuuuuccaaauauaagaucacaucaucugcaaacaaggcuaauucaacuucauccuuccaauuuggaggcccuuuauuucuuucucuugucuaaucucuagcuaggacuuccagugcuguuuuuauauauaguuggcauaagacuguuucuagcauucaaucuuuuuuuuuuuuuuuuuuuuugagacagagucucauuuugucacccaagcuggaguacaguggugugaucuccgcucacugcaaccuuugucccccagguucaagcgauucuccugccucagccuccugaguagcugggauuaugggcaugcaccaccaugcccagcuaauuuuuguauuuuuaguagaaucggaguuuuaccauguugugcaggcuggucuggaacuucugacuucaaguaauccggccaucucggccucccaaagugcugggauuacaggcaugagccaccgcguccagccuaacacucaaucuuaaacaaucauucuagcuucucguccugaccaaguuuaauuuuaauugucuauaaauaugcaccauaaugaaggguguguuucugaauagggagguaauugcuuuucccacuugcaauuuuaauuaaaaauuaccucuuccaccuaccucaccuuuauuucuaaucuguuuaacagauuguagaaaagcaaguuuaugcacucaucccugaguucaggaagcacuacuuccucuuugguaacaaagguagaagauuccauauggugaccuauuuuuucaagaguuuuaugcaguaaaugaucagggacgggugugucccaugacauaauaugggaggaaauuugucagaguucaauuguguuauuaagguauguugucugugagcagccuuuuacauugaaguuuaccaccgcuuccagucccauguuuuguuuuuucauuugucuguuuuuuuuuuuuuuuuaagagacagggucugucugucacccaggcuauagggcaguggcgcaaucaugguucgcugcagccuccaacuucuggauuuaagugauccucccuccucagccugggauuacaggugcauguucccaugcccggcuaacuuauuuuuauuuuuuguagagacagggugucacuguuggccaggcuggucucaagcuccuggucucaaacauucuucccaccuuggccucccaaagcacugguauuauaguaggugugagcuaccgcauccagccuaguccuuguguucuuagcacgguugacccaaacuccuguagacacaagaucacucugucaucugugggaguaucagaggcaggagggcugaaaucugguugagagagacagcacagaucucccuggcuggcuuuuccagaacggcuacugcccagcuuuagcccugaauggcuuuugaaccauggguuccagccaguucccucuucuuugcguagccucucccugaaugcacuuccugccugcccugauccauuacccucccuguggccugaguaaccuucaagcacagcucccguuuccccucugggaagcacuguugccuggcacuugagccccugcauuuugggcucaucauccuuuccugagcugcuucuugaguccuguucuguggcaagcucucugguaggcacuggggauacaaugaacaaauaucagugacugaccuuagaggaaagcauuaaaaaaacuaaaaagaggcgguacgauuaauuuuguugauauuuucuauaaccuaagauguccacaauauuguuuuaacguggcacuuagccacauuucaggugcuccguagacacgugcugguagcugcuguaguggauggcuguggccuagaggcagagcuggacaaguuaaaaaagcaguucugugcacguaguaaguccugggcuccuguuuucaucguuaauuuguguuucucuaggugauuaucuuuugugaguugugaauuccaagaaggcacaggcauugccuuguccuguuuuccucaccauugugucaguaauaccuugcagguagaaggugcucacaccauuuuauccaaugaaaugcuaagcacagggcauuaugggaaaagcugagaugaguaccugccacccuaucguggagguggcaaggcaucagaggccuucucaggagagaggagugugugcacgggcugggaagacagcagggggagggggagccacagguagcucauuaugauggaagcuugggguacaugugaaagugauggagaauaugaggagcugaugccagagaagcaggcagagcucagaugaucagauuuuuaaagcuugcuaaagauguuauucugagaacaccaggaagccuuauagugccugggcugggaccugccccucaagccuuccugugucaucuuuuuuuucucuuuuuuuucuuuuugagacagagucucacccuguugcccaggcuggaguguagcggcacaaucuuggcucacugcaaccuccaccucccagguucaagcgauucuuuugccucagccuccugaguagcugggauuacaggcacacccaccaacacgcccggcuaauuuuuguauuuuuaguagagacaggguuucaccauguuggcuaggcuggccucgaacuccugaccucaagugauccucccaccucgaccucucaaaguguugggauuacaggcaugagccacugcgcauggucucuuucuucuuuauucgugagguguuuucucccuuuacacuugcuggcccauggaaggugcuuaguaagaaugguggcugacuucuaaugcuuccagagagccugacaggcugacaugggugucuuccacugucuguggggaggcuuagaaagaggaguggcuuuuauuaauauuaugaguguggaucagauccugcuggagccaauggcaaagccuggagccggcccagauucugcgagagugcuaggcugcacggucacagaucaaaugugcuuuucaagaauggccccucuccugggauggggaacuuagagcucugaggagcaccgugaacuggcaccucuaugugugagagcugugcugucugacauguggucuaagcuucgcgaacugguguuucuggcacagcccugagcacaaccucagucugcccacuggugcuggcugagccuggccuaggucccgcgagucugcggcuggaagacuggggaggaaaagugaugagacugcaagagaaagauaauuuaauuaugauuguccugaguuauuuacuguuuccaaguccccuuuuguaucuugaaggaagguaggaauggaucagagauaaccacuugggaaaauacgaguuaacuccauauaagaaaucuugauuaucuuguaucgguaacucucuacucuuuaguauggcaggaaagaaugccuuuuuuauuuaaauaaacauuuuuaguuuuagguucacaacaaaauugaauggaaaauacagaaacuuuccaaauacccguuccccuugacaugcauagccuccuccuuuguuaacaucccgcacuacaagugguaugcuggugacccucagugaaccgacagggacacaucacucucaccuauaucuuuacuucaccuuagggcucacucuuguacauuccaugggcuuggacaaauguauaaugacaugauuauaacuucucuuuguauugcagccacucugucaaaugucuggugccuugugaucauuuuuccauuuaaaauugccagcacuaaucaugucuguuuuuagcauccaauaaaauuaucauuguggcauuagaaccagggcuuacgauucugcuauugaaaacugguucaaaaggugauuucaggaaggcuggaaguccagaauccauugcucugaggagcugugcuguguuucugaugauagguuguugcagguuuuuaugaucuaaacucacaugggguaauaauggacacucaauagcaguaguuauuaugugccaguagcuguagggcagggugcuucauuuaguuuucauaggauagccugugauuggcaucgcuaucccaguucacaaauguugucucccuccagucacaagucacccuuugcuuuucuauguuguuuaaguggguuaaaaggacuuuuuacccagcauguugggagguugaggcagguggauccccugaggucaggaguuugagaccauccugucuaacauggugaaaccccgucucuacuaaaaaugcaaaaauuagcugggcaugguggcauaccccuguaaucccagcuacuugggaggcugaggcaggagaauugcuugaacccaggaggcagaggcugcagugagccaagaucgugccacugcacucuagccugggugacagagcgagaccccuucucaaaaaaaaaaaaaaaagaaaaagaacaaaggacuuuuuaccuuuguaucuguugugaaagucaagguguaauuaaauuuccaggugugauuagucguugaacagauaacuguuugagcgccuccuaugugcuggacauugugagugccauagacaacugccguguaguagcuggucuauaaacauuugcugaauauuauauaugagaguaccucuaucuaauuauucaacccugcaaaguggguauuguuccugcugguuucuggagaagaaaucugaggcucgggaagcaauaggacccgucuucuaacacagcuuacaagcuaaugauauuuggguuuuuccaaauccagagugggguugccuccaccuuguuagggcucuauagggggaaggggugcaggcacgauaggagucccuggcaggcaggggcauccuggagccuugcugguaaccaaggagaacggaggguucggcuggaguaauucacuucgcugcagagggcucacguccagcaggugcugugggcaggagacagcuugcaugcugcaggaggaggaguugguuuucaguaauugccaacaaacuucugcuuagugccauuuggaaaccagucuuccacaccacacugagggcuugucucccagaaacaggugccgagggaccuggcagaggaggcuugucucccagaaacaggugccuagggaccuggcagaggcaaucagaguggcacucaacguggugcucgcugcuagcguggucucagcacagacacgguuuaaugacuguauucucuacauuuuaggcuuuggacguggaccggaugguucuuuacaaaaugaagaaauccgugaaagcaaucaacagcucugggcugggugaguauacauccuucccuagagguuucuguguggaaaaugucgcauuugaaguccugguaccguaauauugaugaccauuaacaaaugagccagcuagacuccuuuaucggggcaugcagaucacagaggugagcugggauguuucuuuuucagaaguauguuuuguuuugccagucgucugauucaggugugggauuucguccccugucauccccugucauccuccgugcugucugucccacguugcacuuccuguuuucuggagcaucguccugcacguacccacuuugucagccuggcugaugggggccuggauucauuccugccucugucauuugguuuuugcuguuaauugugucacagugcccuuuccguuucucuuuuacccagucuugccuuuucuaguauaggaagaaaaugaauaaauagacaaacauaaaguaauauuugaucuagauuuacacauacauauuuuuuacacauauauauuuacacauauauauuuuuuaaacccaugcaacuuuuggcuuaaagaugacaaguaggucaccuguagcauaccuucccuuguacaaauccuacgagugauacaaaauauuuuuuaaaagucguuaagugacuauauaguuucauucagcaacaaaaagguggcauccuugcagggcuaggaacugugaggagucccugagagacugaaacagggcugauggguugcucaggggagcuugcccgugcucaggugcagauagaguuugggugacagggugggaggaggaggggccuggggucugcucccacugaaguagucaggucccuucaucuauacuguguccccucacccucguggugucuuucuuuagugaaaggggugauuggaacaggaggacagggagugccuuagauggucguggugucaggagggaaggggaagagccuggaaguacacauuccaccugcucccccccaccgcccccaccaguuacaauagggcgggcacaagcuccaguugccgcucuugauucuccccccaugagagcugugcaagccacaaucgggaagaaucuagcaggaaaucccaggugcaggauaauguuacaguugagcauugccaaguguauuuaggaacaaauuuaacagaagacgcacaggaauccuacaucaacaaguacaaaacgcugcugaccaaaaugaaagaagaccuaaaugagaaauaugugaugcacagggguuagaagagucaccacuguuagugucaggccuccccaaacugaucugaagauucaccccaaccccagucagaauuacagcagcggaaauugacaggccuuuucuaaaacugauacagaagguggccauccgucucuagcuuuuuuaccuggauuaaguguggggcagggagcaauaaugauaguuuugauuuuuuugaacacuuacuguguaucuugugcuuucuguacauugugcuaaucuugucaacaacugauucuccuuauacaaaugaguaaccugcaaaucagagaguucuggguguucccaagaugucugugcagcuggagcucagacccugauggucuuacugcugugucaggguugugugcagugaguggcccacucuguuucaaagccaccaugccuucagugugucugucacacgggugacaucuugaagacuucagugagucacuaagaaaugguacgcccaguuucauugacaagcaccagauuucaaaaaguaucuuggaagauuuuuuuuuuuuuuacugcguucacuuggacuuuuugaguuuauaacuugagggauauuugauauucuggucagacucaaaaaugauuuuauagucauauguugaaaagguugcucuuaucagaaauaaaaaugaaauaaucugugucuuaugcaaacacuggcuguguagcugcugcucgucuggaggagagacuugugugacucccaaggcuggcccaguggcuggcaguacagcuuauaaacagcccugcauuugaagggagaaggcgcuagugcuucggugucaggaagcuggccugcaggaauuuaacagcaccucugucuaauuugccaugcugaccuauauugcugagcguguaccacaaaccucauuccuauuucuaaccacccccaagcgucguuugcuaaaaugcaaccccacugguguuacuucucugccuaaaacucuauagcauuuuuucaucacccucuuugaaguucguggaagucaguuccagagcaugggagagagaaggaaggccucugugggcuucagaauuuuagggcaauugggauaaagaugguucucuuaccacagauccauccaaagauuuuaaugugcuaguaauguggauugugagugguuaucguucuuaacccuuucccaauucaucugucgaugaaacugucacugccuccccugaucaccccacugugagccucaggugaguaaauacugcagagcaccagaugaguuccgagcucuugugcauugccuggacucaggccaccugucccgacccuccccaccuggacuccucugugcccuucuuugaaauaacuugcaguuuuccccagagagccacguuuuaugccuucuucccucugcucaugcucugcuguuugcuuaaaauagcauuugccacuuuaugaaagaaaacugagguccaaggaaguugagaaguuuguucaaagucacaaagcucuacagugacagggcugggauuuuaacguagcuccuugggcucauguccuuuuugaggccccgcacauaacagccuggcaugugaccuuggagggggucuccuauuuuugucauccuuuagccaucuauuaugucaugccaaguuugaguuauucuaaggucaugagucugaguccugaaaaguccuaaguccuaaaaccagagccugauccugaaaucuuuauuucggaacaagcguugucuacugcaaagaagucaccugaggaaacgugauacuuucuccugucauguugaugacaucauucacagugucuuuagaacucuuuagaacugcuuuuaguagcacguucuuuugcauauauuuaguagagaagucuaaggauagauuaaauuuuuuuagaacuagaugucagaaauaagucaggcauauucaagaagggacugagugccagcgaccacaguuggcuucggugcacuguaacuacagucaugggcucugaaggcagcugguuccaaaggagaaguccccauaguguuuugaucacgagaauaaagaccaaaggcaauuccuguauaggaagagcgcucauuuuauguacgauugaaagaacagugagaauaaauuagcauuuaugcuucauacugccauauuccuugucuugucucauguuucuuaauuucuuugggaccaagauuuccugccugcuuuccugauuugucacagauuggccccauuugacccaucucuguaccagugucccucacugcaggcugcuggccugucacugcuuccugagugugugccagcuguacuucugugucuuugcacagccccacccagucuguaaacggacucccccaucccagucaccugcaggggaccugcccuugcuuccccacccauuuucaucaagccuuagcucucuuugacuucagcguagcccucuuugacucucuuguaauagauucuuuuuuuuuuccucucuuuuuuugagauggugcuucacucuguugcccaggcuggagugcaguggcaugaucucggcucacugcagccuccgccuccuggguucaagugauuuuccugccucagccucccaaguagcugggauuacaggugucuaccaccacacccaacuaauuuuuguaauuuuaguggagauggguuuucaucaugcuggcuaggcugaucucgagcuucugaccucaagugauccaccagccucggccucccuguaauaguuucuuauugcuguuguaacaaauuaccauaaaaugaguuggcuuaaaauggcacaaaguuaucuuucaguucggccaugggaaacccgacaugggucucacugggcuaaaaugaagauguuaacagggcuccuucccugaggcuucaggggaaaucgguguccuuuuccugcuccuagaggccaccugcauuccuuagcucacggcucccuuccaucuucaaagcuggucauggccgguggugucuuucucacacugcauugcucugacacuuagauggcucgggcugcuauaacaaaauaccauagauugguggguuaaacaacagaaauuuauuuucucacaggccugggggcugggaaguccaagaucagggugucaguguggauggguucuggugagggcucuccucuccuuccuggcuugcagacagcugccuucucccuguacccucacauggcagcgagagaaagcaagauguccacuuucuccucuuauaaggacccuaaugccaucaggagggccucacccacuugaccucaucuaaaccuaauuauuaugcuucccgauggccccaucuccagacaccauugccuuggggauuagggcuuuaauauaugaaucugggggaagggacgcaauucagucccauagcaaacacugacucuucugccucccucuucuacauauaaggacccuugugaugacauuggccucauccagauaauccagauaaucuccccaucucaaguucagcugauuagcaacuguauuucauccacaauuucaauuccucuuugccaaguagcauaacguacucacaaguuccagggauuaggaggugggcaucuggugguggaggagacguuauucugucuaccacaccucuccugaauucuuaggauuuggagguugaaucaguuuccacuguuuuguucagcuacaaauuaaaggguaccuaacaugcaggcacuguuaacacuuuaaauauugcuccugauuguucucuaguaguuuuguaucuguugaucuuuucucaguuaauuagaagcccuugaggugaaagaccaauucugggagauggugucauuuaggauaaagaagacguagguauuagaauccaagaacccuugauuaaaagcuagcaaugccacucaaaaagccugugacauuaggacgauuauuuuaccuuucugagccucaauuuccucauguguaaaaugggaauuuaauaggucauaggauugcuagugaagauuaagugagauaacaugaaaaagugccaugcaugguucuggacauacacgugguaagugugacagcugugacauaccuccuguguguuccuugcaguggcugccaugggugugggcggguaauaggugcccaguaaauacugaguguuuauacauuaucagguuccugcuguauguacuuacacugcuuucuuaguguaggaggggugaacuuacaauuuuagauguaagugguguguguuacgacaggcccuguauucuauucuuugaggauuuauauggauuuauguagaaggaagauuuaagaugccuuacaauggaggcuggaaaacuguggccagacaccuguguuuucacagccugaaagcuaagaaugguuucuuaccaucguuaccugcacaauaaccucaguauugccucagcaacccacagugugauggucucuggagauggggccuuugggaaguaauuagcuuuagaugagggcaugagaguggggcccucaugaugggguuagugcccugcuuaaauauuuacucucugacuuucuaggaaaaaguuuuugaaucccugcauuagagcagugguuauaaacuggagagaguaucagaauaccccggggucuuguuaaaauagggauugaguuucugguucagcaggucaggguuggagccugaguauuuuauuugcuaauugaaaaagcucccaggugacggcacuggacuuugagaauccuaccucagaaccccccauccccacuucaaacacugaacugggacaaaaggguaucugcaugucccacguguauacaaaacaguagucuucuuccacaauagucagugcauuauguuugcucccagucuucaaaaugauggcaacccagccagcuguauuuucuggagagucuuagcuuggguuuccaaaagcaguugucauaaugauuuaugagaaacuguuugccacucagugauggauugcuuauuuauuuuaaacucuuacuugucuaaaauuucccaagcucuggcucagcccaaagguguuccuuccacaccccaggaaguugaagcuaacauuuuuagcuguuugacauaucaguggguggaaaaauucaucucuaucaagaaggaagcaacagaagauuuucauuuucacuucucuagaauuauucugucauaaggacuuguuagaacauucuuaucgagagugauauuccuacccucaaucagaauauccuagaaaauuaucacauucuugaaaguacaaagaaaugcugauuuucccucaaauccuuaccaucucccacauacaaaagaaaaugagaauacaacaacuuuguguguguguuccugccuguuguuugcaguguuaauuggaauaugauauuaaaauacacuucaaauucauacagaaaacuauuucuauuguagauauuaucaauuagaacagggcaguucagaacaaauauauauaauaguugaggaaaugaaguuucacugugcauuaagaagauacuggcugggcacggugacucacgccuguaauccuagcacuuugggaggcugaggcagauggaucgcuugagcucaggaguugaagaccagccuaggcaacauggcgaaacccugccucuacaaaaaaauacaaaaauuagcugggcaugaugguguaugccuguagucccagcuguuugggagggugaggcaggaagauuacaugaaccugggagguugaggcugcagugagcugaaacugcaccacugcacuucauccugggugacagagugagacccugucuccaaaacagaaaaaaaggaaaaggauuuuuuuuaaaaaaggaaaaaaaaaaauauauauauauauacuguaucugauuucuaccuguuacaugagaaaauaacaaaaucagaauaaucuuuacuguuuggcaagcuuacaguaacuaguacucugcuccauuguuguggcacugaaaacaugcacgcagaguuucuggaaagcaguuuggugguacacaucaagaaaaauaacaaucuuuuuguggaaggagauccaugcacaaagauguucacuuuguuguugcacugcuuaucaaagugagaaauuggaugccuccuauauauagcugaauuaggauuuagcugcuugcuggaauuauguuuauacagcaacaggaagagaaaugcuugugaugaaaucuucagcaauaaaauucaggaugcaaaauuuauguacaccgugugugauuaaaaaggaauagaugauaaaugaugauaaagaauauuuuuauugauauucacaaacgaggguagaagcauagugguaauaaauacucaugagguauuuguuagaauauuuguauuauaaagcuaaauaaaaacuuuaugugaauuccauccuuacagccuugugaguuggguccuguccauugacagaugagcucacagaggcacugaguagugaucugccagugucaucuagccaacaguuggaggagcugagauucaaaaccaggugagcgucccgucucugcuucugacugcugcggcaugcugccuggugcugaggcgggaaguugcugggggcacacgguggagaaaacaagcagcaacguggggaacacccuacgugccaccuggcugagccaucguaguccuucugaaaaauuccaggugguuuugguugauuacagggucagugugagccaguacguggcacaugccccaaaggugagccacacaugaccucagugaagucuuuggugcuuauaaauaagguuguuguuucauuauuuaguuguaagagcagcauuuaaagaagaaccugaaaaccuuagggauggagaaaccuccuuguaggacggauaucugaaggacgcggggcuccugguuucggaaggggcaggagagggcguacaugaagggcuuucucuggcugaggaagguagacauaguauuuguuccucucuagaggaggcuuucacaagagcaagccuugacucagauaugagggagaggauaacugggugagcagacugagcggcgagcuggugguuggaagguuccugcagcggguggacggccucugucucugaggaaguuauagagggaggugaggacgugggcucgaaggcccuggagaugucuuccaguugugagacucuggaguccagccuucuccccgcugcuggcuaacaacaaugauuggaauuuagauggugacuuguggaauccuguccgcagugaccacugcauuagucauggaaggaggguaccucugaaggaacacagaggucugugacuuaacuaacguccaaguguuggcaugaaucauacuuugguucagagguaucugcuauuuaauuuggcuggcuuuuauagucagccagucugugggccaaccugcuggccgcaugcaucuguaagacauggggcugcaguuucaucagugguucuuuaaucuuuugguuaucauagacaucaguaaaaauaagaaggcuguuuuggaugaucccuccaggaaaagguaccuuuacauaauuuugcauacacuguuugggaugcccauacccccauaaaccuguccgcaaacccaaccuaccaagcaaaaaagcucagaccuugagcuuaaaucuucuaccaaaucaacacgaugacuucaucuguuuccucaucuguaaaauccugcagaguuguaaggaugaaagauauuucuacacguaugucaucuccacaguguucaugguagcuacuaucugaggcuuuagagaccauguacuuuccaagggcugcuugucccugagggugaggcuccaggaucucgugaaaccacaggagucagcuugcuucccaggggcugugcccuccauggaguugggugggggcagcguguguuuuuaagucaucacuguggugagcguggggucaugggguaugacguggcaaaaaugaagggcugaaagcugcuuacccuggcaaaaugcacauucuguaauguagcgagucagauugcuuugccaacaugaacucuuccuccauuaaaggaugugaauauaauugggaguaaaauuucuaauagcuuguacuccccauacaacaaauguugaauucaccucuuggcuuugaaccccagacaccuugggguagccugucuccaggcuaaaggagagcccugcaaguuuuuuagugaaacccccuucccaccaccuccaacccccuucuccuucccugauuuggucucagagcaccccuaggagggaagcagcucucugguuaaggagagucuagggugagucaagcagcugguagcucaguuuuaaucucaugccauacuacauuuucaaugaggaaauuccucuaaaugucaucugcuccaagaagccuuuucuguuaccagcccccagaaaauguacuccuuuccccauagagugcuguguuuccaccucguguaauuuacaucacaguggauuguuuucgcauguuuaucuuugucuugcuaaguuguguguuggcagguaccaagguuuauuaucuuucuugaaugcagaucucuuagaagccuuuuggcugcucuccguuaccugggaugaaguuccucaucucuggcuccugccugacucuccagcccuuccccaugcucuggacacaccaagcgccuugaauuccccagagcucauuuuguuucuugccuuugugucgcugcacugaacugaugggcugagucuuucucacuuauuggaugcuugcuucuugaggguaggggcucuguuugaugaaucuuuguguucauuagugcuugcuggagaauagacuuucagugugauuggauuuuauucuuuaguaaccagaaauauucuugacccguaauggaagcacacaaugaaugaauaaaaguaaaugcggauacauucuguacucuaaagccuaaagggacagaaaccaucaacauaaaaaaaaauaugcaguagcccagucuccacucuucacccucucaccugccuuccaaguguacuccuacaagcaguaggagcuucacagggaggucauuggggugacguuuaguuauucacacagacuuugaacucauuugaacaucacuggaaggaugggaucauuaauauaaggcaggaucaaagaggaugggaugaucauagacaacagguuuuguauuuuaauagcgcacaccuuggccugauuagugaacuccauugcuagcugccugugcugaacacaaccagacuagauacauccugggguaccauccacaaagacuggcuguuucuugaggaaucacauuccaagggacuuccuaggaaagaugauggaaauggguauugaaaguggaacaagcccgggguguuggagaaggcggaggaaguggcaggaagaagccggugagaggcauccuuccaguugcucauccugcacgggagcucucagggguuaugaauagggaggacauucuuguucaaccccuucugguuguggcuacuucugucuugucaaagaugauacagguauacucaguuccgaaggcugugucccucccgucaccuuguccagggaaagcuuugggagagaaagacauauucuaauguuauuuauuuauuuauuuauuuauuuucuuuugagauggagucucgcugugucacccaggcuggagugcacaguggcacgaucucggcucacugcaaccucugccuccuggguugaagugauucucaugccucagccuccugaggagcugggauuacagacaccugccaccacuccuggcuaauuuuuguauuuuuauuaaagauuggguuucgcccuguuggccaggcuggucuugaacuccugaccucaagagaucugcccaucucggccucccaaagugcugggauuacaggcgugagccacugcaccuggccuaauguucuuaauaggcacaggcacagagcacuguaacaaucuagccauuagagcuggugcuucagauuucuuuuuaaaguuuuauuuauuccuuacguuguuauuauaaagcuaagauaagcuuaguuuagaaaauuuggaaaguucagaaaagcacuaaagcaagcaagucuugagccuggcaggaucucaguaucuuuauaaccagcagaggcucaggugagcgcugggucugaggcccacugcgacuuggaacacagcucugccucuuagaaguugcaggauccugggcuuguucacacucugacagucuguuuccuuguccacucagaggagaauaaaauaacaucuagaaagcacuuggccugggaccuaguauauaacagccuugcauaugacaguuuauugacugcuagcaagugcucaguuuuccccaccacuguuagcauuuugauguauuaucuuuucaaccuccucucuacauuucacuuuuugcaaaauugagacuaaauaucuaauuuuauguccucccuuuuuuaaacuuggcuuucugcuccuaccauauuccuauaucaugauuuuaaaagccaacauaauauuccauuuuguagaaauacuguuaauuuaaccauuuucauauuguuggaacuuaacacauuuuaaauuuucacucuuuauaaauguucuguacacacaucucugaucaccuugauuauuuccuuaggauagauuucuggaagugggauuauccagaagaaugauacacauuaguaaauuggaaaugaaaauauguuuucagccguuuaguugggaugauucuagaaauaaaguucugaaaaugguucucucucacgagauguccacuaaguagagacccuguuaagaaacagggaugauguuugauuugaagaaauugcauucccaugagaucaugcgccacaagugaggucggaaacagguggcauguacagccgacagccggaggaaauggucuccacugugcagaguugugcacaacaucacaacauucgugucgugacacacauuugaguaguaaucgucaugucauccgucuagggagagucuccaccaggcugcugccauagagaacauaugucucuccuuaaacgcucccuucgccgagcugucugcauggaagguuggaauguggggugucagcaagugcuuuucccucugccugauucccaaguggccuguggucuggccuggagcagggguuuggagggucuuuguugggucagcaaggaggcuggggcuggguagccauaaggcuggugcacccugccuucguucuguuaugcuggugacagcacuugguguucagguuaaugguacaugcacuugacuggaagguuguacauugucgcugucuucagcucuuagcucuuaucuaggcuaagagcugaagauagcgacaaugucauuagcaaaugaagaaacgguuuuugcugugggaggaagagcacuggacucagagucaggaaacccgaguucuuguuccagcucugcugcaaacucacugugugaccuugagcaagucaucacccucucugagcuuugguuuccauguuuagacuaggucaucuuucaggauccauggaaugaaaggacucagcagugaguauagcagcccugaggagguggggacaaugagaccugugcugcccuguggcgauuuugagaguugagagcuggaugcagacaggggcuuuaaaacagagaaaguaggcugggcgugguggcuuugggaggcugaggaggguggaucaugagaucaggaguucaagaccagccuggccaauauggugaaaccccaucucuacuaaaaauacaaaaauuagccagaagugguggugugcgccuguagucucagcuacucgggaggcugaggcaggagaaucacuugaacccaggaguuggagguugcagugagccgagauugcaccacugcacucuagucugggugacagagugagauucuaucucaaaacaaaaacaaaaacaaaagaaaaacagagaaaguauuaacagugggaacacauaggacucccugguauuccccuggggcuaaugccugucuguuucugugaucugcuccuucucuacucgacaagucuuaccuguccuuggagccccaguucaaugucuccuugccaucugaguccucagcgccuagcacauugccugaugcauuguaagugaucagugcauagacugacauaucuuuccccaggcauucaucccagccaugagcauauguguccuuguaucucaccccagcauaccgucacaucccuguugccgggcuggaaauaguaaguuuuauguuugagaugaaaaaggaggugauugaaggugaguuggcugggggacgcccauccucuggcagugcuguguugguggcuugcuuccucacugugcugugggccacacugaccugucaagagccguaucuacauguguggcccguagagggggcgcaaaggagccauucuuguccuuuuuguauccagcaauuuuugcugaaacaauuugcacugggccuucuccuugauaccaguuuuuuuaaauaacagaauccaguaaacuaaaaagcacacaacaaaaccuagucauugccucuaaacucuguauguacacaugcaugcuggcuucaugaucgauuucucugccagagucucucaguucauccuuuugcagggauugauggguuucgugcagugaggugggggagauaaaggggugauggcuuagaauugagaagaaacgaagucuuguccuagcauggucucugugacucagauucuuauuuuccaaagucccucccaggucagugauuauuggaucuggaucauuaaugagaauuagaguuuaagauacauuugaacaagggggaggugagagugugagcucuuuuuagaagaacagcuuucacaauucuguaaauaaaagcugauagacccaguuugagaucuuuccagaaacuuuauucccaagcuauuuauuuuagguuccuguuuuaagguuguuuuuggcaaaagaaaaacaaaggcacugaaugauuuucuguucucuaguaggaaaaucuucaccuuggggugaucugcagcagugggucagucagugccauguuaaucauggagggauggcuguugucguggugggcaccgugcuagguguuagaggaagacacggggcuuaugggcuucagcaggaagcuucaaguucauuugcaggaugaaaaauacaucuaaaaauccccaacuaggccagugcacaaagauucccacugaccucaacugguacagugugagcaucagaagacagugcugauugcaguggaugaaagcacuguaaacguaaauccaugagaugaugauggugaugaugagccaaagaacuaauugaucaccuugggguugcuggggaucaauacaucguuuagaagauguauaaggacaagaauuuuuuuuuuuuuuuuuuugagaauagagucuugcucuuuugcccaggcuagagugcaguggugcgaucucugcccacugcaaccuccgcuuucuagguucaagugauucuccugccucagccucccgaguagcuggaauuacaggcaugugccaccaugccuggcuaauuuuuguauuuuuaguagagacagcguuucaucauguuggccaggcuggucucaaacuccagaccucaggugaugcaccugucucggccucccaaagugcugggauuacaggugugagccaccguguccggccacuaauuuuuuuaaaaagaaaaaaacuuaaccuacaccagguagucaguugaggagcccagaaggagggaugauaaggagugcuuuuguauuucuuggugcuggaacauaaagucuacuaucagugagaaggccggcuccucucuccuaccaagggcuggaggaccaagggcuggaggcagccugcgugguccauaaagugcaccgauccuccuaccaacucuauggucuggggcaggugacaugacucucugaacugcacuugauucagaagaaaauagggauaauaauagccaacucuuagugcucagguuaaacugaacaaaagacuuacaagccaccuaguaggcguugaccuuuauacgaagucccuucccuuuggguguucacuuagagcaacacugagguccaguccuccucuugguuugagggacaccacgaggcugcauagagucuucagcuucucuccugcugggcuuugcauucauugcccagcaccgugaaggaggacaccacggcccagcuccccuccuuugucaucucuugaaagacccauggcucagaaagcagcgagcgagggaguaagcaggaccauggagguugcguuccuguuucugucaugcaguagacaguguguagugacagaugccugccuguggccaccagcccccuuccugaacccaaugaaacuaaacugcccaugucuugaccgcuaauuuugagauaguuuaaaaauaguaugugguuugaaaggaccuauccuucacuguuaaccacacucuagaauuauaaauagaguaaaacagaaggaauuauugauccaucugugaaacuggauuuuaaaaaucuaaaaauuagauacuuuuguuugacaagguaaacuuuuuaacgaugaaaacaaacaucguguaguagaguaggagaguggacuuuggaaucagaaaauuuggguuugaaucccagcucugccacuuucuguguuuccuuggaugaauuauuugaucucuuugagcccuaauugccuaauaguguuaugagaaauaauacaugucuuacgaaguuuagaaaaaauauaugugaaguuugugcuuugaauaagugacgccuguugcugcuguuacuuuuguuaguguuauugguuaugcgccaagugugguaaacugagucucuuuaccugauucuuucauucuuccucugaccuugagagcaucucccagcagguuuuuauccuuuauguagcugacgccgcaggcccagcgucacugugacuuaccaaggucauacagauauuuacagguggacauaggacuggaaccuagaucuucugagggcuccugaggagcugcguuugcgggugugugugugugcacauguauguuucugucagaauuuguuugcugaaucuggucucagaaauucauuuaauuuaucuagaacucucaggcucuuuacuggaauguuaaaaaagaaaaaggacucaaacagugaagugaguuuucuuuugugucugcuagauccccauuagaacccucuagucccccaaaugccacuggaggucaaagacauggugcuucccccauaggaugggugagcagaccauucauaggucauagggauuggcucaggguccaggacugcccuccaggaacaaauguucccucguuuucccacauugucaggcccagccuagccauuggcguuagcugacaguggucucauuuccccgagaaggaauucgggagcuacagaggggcuuucaggaucugucccuugguggaggagcugcagcacuaaggcugucucugguggaguucacauccagguucacaccgcaggucuggcugcccuguugugccuguaaauaguuguguuauauuuccaguugaacugaugaaaacauagaaauuagguagccaugcagauagaaguuguuuuauuauagacuggcugguuuccuuugaaagugccugaccuagaagugagggaauuauauucaaccacauuaauuuaccagaaucaccuguguccccucccccauuccuacccacgguuuaaaucagaggucugagaugggacgguggugucuagaguuuggugaaaauccaugcaugcauuuggcguccagcagggauugagaaccacugugccagagacccagaguccagauuuucacucuuucaggugcuacuuugaggccuaaugauaguaaaaugccaugagauguaagcaccugguauguuuuuucugcucaaacaacauguguguugucuaauauuucaggcacacgacuucgucgaagaugaauacaacuuagucugucaacucuaagcacauccgauguauggggaacacauuugccagacuauuucaauauaacaugcugagugcaaggauaggagaggugccaaugaaauacccaggguguagggcagagucauggaaggcuuccuggaggaagcaugagucuguaggaugcagaggaguuugggagggaagggccccuggguagaggcugcauccugagcagaggcacuggagcugcaaagaccacugcuguugcuguauuaaaaggagaaggagcugcuguguggggcucugaaucagaguccugggcugcaggcuagagaggaauggggcaucugugguugaguuucugggagggggcugagucuggugaguugugccaucauuuggugaaggaagaguccucggagagguggaaauguuguguguccuuggccaucucaucugauaugcugaggaccacuggacgugggcaagggcuuccccucuugcauaccacacuuguucuuugggaucuguugccggcaccacggguuguuguugggauaacgaagcuauuucuguuccuggugcagcuugacuuuucucagauuuuucuucugcugauguguucaguguuauucacaaccgagaagaaccugguggggagugaggguggcaugccugagacucacagcaccuccgucauucuguugcagcucacguggaaaaugaagagcaguacacccaggcucuggagaaguuuggcggcaacuguguaugcagagaugacccagauuuaggaagugcguuccugaaguucucaguguuuacaaaggaguugacagcacuuuucaaaaaccugguaagcagcucuguguaugaaaugcugcgguuacuucaguugggaaaguggcucaguagaggauaguuaugguuuguuugauaaacuaggaaugcauuucauaguuccuuggguacccaaaagaauuauguuuuuauacacauugggucaguuuggaauaaaguuuaaaauuguaauuuuuacuuuaacaagacuuaaaauucagcucugcaauuuaaauguacacagcuaugggacaaaauggguaaaugcauucgucuucuuaagggccucugacuugaauuuuuaacaguuucuaaacuguguagacuacucuccuucugguaauuauaguaggcauuuaagcuuauaauauuuaauaaauauguuucaggcccaucuuacacagcaagguaaccuguaaucaaagcacagaaauuaccaugaauauuuaaaggccuuuugugcucccaaguguagaaccuaaaaaaaagcaggacugagagcaaugccucgguuuucagccgugggaaugcggugcuggugccugcugccuguggcugcugcuuggugcugugggugaauugcgccuuucuugugccuggcagcucugugcuauccucgugauggggacaacauuuugaagaagugggcagcccaagagggcuguuugggacccugcccggguggaauggacccugggaucgcuccagcuuuucuuuccuguuuuucuucuccaguuucuccuaaaggucagggaaggccaggucaagaacucaguaaugcuuucucuguaggccacacacaacagcaucuuuuucguguccucuguuaggaagcucauaacaagugaaaaacauagcucauuccugagauggugaugacagugguuuugggagaccggccuuagaaggggagaaaugagggagcaucacaugugaguuccuaaugggaaggggaagagcaggagcacucgggcccuugcucuuucuccccgucuucacuuaugaacauuucuguaggaaaugguaaaaguaaaaaacuguuucucugcucgagcuuuucacuuagaggaauuugaaauccccuggggcuuuggucaagcucaucccccuucauccuuauccuagaguggcggcccaccugcucagcaguggagcccucgcccugccucagccccaugcccuggacacuggcaggcaugcaugguggggucucaucaccaggucgggaaagaguggagauuuuuuuuaaacuggagaaacugcaugggcccaggguaaagauccguagaugcugccauggagggcgucuccugguagaaaagucaguuggcugccugcucuccccgcaccuggguggauaagcccuuuccaugcacacagagcugccuguuagcuuccuggugccucacacuucaguacagaugagcagccuccagcaugagggagaccagaaauagcagaaaaaugaacguacgggaagacugggaugcagcaugcuaugaaagaaggccagggacacaacuaugguaagaaaauauaacauuaaaaauccaacaggaagggcuggaguagaggaaaucucucagaaaauagaucaaaaagaccaaaaagugggaaauagauaaaagacgaggauuaauucucaaggcccagcauccaacuggcagguguuuuagaaagagagaagguugucaucaaugcaacaaaucuaaaggcaauuucuaaaaauggaacggaagagucuccaaguugagaggcucacaaguacccagcgcaauaagggaaaagaccuacccugaggcaucccugugugaacuugcaaaagaucuuaaaagcuuccagacagcagccggaggauucagaaucagaaugguggugaacuucucagcagcagcacuggaaacguuauggcauggagcaaugccauuaaaaucgugaggaaacuaacucagccuggaaugaugcccagccaaucaaagacgagaguagaauuaaagauauuuucagacaugcaaggcuuaaaaacuuuggcucccaugugucauuucucugaaacuccuaaaggauguguuuuaguaaaaugaagggaaaagccaagaaagaagaaauugagagucaggaaacaggacccaacacaggaaagcaagcaguggaagggaauuccaagaggaucauggcgaagggaagucccagcggggcugccaagcagggggccuagaaagcagccagcccaggacggcugacgacguaggagacggguggaggcccggguucugcuucucacucccagacugcccuuuuaccuuuauucagcugauaucuagaccuggauugucucagcuguaacauggagauaauaauaccauaccugauuguguggauagauuauagccagccggugacucuuacacaggauagcuuacuuaauucuuaugacaaucccauaaggucagucaaugucauccccacuuuacagauuagauaacugaggcccugaaugguuugaagagcuaauaucuggcccggcacaguggcucacaugugucaucccagcacuuugggaggccaaggugggcggguugcuuugaacccaggaguucaagaccagccugggcaacauggggaaccccuguuucuacaaaaaaauacaaaacuuagccaggcgugguggcucacggcuguagucccugcuacucgggaggcugaggcugaagaauugcuuaagcccaggaagcggagauugcagugagcugacaucacgccccuguacuccaccugggcgacagagagugagacccugucucaaaaacaaaagaagcagcagcuaauaucucucuugggaggcucagaguccuugccuaggcaggcccacuuggagcacuccacaccauggaauccggacgaaacuaacuugucucaguuaacaaaagggcagcugcauaguuaaauaaaaggaaucccuccuucuccuuuauaaaauuuccugcaaaagcagaaagcagagcagggccugcauguuacagcugguacauugcucaccacccuguggcuuugccaguuuuuaauacuucacauaucacugcagguccuaguugcuguccagcuuucuacagagaguaaagguaucaauaaagguaucuguggcagugauuugaugagcacccaccgguguagcaaucacugggcuaugcaugaaggauacucuguuucauuuauuccucuuggcagcugugcaggauaguuuguaucaccauccucuuaaggcacacagucacuuacagggcccuuagcuagugagggacagaguugggauucaaacccagguauuaacacuccaaacccaaguuguugucauugugacauuuaaaggaaccauggccucuugucaccuucuugacugaucauaaggguucaaguuucaacuugcacuuuauggaagucggauuguugauccuauuuccuggcaaagaucaaagagagagaaaauuucuuacaugagccaaaauuagcacucaccaugccugguuuuccaggccagcgccgguguggaagcugcacagccagaggaaggcccaguggcggcuccugcaaagcugggcaaauggggagcggauuauggcggaagucuccuuuuuuggaauuuugugcaccauucuucuuccuguuuuuggucacaucuggcuuaucucauaucuuccaagccuugcuuuugcuuucccucgggcauuuaaaacauuucaguucugucuggcuaagacucacagugcuaccucuuguccagaaagaauaacaauuaccaccuaccugcuuggaggcgugaaagaauguuuauaaagcaguuggaagaucuccagagaaaugccagcuuaauauaaagcaagauuuucuuacuaaugggugagauucucaccugcagaagucugugaauuuucucugcggugaugcaggaugaaagggaaaaccagacggcuccagaaaugugacaugugugaaauuaaagugcuuaugaagucagccuaguuucagggguucuuuuccucuuccccaauggaugugagaauccuggaaagacuccaagggccaccucugugcugagaaguggcuuucuaaugaaaggcugcauuucagggcagguuucugaaagguuuguuacagauauguagucucugucuccaguguuagaggauuguuagugaaagauguccucacggucugcagaacccgcuccacaugaagaucagcauccauugaaagcaggagccaaugggugcugaggagaggacagaguugcagcaugagaucugaggugacccugggcuaaggaguuuucccucacccauguugauagaggaaauggaaagcucuaccaagcaacguguguauccaucaucuuuuuuuuuuuuuuuuuuuuugagacggagucucguucuguuguccaggcuggagugcaguggcacaaucucagcucucugcaagcucugccucccagguucaugccauucuccugccucagccucacauguagcugggacuacaggugcccaccgccaugcccggcuaguuuuugguauuuuuaguagagaugggguuucaccacguuagccaggauggucucgaucuccugaccucgugauccacccgccuuggccucccaaagugcagggauuacaggcgugagccaccgcgcccggccuuuuuuuuuuuuuuuuucccaaacacagaugaugugaguuagaagccuuuuuuuuuuuuuuuuuuuuugagacggagucucgcucugucgcccaggcuggagcgcaguggugcagucuuggcucacugcagccucugccucucgcguucaagcgauccuucugccucagccucccgaguagcugggacuacaggcacgugccaccaugcccagcuaauuuuuauauuuuuagcagagacggaguuugacuguauuggccaggcuggucuugaauuccugaccucgugaucugcccaccucggccucccaaagugcuaggauugcaggcaugagccaccaugccuggccaacuuuuuuuguuuguuuguuugaaacagagucucacugugucgcccaagcuagagugcaguggcacgaucuuggcucacugcagccuccgccucccggguuccagcuauucuugugccucagccucccaaguagcugggauuauaggcgcgagccaccacacccagcuaaguuuuguauuuuuaguacagacgggguuucuccauguuggccaggcuggucucgaacuccugaccucaagugauccacccgccugggucucccaaaguacugggauuacaggugugagccaccaccuguaauaccaaaguacugggauuacaggugugagccaccacgccuggucagaagacauuauagcuaaccuuacuagggagguaguaagguucuguugggacaagcaguaguuuguggcuuucucauaugugcugcaccuggcagaggggcauccuggcuuggcugcauugguacuaguacagcaggacucugcccagugcugucaggcuuagguuaagugugagcugauuguccauauuaguaaggcuugucucgucacucaauauagacaucuugcuaccagagguccucacccucaguacuuccauagacuuucuccuaacuucuuguauugcaaaugucuuagauucuuaaaugucuuacuuuguuuuuuaauuaaacaagagcaaugaucauaguaucaucuuuuugggaggaagauuuaagucacuguuuuagacauaaacuaaugaacuaugcugaaaucuagagacauccccaguggcuugggguacgugggaauauccgcccuuggauuaguccuggacuauuauuagguguccguuucugacauuugcuuuuuaauauucugacacuuuuucuauugguugcccuuuuuccugcugucagugcuugggugccucuaaggucucuguuucacgaugcugcgagcugaagagcaaggugacuuggcuuguuagacuugggugcaaauuaggaguccauaggcuucgcuugaggagggcuugagggcuagggcuuugagugaggaggggagagagaguaccuugauggacuugcugacagucgcuuugggccccuagaaaccucugccauuuagauuuuggcauggccucauuuauaguuggaaauuccuuaucuaagacccaaaagacuucaacgcuaagcuauguucuauacucacaaaucucuaaccaaaaacaaaagcacauuguuugaucgagacaaugaacaaauaaggcuggugucagauaucuacauuuugguuguggcauagccacauaauagauuuccauuggacuuggauacuguuucuuuuugggguugggagggaaugcugugauacgguaacccccauacagagaaagugggagaagccauauugggcaaagauagcauggugaggccuugggcgugggagggagaacucacagagacgaggacugggcaccugcugggugcuauccaugcgcuggugcuguauggggcggugaccucuggcaacuccugccugggcaggggacacagaugcuuuuauuagaagacaugugccgggacagccacuggcagccugcggagcccugaggguacagcauuggaagcagggagcagugacuccccgcccugagcccugggucccugcuucccuggaucccugaggguggaggggcacugcaguauggcacuuguccaucugcacacaagccugcuugcaagguuuagaaaucaguuucuucacaauugucaaauguguguaggacaugcuguuucuguuugaaaguauuaaugaaccuaaaacaggguuuguuuuuguuuuugucauuguguguuuucuuaauugcuggcuauuaaagggacaacugccacgauguaggugaccucaaacuuagaaaaaaauuguuugccaaaucuacaagguacuguguggaauggcucuaguggggauguagauaggggguggaagggcuguaggggguguagauaugcgguggaggggcuguaggggggguguagauacaggugggagggcuguagggggauguacauaggugggagggcugcaguuguggggguguagauacaggguggagaggcuguagucuugggaguauagauauugguggagaggcuggaguaguggaguauagauauugguggagggguuguaguauugagguauagauauugguggaggggguguaauagugggguauagauauugguggaggggcuggacuagugggguauagguauugguggaggggguuguaauagugggguauagauauugguggaggggcuggaguagugagguauagauauugguggaggggcuggacgagugggguguagauauugguggaggagguuguaauagugggguauagauauugguggacaggcuggaguagugggguguagauguuaguggagaggcuggaguagugagguauagauauuggcggaggggguuguaauagugggguauagauauugguggacaagcuggaguagugggguaaagauauugguggaggggcuaguguagugagguauagauauugguggaggggccguaauagugggguauagauacuggugaggggcuguaauagugggguacagauauugguggaggggguuguaauagugggguauagauauugguggaggggcuggaguagugagguauagauauuggagggucuggaguagugagguauagauauugguugacaggcugcaguagugggguauacauauugguggaggggcuguaauagugggguauagauguugguguagaggcuguaguagugggguauagauguugguggaggggcuguaguagugggguauagauauuggaggggcuggagcagugagguauagauauugguggaggggcuguaauagugggguauagauauugguggagaggcuguaguagugggguauagauauugguguagaggcuguaguagugggguauagauauugguggagaggcuguaguagugggguauagauauugguggaggggcuguaauagugggguacagauauugguggaggggcuguaguagugagguauagauauuggagggucuggaguagugagguauagauauugguggacaggcuggaguagugggguauacauauugguggaggggcuguaauagugggguauagauauugguggagaggcuguaguagugggguauagauauugguggagaggcuguaguagugggguauagauauugguggaggggcuguaguagugagguauagauauuggaggggcuggaguagugacguauagauauugguggaggggcuguaauagugggguauagauauugguguagaggcuguaguagugggguauagauauugguugacaggcuggaguagugggguauagauauugguggaggggcuguaauagugggguacagauauugguggaggggcuguaguagugggguauagauauugguguagaggcuguaguaguggggugguagauaugggauggaggggcugugggagaguaucgauaugagguagagaggcuguagggggugggguuauggggguaggggcugugagggguguauauauugguggaggggcuggcguaguggggguguagacaugggguggaggggcucuagggguguagagagggaguggaagcgcugcaggaggguguauauaccacguggagaguuguaguacuggggguggagauauggccugguggggcuguaggggauagagauaccgggugggagggcuguaguaguggggguugugagugaaggaggucggggagccacauccgcagcagggaugcagaagagcagccgugucggcuugggugccugcgaggggccucagggacguuucccagacuuucuuaaaggcagaagagcggcugcugcagguggaggcauagggaccacagguguucacuguucuaagaaggguugauaacggaagaggaaagcaggugggaaggguuccuagggugagaggggcuugagccuguuucugggccccagggaaggagcuggaagcucaagguugaugagaaggaaaauggggggcugugagcuguggagauccugugccccuuuguccucggguugaugagcccagccaggagucaagccucugcuccuggcucgcugagggaauugucagcgaauugauagaaauucagcaugugcuuguuugcauuccuccuucuuugggaacuuucagccguuugguaaucauugcuuaaaaucugaagccuggcaccccauaucagugcccauauacuccagguuccagcuuagaaggcaugugggcaggguuuguaccauuggugccccaggggcccuggccggacauccacagagcaucacuggaaucgccuggggcuucuuagaauuccagccucucggaggccugcaaagccagaaucuuaguguguaggagccccaggcaauagcaggcagucaagcuugagcagcacugcccuggagcagagguccuccaagugcagccccugggccagcugcaccagcagcaccggaauuguuagaaaugcgcagccccagccuccacaccucaccugcaggguuguggcucuccagcuggagugcaucagcaucgccugcguggcuuguuagaccacaccuguuggacuuccccuagaguuucugauuccgcaggucugggauagggcccaggguuuugcauuuccuguuccuagucacgcuggccuugcuggucaggagccacacugagaaccacugccccaaggacagccuggguccagugcuuccgacucucacccuuggcgagauggagacuucaggugccccagguccuguggaggucagagcuacuuccuaaaccuggauucuuggagguaauacauuugaaaaaguacuuucauuucugguugauggcuucagcaaauguuuuaccaucacccgguuuuagaaguaguuuugggugccugaguccuggguucuccagugcugcccuccggcucccagaaccggccuucagcuggugucagugugguuguugguggcugacugacauguccaagcuuauccuuuauucuaguggagaagggggcagagggcccaguuuucucuccacuuagagccugaaagaucagagcuguugacugccagagaagcagcauuaagagcagaaaccaggucagcgauuuuccuccuuguucuggugugaaaguugccaauguguuuuuggcagcuggcugguuuugaucuuucaguuuguguuaaacacuuaggaucagcaugggcucccccuucuccuuuuuaauuaaacagcgacugugcugccagggacgggcugggcgcaucuguucaggagggcccugugugagagugcauagacgggagugugugcauacgugugcuugucugugugcaugcauauguguacgugugcaugcauguguguaugauagaccucaaggcaauucuguggcccaggggaucuguucacugacaccaaaaacaaaaguggccuagaugauuguauuagucuguucuugcacugcuauaaagacauaucugagacuggguaacauauauauaacacauauauaacacacacauauauaacauauguuuaauuggcuuacgguuccacaggcuguagaggaagcauggcagcaucugcucugcucggcuucuggggaggccucaggaaacuuacaaucauggcagaaggugaagggggagccagcacuucgcauggccgugggcaggggcaagaaugaggcgggaggugccacacacuuuuaaacucacuugcuacacaguaccaaggggcaugaugccaaaccagucgugagaacuucacccccgugauugagucaucucccaccaggccccagcuccaacacuggggacugcaauuggacaugagguuugagcggggacacagacccaaaccacaucagugauuuuccuguuuagaguuuccuuguauguaccugacgggcugcucuguguaaaagggaacaggagggcuuuucgauggagacagcaucuaggauggcagcaugugcccagccucagcuuagcuuagccuggccuggcagguguaaaccaucuugcccugugccagcaggaguuucaguccagccgucuuuaauagugagcugagaggaagagcucuggcuucacuguucuagccaacuccgcugcuaauaguugugugauuuggaggcaacguggaugacucaagccucuguugccauaccugcaaaaugggggucacggcacauacuucucagaguaauugcaaggguugaaugggauuaaagggcccugugucaucuggugguuuauucaggccauuuuagucaguaccuugugcuucucaaaaauacuuucugccuggauacccguucuuucagauaagcggccuuuagaaagaacagagagcuguccuuugaaccugccagucauacuccugccccaggaccuuuguguuagagucccguuggcccagagcgcacuucccccagguccucauguggcucucugccccgccuccuuugcgcucugcuccaagaccaccuuauaaaaaggccuuucugacacuauuugaaagagucuccaucccacaaaugaucauggcaucuuuauuugugguauccguaguaucccccaaacuggaaacaacucaaauguccaucagcaggugucuggcuagacggcaguguagccauaugauggaacagugcuggccaagaaaaagaagugaacuacugguacacgcaacuacaugaaugaaucgcacagucaugcgcagucccaaaaucaugaugcaagaagccagaugaaaaggcguacaugcgggaugauuccagauaccguauauaaaauuccggaaagugcaguguucucuggcaaagaagcagaucagggguugccagagacuuggggguaaggagcugggguugcaaaaggggcacaagaaaacauccucuuggggugagaggguacuuucccagucuggauuuuggugauagcuucauaggaauauccaugugucauagcauaucaagucauacuuuaaaugugugugguuuauugucuguccgugacacuucaauaaagcugcuuaaaacuuuucaaaagccauuuguccaaaguguuggugcccaauagaacuguuugcguugaugggaauaguguguaucugcuuuacugagucuagcaagucucuagccacaugugacuauugcauuugaaauguggcuagggcaacugaggaacucaauuuuuaacuucauuuaaguuuaaucaauuuaaaugugaagaggggcauguagcuauuaucuguccugugggacaucacagguccaaagcccacuuuccgcucuucaaugccugccucacacacauguuguaggccgugagcucuggcuccuggagguggcuggaagcuuccagcacuggaaggcuguuucacacucugauacccuuguuaaugcugcagccucugcuaagaaugcucuuaauugauacaaugaggugugaggucuuucuacaacugcccacccuuagacaagguguugcuuggccugugcagaaggugaauaggugguuugcuuucucugaagcugugcuuuuuccuauuuaacucuuaugacugagcagcauuugcucgaauuaaaaucuccccacauuucaaagcgucuuuucuaccucucaaguuucucauaaauugggcauauucaaauaagugacaugaugcaggcaagccucagguaagauccuuuggccauauuguauauuacaugguaacaaaauggcuuuuuaaaggaaaagcugauuauccucgaagagaguuggauucuguuaaggguuuuggaggugagcccugggaagaccuguuauuuucuagaccuuugaggcuagagcuggaaagauucugcccagugaccuuuggcugcuccuuaaaaauagcuaugauguaagaauccugucuagcuucaggcuucuagaugggaucccuuugggcaagaucauuugacaaagcagaauuacucacugccuaagucagaaggcagcacugcagcucccugggguggggcugcaccuccacacuuuggcuggaucagcagcuguugaucaguggccagagaacagagagggugaccugugaacugaagggugggggaaaguagaaagugacagaucuacaggcaaggaauuuuaagauccccaccaccaccauccacccccaccaaaaaauaaaaaauauuaggaaggacauugugaagagauggcuguuuggcuggcucuguuccccuccucugugccuucuggccuaucuuuguuugcucaucagcugugacauuagcauaaugauuuuguucuuuauaucuaauagcucuaugugcugccugccccacugacugaaucauuuuauuucuacuugugagaucacagaccuuugacuacuuacuuaccuugucagacauauccaagugaacucggggggaaaagcuaagacaggaaguagggguggggaaaggaaggauuguuauuuugaaagauugccugggcugggugugguggcucaugccuauagucccagcacuuugggaggcugagguggguagguugcuugagcccagaaguuugagaccagcguuggcaacauggggagacccugucuugacaaaaaauaaaaauaaaaaaauuagccaggcaugguggcucaugccuguggucccagcuacucgggaggcagaggugggaggaucacuggagccccacugugcuccauccugggugagaggcacucucucaaaaaaaaaaagaaaaaaaaaguuugccugcuuguugguccaacguuaauagcagugauuaagauuaauaauuuguauucagguugcacucgauguuuuaaaaagccauuuuacauaauauauuuguuaaaagugagucagaacauaagagaaagcccuaugcuuucuuggugcuaaggaaaauauucugguuggguuacccagggauaauguaauucuucccauagagcaugaaaaugucauuacucauaaauugagacuggagcugccugagcacaagggauauguaaucaucuucuggcugugguuuccgucccucucggccagaacucgaggauggcucguucggcugcgggccugaggcugcuggacacacagaggaagcccagagccugcccgccacucaggcugcagggcacaccugccgagaagcgcgucuggcccccacgcacuuguucucuggcccagacagagaccagaguggccauguccugggaaauucucccugagccaccaggcgugugugcuguguggauugcauacaccaagcauggaaaggcagaggcaagcaggcugauguccaggagucuggaagcuuuauuagugaagccaucgauggggauucuauuuauauuugugagauuuucuuuaaaaaguaaacaccuuuguuaagcauauuuuauguauuauaaaaaucacccauuucaaguguacacaucagugauuuccaguaacuuuaccaaguggugcaaccaucaccucaaauccguuuuaggacauuuucuucuccccuuaaggacccucauguucuuuuacaguuaaucccaucuuccccuuugcuccaggcaaccacugaucuacuuuucaaucucuauuauaauaauuuauuuucugauuagaaaaguaauaguuuccuauuuuggauaauuuaaauaauuccaaagagaaaaaccgugaaugaaaccagaaucccccucauugaccuggcaccaggcuucucucucuccagcugcugccuucugcugacuccucgacugccacggcuggcagggcccacaccagcacuucgaccacccucuaugccauuccuuuugcccagucuaccccugcccccaccucacgaugccccaucuuuugaaggucugucucacauccacugcuuaacagagauuucccugguauccaggcuagaaauaauguucucuucauggaaguuccaugaugucucaguccuggcuccucugguaucuaggcuagaaauaauguguuuuccuugaaguuccauggugucucauuccuggcucucagaguuuccacuugguaguuuacuuaccuaaacauggggcgugucuccccauucacccgaggggagaggcugucugaggacugagguccucacuagcuuguuuuuguuuccuaacucauccguacaccccccucuccugccaccacugcggccacauguggcuccuuuacaguggucaucagagcuguccuugcagccuggccaacaugaugaaaccccgucucuacuaauaauacaaaaauuagcugggcauggcaugguggcgugugccuguaaucccagcuaccugggaggcugaggcagaggaaucacuugaaccugggagguggagguugcagugagccaagaucgugccacugcacacccgccugggcaacagagugaaacugugucuuaaaaaauaaaaaaaaaagcugcaauugguuguugagugucucauugcccacuaggcugcgggcccuguucccagcauccagaggucacacucacugcugaaaugaacgaagaacgaaagcaagccgaccaagugggucugcauguccguggaguguucacucuucuccacuugaauguuuuugcuguaggucccaaagcauaguugaucucuucucacccuaaucuauuauuaacagcaccuaaguucuuauuggaauuaaauaacgaauaaucucaaaauagauggauaaaccaaauugugaugaauuucuuuuucucugcugcagagaaucuuguuuuucccacucacucguguacauucauguucauguguguacucccgcuucaugaaaaaccuaagauucucuuuagaaaugugaauuuuaacuuguggacacuuuuaacuuucuuccccacaacccaccuuaucacuggaugguucuggugccuuuggcgcugcccccgccagcugccggacagcgacucuaauccucccuguaggcugccuucuuucuugcacgugccuuguucuagaccgcacagcauuggcucccagccaggcaggguucaggaccaaauugaccugcgccggugacucugauugugguuuuguaugaucguguagaugagugggcagugagcaucucagggguuaguaacugggacaguuacccuuccuucuucccaagcccaggccagcuggccugaccaccuaaaaccuaagucacuguuuucucaccuuucaucaaugaggagccauuaguaucugugcaguguaaaauaugcuacuaugugguauucuuagaauuuuacauucuugguguguauguacauaauucuuccucugaaagggcaggcaucguguuucauuuaccuuuguaaauuuauuuuauuuuauuuuugagacaaaagucucgcucuguuaccuaggcuggagugcaguggugucaucuuggcucacugcaaccuccgccuccuggauucaagugauucuccugccucagccucccgaguagcuaggauuacaggcgugcgccaccucgccuggcucauuuuuguauuuuuaauagagaugggguuuugccguguuggucaggcuggucucgaacuccugaccucaggugaucugccugccucggccucccaaagugcuggaauuacaggcaugagccaccacacucagccuccuuuguaaauuuaccuacuguugcuguaugcaaaauaggugcucaauaaaucacuugaaugaaugaauucacacaugcauuugcuauauuauguuugguuuaagguguuaauagaacuaacauuuuaucugaagccccuguagauucugucuuucacauauucgaugcccaaaaaaauauuucaguauacugauuucuuccaucaauaauuuuuaagccucuauucuaggccaagccccaugcuaagagcucugguaaauauaaaauacaauaaagguggaugcuacccuuuagaacuuagugugugagaucacuaagaugaacacgagaagagccugccaagugccuuaaaacauuuagaaaaggggcuggguguaguggcucauaccuguaaucccaggucuuugggaggccgaggcagguggaucacuugaggucaggaguuugagaccagccugaccaacauggugaaaccccgucucuacuaaaaauacaaaaagccaggcaugguugugggugcuuguaaucccagcaacucgggaggcugaggcgggaggaucacuugaaccuggaaagcagagguugcggugagccgagaucacgccacugcacuccagccugggugagacuccaucucaaaaaaaaaaaaaaaaaaaaauagaaaagaaaauauuggaggaucugggggagggagggaucacauucugcugggguugcuuaguagagaagguggcguuugaguaacuccugauggaugagaaggcuuugaacagcagggauagggaagacguuuccgucgaauagaacaaauugagcacaugcguagaaucagggaaggagagaguucaguuuggagaaauaugaagaugaaacauggaaaauaaggauggauuguggagagugugaaaugcaggaauaaguaguuuagucuuuauuagggacacaaccccagacaagccugccauagcccugaagcggggaguggggcaggcagagacuaggaagcggcagcagggagcaggggaagccauagccuuaguccugagaaggagcagugaggcgcagccaaggcaguggacgugagaauggcauggagggaauguuggaagacgggucugcguauguaggguuaagaccuggaauuuguugagaagcgugccgcacggcuggguggcagcacuggggucagagaugacucuugggugucaagcaagugaggagggugggagagagggcuuuguaggaaggaagagcauuggaggaaggagagcuggcugcauacuuggggcugccugcaaguagagggaaauguggcccuggaggcgggaacugugacgggaguuucauuccucacucaccugucuggcugccaggacugucaaugacaguggaaaucuaggcgugcuugcugucguagguuacucaucagcacggccuucuguuuguccuuguuccuuccagucguuccuaagaccgcaccuuaaacugcgcuuuucagcauuuaaaaauuuaaugcuuaaggcugaucuuagcaagacauagcugaugacauuguaccuuggaggaaggccagguacgugagaaauguugaguuguuuaauccuagggcaaaaguuccccaaaaaaguuuauuucugaaaugacagucauuaauugaucauuuauuuagcagaauuggcuguggaugcagacguuauuauacaccuuaccaguguuuuccaaguacauuucuguuucuaauguaaaauuuaguccaggcgugguggcucaugccuguaaucccagcacuuugagaggccgaggagggcagauugcuuaagucuaggaguucaagacuagccugagcaacacagugaaacccugucuacaaaaacuacaaaaaaaaaauuagccaagcauguuggcccgugccuauagucccagcuacucaggaggcuaaggugggaggaucgccugagcucaagaaguugaggcugaagugcccuccaaccugggcgacacagugagacccuguuucaaaaaaaaagaaaaaaaaauuaguacacugaaugguguauagaaaucggaugccauauugcuuuaaaaguggugccauuuuaucuuccuauuuaagauaauuauacuaaaaauaaaacuuuccuuugcuugaugguaugaaugaauacauaaggucccaagucccucuucucguccuucuccuucucugggccuguaaucuagaagcccagagugucacagaagccacaggggcccagcagugggaacuggcccuuggguugauucaggggagugguccaagccugggaagugcgaaaguggguuucgagcucguuuuccacuugagggagggaaucuuuucaggcucagggcucugaguccguacuugaaggcucuuccugacugaaguuucgcaucuugaguugacucgcauuugaacugcugucacggagacuugcuugcuccucguguaccuguugguuaggaggcuuccauuccacccaauuuaauccaugcggacgguguguguccccacucuccugccuucuugcuucagggagaagaaugggggcaccaaggcucuugcccuuccuguucccuuuuaucuccuuugccuagcaacacccccccaacacacacccccucacaaucacacccucacucucacacccucccacacaccccccgucacacccucucauguccacucucauacacucucacaaccacacucacacaacaugcaaucauucccaaucacucacauccacacuccacacaaccacacaaaaucacauccacacacacacucaaccacacucauaccccacgcaaucacaaccacacaacacacaucccaaucacacccacucacauccacacucucaccacacucaacacacaccccacgcaaucacacccacucacauccacacucacacaaucacacaaccacacucauacacaccccgugcaucacacacacucauauccacacccucacacccucacaaucacagccccccacauccacucacacaaucauaucuucacucacacacacccucacacaaucauucacauucacccccaacucacauccacacacacacccucaaacacacacaugcucccucacacaccuacacauacucacauucucacacacacaugugcauucaccuuauacucagucacuuacacccuuacacacccacuuacacccccacaaucacaccccacacucaaauccacacaaucucucacauccacaaucacacucucacacacccacacacccguacacaaucacauucacgcacucacauccacaaucacacccacacacacccauacacacauuuacacacuuacacaaucacucacauccauaaucacauccugaaacccucacacgcccacacacacccauacacaaucacauucacacucacauccacacucacacucacauccguacacaaucacacccucacacacccauacacaaucgcauucacacacucacacaaucacacccuuagucccuuaacaugcucccucacacaccuacacgaucacucauacccacauucacucacauacacccucaugugcauucacucuuauacucaagcacagucacaccuuuacacacccacaacacccucacucagucguacacacucauugacacacacucuccguccccaacacacacacgucuuuucucauucgcacccagcauucgcucgugugccuuugcagcagacagaagacucugccuuuguuuccccugcuuggagcuugcuguggagacuggggccuggggcccagagcaccaaccccaguacaguccagcuuauggguggagccgugauugagagucagaaguggggguuuccuuuuauucuaggcuuucgacguaauucugucauugaauguuuugaaauauuuuuucuucacugcaaugauugucucuuuacaaacuuucuagcauaacaauauaagauuguuacugugaaauauauacagaccuagacuuuucauuagcccucuauucauuuguaagaugaaauuguuacaaagaauguaugacugaauaaggcacaguacaugcaccggccagguuuuagguggaggugaaucauuaucaaauguucucucuaauguccuugcuguccuuacuuuagauucacaaggaagcugaauaagaaucuccuuuuguuuuuguuuuuuagauucagaauaugaacaacauaaucuccuucccuuuggacaguuugcugaagggggaccugaaaggagugaaagggguaugacauugacacugugacaccaggggcagcuuuuacaccauguagagucacaguagcuuggccugccgggcagcagccacgccaguacguucucauugggacgauaggauggcucuuuuaucucagcuuccucugauuugccaucuugggaccaccuuucagccaaaaagguggugacuucuggccuuucuggccguccuguuggcacaacaaaguuggugaggggaggagacugggaagggaaagaaaacugcuauuuuggaaaaaguaaagaguuucggucucuccagggagcagggaaaccugugggaggagucgggcuuucuagcuggcacguugcccauuuagcacugggaaaggauccuagcaaggguguauuuuccugcugggaaggucgcagucgucaggcaugagccaacuuugucucucuguccuucagaggauguuggcuguuuaggacaugccuagccaccauaagcacgcaggccaggagcuguuuaagggggcagcagacggggcuggaggggcguuugcucaugagcacgcaggccaggagcuguuucgggggcagcggacagggcuagaggcgcguuugccaggcagcgcgcugccccugcgcaucgccagcccugacagacgugcaccacggaagggacgugauuguggcugccuucucgggagacucaaauucuuuggaucugcgcacgauuccugggucccaucggggaugacuggaaacccagucuugacccaucuccaggaccucuacagaggccucucagggucuccuucacagagugugcccggagagagcuguucagacacauuccccaucgagccuucaggggcuuggagaacaggucagcggaguuagcccaacucacgggcgggaaggcaucccaggcagaggaaaggcgcaggugcgcacagggagcagggcucagugcugcaugucaggcugccagggugcaggaggagccaguucgugcagggacuugugugccaggcuguggcacuugggccuuaccugaggccauugaaaagccaaaaaguagucaacagcaacaacaaaaagauuucugucucccugaagaaccccuuugaagggagcauaaauaggugaggaccauucaauagaauuuccaguggcucaguaguuuuugaggcaggcuuuaccagaguguaugaaguccugaauugcacacggaagagcaguaagagacccuaggaggauguggcggccuuucuauuucugucguugggcuuaaagcaggguuagaugugaugagauucaucuaucaauuagaguuccuuucuuuuagagagacauccugaaguauuugcagaugaaagguugucuuucaggauuuacuuucagauuaggcccagggcagggaguagggcacaggugacacaagguggcccaagagugucauaacuggguggcagcaccuugcuuuuguguacauuuaguauauucuauauuauuuuaagagaaagaaaggaaaugccaccacuggucuacuuaaaagcauguacucuugguucuuuauuuuucgugggauuacauacgucauuuauugcagaaauuaaugcuccuuucagggcuaguacagggauaaguaaguuuaucuugcacagaagugaaugauuagucuugccuaauuuauuauucuuuguuuacaggaucugaaaaagccuuuugauaaagcuuggaaggacuaugaaacaaaaaugugaguguucucguuuuuaaauuuacguauagguaauuugggauuucaaauuuaaaccaaccucguauugcuuaaagggauuguccaaauaaaccuuaauccagaaaagaauguuuaucagccauguugcugugguucauuuugaugacagauguguuuggugaugcugucuucuucuucuaaucuguuuucuucuguuccuuugucuaagaugucauagugguuauaggauguuauuuucaggaaaguucauugagggaaguuaagaccaauuucucuuaggagguauuucuuucuguuuuuguuuuuaaacacuuuguccauuccguuacuguuuuugauagcagggcaguuuucagacuucaucuuccuggugauuugugaaagcugcuuagcuuuguaucuguguuucucugaaauaccaguucccuugguuuuagaaagaggguucaauaccugucuccuucagauucaucugccaaaaaauaaccugaagaauggagaauugauucuuggaugugaacuacgguuucuacaagaaguagaauugguuuccugacccgaagucaaccaauagacaagacucuguugguugacuucaggcaguuguaacuuccccaaucacaguuucucaucccuagaguagagagagucgagcuacagggaauugaucaagcaaguaauuauggggggaauaauggcuucaauuauuuuaaauacuggaaagauaugaaaugugguguuuacuuuguaaucucugugucuuggagugcucugaauggaaauagaaacuuccauaugaagcuaucuguuaaacuaaaagguguuaugaggaagucauuucaaaucuaaguacaaguauuucauuagauuguuuaaaaaaaaaauagcucaggauaucuuuccaguggugaaggaucacaaagcucaaaucagugagccccacaccuuugauacuccuucuauccaugggaaucuuacauuuccauacccgagguugcuuggccccgaguucuggaguuucauugaugguguacauucauucagaagcacaggcagaguguugacuagagaacccugcagguccauucagcccagggaggcccccacccaggaucccugguccgucagcauccuuuauuugugugccaguugggugaaauaaaugggaagggaccagcggauuccugcuuugcagagggaaaaccaagagucagugguuucugcuugucagccaguaagaguaauugagccaggccaggaagcagcuuucccacuucacucagccucccuugcugcccgucucuguggcugauaggaaaugguccugugugugacuagaccaagggcagaaagggcuuucugaagaagagugccugagagagucaucugguucugaaaagaaaagguuuggaagaaggauaacaucaaauucuguaaaaucgagacacacauggguaggauggggacagaauuccucacaaaacccuagaauuuaggaggagggagcagcacccuuuaaacuugaaguaauuguaggauaaauaaaggaaauaauucuuuauuaaugugggagauucauuuaucccaagagguuuugugauauguaacaaccauaauagguuuuagaugucuuuaaaauuccugggcaguagucccauaccugauuauuaagagaaaugaccagugucuggacggucucuugccugugaaggagugucagcgacaccuuggaguuguauaauucuagucccagggacccuccagucacacuccuuuccggaugcauagacucauuaaacaacaacaucccucccaaagggucuccuguguguuuauuuuucacucauucacuccuucaaauuauugagaaccuacacagugcaggacacacagagaaaucacauuucuugccucuucuuaaacacucuaguccuccuugcccuaaugacagggagcccucuggaacccugaguagcccauuucaucacuggaugccuuugaaagaacaugcuacuugggucuucuggugucuacuucaggcucuacagaaagagcugcuucccuugucuucauggcagcccuuucuguuuuuugagugcuuucuguugguuuuguuuagucuccuuuucuccagaauaaaaacucacggcuauuucaagcccaccuuagcagccacgauuacccugguggcucuucuuuggaugugcucauuggucaguuuuuacccugaacugcacacucgacauuuagguaauacagguuaggcacaagaugaauguagaaaggauaauuaagccgacagcauggaaaggugguuggucgucuucuacagugaugagcgguguuguaggucaaggcagagagcuggccuggcuucacugagugaggaggugaugacagagacuagggaggaaguccaggaggagaaacaguggguagggaagagucagacggugcccuuggguuacuagagggcaggaaggcucugaaugcugaugccaaaggagcccuccaagcccugugcagacuuccuaccuccucugacccauaccugacucaaagcaggugccuaggaaauacuuguugaguaagugggaagacccgguuugacaucuucgugaggacacccauuuuccuuuugagggaguugagaggcugccugugcugaaacguguggugagcguuggucucgccaggcuggguacugggguggcuucaaggcugucccguugaguucugugccaacaggcaucuugauguauccuugcuuucacacguagaaccaagauagaaaaggagaaaaaggaacacgccaagcuccaugggaugauucggacugaaauaagcggagcggaaauugccgaagagauggaaaaggagaggcgcuucuuccagcuacagaugugcgagguaaggcgguggugaaggcagguccuacagcccaggcugugccggcucugcccucaccugugggagcaucucaccgguaccagcggcuucagagaaaacaccacaugcauugcuggacucccuuugccccuguguugacauuucuuuuacuagggaagcguuagccuccuggaggguagaauuagguuacuuuaacaccaacauuuucuuaaaaguagagaaaaaccacuaaaugucuagaauguucuuucuggcuucacguacguacucuugcuaaaauauuuauuccuuggguguauuuaaaugagaucucugaguucccuuguaccaauggagucagugacuggcuugugggagggugagaagucagcugaaaacaacauacagcgaugacagaccauggccugugucagugucugugaguggaugggaaguccagucaccuguuuugacuuccugcuagaccucaccugcucaggcgggggcacucaucuagcccgaaggcccagguggccuggggagcgccucucugcuccacuccauuccacccgcagccucagcccuucccuuagugaggcggagacagcaggauggacacucucagagcauuucucugagaucagagaccauggauuaugaaggccuuugcucacagauuuuuuauuuuugugccuugcuugccagguacguguauacaaauggcacauggaaacagcugccaccucugccugggguuaauuccuccuggcagugccagcgaagcucccuugcacuggaugguauuuguuucccucucauagcagugcaaacuuagguuucaaauguacacaaugugugggugauguuugugacaggcacugaaacuggcauuggccagcucuuaauucccucugagcaaucaacaacaaagcuaauccagaaggcacuuucugauuuuggaauguauguuuguuaauuguagcaggagcuuaacccuuauaaauacauauaucuuagaaauguauuuaaaugaguuuuuauucccagagcagacucuuaaguggucagcagagaggaaucagucccaggaaucaggguggcaguugaaaguuaaguccauuuugucuaauguuagaauaucuacuuaucuuagccuguuuucuguugcuauaacugaauaccugagaauggguaauuuauaaagaaaagaaauuucccaguucuggaggcugccaaguccaagguugaggggcugcaucuggugaggaccuucuugcuggugggcgcucugcagaguccuaagucagugcaggacaucacauggugggggccucacaagagacagccaaacuggcuuuuuaauagcagacacacucuucucauaauuguaccacucccccaguaauccaugaauggauuaauccacucaugcagugaccucccaaagguucuaccacucaacacugcugcauuggggacccaguuuccaacaugugaacuuuuaggggacacauugaaaccauaucaccacuccagcucuuuugguuacuauuugcacccuuuuacauucaaccugugaaucugaaguguaucacuuauagauaauauauauagcuggaucauguuuuucuuaucaguuugacaaucucugccuuucgauuggauuguuuaauccauuaacguugaauguuacuauugauaugauuggauuuacuucuguuauuuuacuuuuuuuuaugucugucucgugucuuuugcuccuugauuccuccuuuaccgccuuguuuuucauugagagaauguuuagagauauucacuagaugaaaaacaagcaaauauuuuuaaauauucacuugaugaaaugaauucucaagauaaagccuuuaauuaaacuuaaaggguucuuauagacaggagaauggauguuuuuauacacauuuuuuuguaaacacauaucauguguaguguaagagguugcauucucaaaagaaaagcacauaccauguauaauaccaccuuccuggccuaccucauagaguggcagagaaaucagcgagacagcaugagacagggacuaggaaacugcuguguguuauacaagcacaaaguauugguuuuuguuuuuguuuuucucaauccugcuucuguaaggguauuguuucuaauuaaguacuguaguagcauuuuacaaacaaucagggugaaauuaaguaguaguguuuuacaaagaaugaauuuggaaagggguguuuguguucaggucaugcucuuuuugguuaguaaaguagacaucuauuuaccuaaacacuuuaagacuacuuaaaaugcguacugaauuuugacauucaaguaguaugugaaggucauagccaugacuugaggaguaauugguuccccacuuggcucugucguugcuuccugugguaugcaccuugcacugguuacuacuucucuucuguauccaggugaauugauccugugaacugacuaagucauuuauuuuaauggaaauacacuguguagaugaugccucuaagucauagacuugagccaucuuucgagcaguccucagguagugcuggguccuggcucugcagagcuggcacuuggaggggucaggcacuaauguuucacaguugagugagagcuguacuauaugcaugcauaaaagcagaggugggcuuaucuaacaguaaacucacaguuuucacaggagaagacaucugaugaagaguguagaaguuggccagauagucaugggccgugaaggccuuucuuuccaugggugagaaagaucauuugaaaaacaguuccuugagaauccaacucugaagugaauuagauugccugcauuaaaaucauguuaaaaggccgggcaggguggcucacaccugcaaucccagcacuuugggaggcugaggugggaggauuccuugagcccaggaguucaagaccagccugggcaacauggugagaccuugucucuacaaaaaaacaaaaacaaacaaacaaacaaacaugacuuuaaaauuauuugacuguuuccccaaacugaaguucucaagcuuuaagugcuugcuguuguuuagguguuuaaaauuugaguugcccaggaucuaauccagaagaguggcuuucaggcuuuuauuuuaaagcuauggagcccuuucuucaaaauucauuuaauaaagaaauucaguaugucaaauagguaguacagaccuucugugagcggagaaggcgugagaagauccucuguugcugauuguaaaaauaguauauacuuuuaaagaaaauugguuaauauaagaaaauauauauaaaaggaauuaaaaaucgcccccaaauuuuacuuauccaaagauaaccacuuugacauuuaaguaaacaucuuuauaugucccuauguauacauucaaaaaaaaucguauaaguagaucuuucgcugcugaugcuuuauaaccuauuuucacucucuaguauguugauguccaugucagaaauuuuggguuuuauuggcuuaguggccgcacaguauuuucuguauggaugcaccauauguuaauuucccacucauuagguuuggacuguugccauuguuuacuuuuauaaacaggauagcaguguaucuucuuuucuguucaucuuuguaaacuuuugugguuaucuucuuagaauaaauuccugggaguagaauuucuaggucaaaauguacauacguuuaaaaauuugauacauuaccaaauauuuaauaucaaaaagaaagagggaaagaaggaccuauaggugguuguuacaggcagaaggacaauuuguagcuuacaguuucacagcagcuuuccaccuccuccuugggcugcagagagaccucagccagcaacugaacuuggguaccccuaccccacccccgcccauccuuuacagcugagagccagggcaugaaucagcagcuuuuccaggggacauuccauuucagagaucaucuucugacagcggaggggauggggacucaugaaguccuucuauuuccugacacugguuuuguagcucccugaggcuuucugauagcuucguggucacuaaugaauucuccaaguuaaaaauagcuuuaauucauuucaauuaaacuuuguuuuuuuccaacaaucacauuauuuuccuuguaagggaaaugucucaggacgagagacaugaugccaagcaucucagcuacaauacguuagcaguuauuguuccuaaaguaagggaccuugggcaggaguguguuugagaugguuagaaaucccauuuauuugaaccauccauagucuuccauguagcuagagugaagauuucuccuagcaggccaggauagacugucuuauuauuaggaguuuuuggcacuucaauauuuaauuaucugacugucagauaauucauauggccccaaaauaaagaaacgguuacggaauccaggcgauacuaagugucgaucaugcacucuacgcauuguaaaagaugccaaagaaguagaagaaaucaucucaguccucagaagcuccuuuuaaacucguauucugcuuacuuccaugacauuuccuuuucauuguucaacaguaucugcugaaggucaacgaaaucaagauuaaaaagggaguagauuuacuucagaaucugaucaaauacuuucaugcccaaugcaaguaaguucuucucuguuauguuaucuuaaauguuuguucauguguggcaacuucugguagaucuauagauagcucauaggaaauaaacaccacuuagaagucuauaguaaagggaaugaggugcugacucaugcgacaacacggguaaacauugagaacacguucaaugaaggaagccagacacaagaggccauguacuguaugaucccauuuauuuggaaggucaggaauaaguacauccacagagacagaaagcaggugagugauugccgcagcuuggaggaagaaggaaaugggaaauggcugcuaacggguauaggguuucuuugugggauauugaaaauauuccagaagugagugcuaaugauugcacaacuuugugaauuuacuaaaaaucacuuuaaaaggaugaauuuuauggcuuuauggcuuagggauuauaucuuaauuaaaaauaaaagcauauauacaacauaaaaaaucuguaguaauugccagauauauuuauuuuuggcucuuuuuguagagggacaaacucauuugaccuauuccgcaacucucagauguuuguuaaaagagaaaugauacgauguuaaugcaguguuuuaaaauaagaaaacacuuuuauauauuauccuguggagccaaugacugugaugagcaaaggaagauguuaguagaggagaaggagaggauuccacgugcaggggcugcucaaguacucagcuuugccaucugugucaguacuucagucugacccacgucucugaccuggcuucugcuccucgacccccagucacugauauagacaggccucuggcuccuucacucacccacccaacacacaugucaggugcuggaccagaggcgagagacacagugauguacagugcuggcauaguuccuacucaaagagucaaguagggaaguuagacugaaagagacaaauuucuaauuagauguuuacaaaauuguuuuaaaguauaggaaucuaagaaagaauauaauacagggaccugauuuagauaaagauuuaggguagaguuuuuuguuuuuuguuuuucuauuuuguucccugauacagucuccaacagccagcacacagugcccggaacacaguagguacucggcuguuucuugaaugagcugcaggccucucugaggagacauggaucugagaucuaaaguaugaguaggagccggcagauaaggagugggggaagaacauuccaggcagggucuaggucuuaaggcaggaaaaaggccaaggugacauaagcucagugaaaaaggagaguggcgugaaacgaaacugcauggaaaagccuuagggauguggauggccccagacaucuugcaaaaguuuuuagauuuuaucccaaauauguugggaagcucuugaagaaauugaagcagaggaccauuuguaugcacuccugugaucugccaggcgcuauuagggguuuuggugaugcaguaaggaggaaaacaaaguucuugccuucacggacccuggggucucaugggggaggcaaguaggaaacacgagccaauauuuaacugaguuuaugaaaaggcaaaacagugauggggagagagacagugguguugguuagaagcagcuucaggaagcuucucggcuguaacaagauuacucuguguguuguggagaaggaaccaaacaggacaaggguggaugugggcaauugcuuguguacacagcuccugucccugugcagaccagagaugacgauggcccaccuggcuucgugacagcgggaguggaagguguggacugacaagaaaucuuuuccuuguggaauugccaugccugucugcuuaccuucccagagcaggcugugccaccagcagccuaccuuuguacagaauuguuucuuuuccuagaaggccucuuuccuuugugcccucccugucuucuguuccuccuaggacccagcuuauggaucauuccugcuuugcgaugcuucuuccuuuuggaauuccuuuucuuccuccuguguugccaccacaccgucugcuugucuccaugaugacaucuuccuugugucucugugccacugaacuauaugcucuuaaggaaggggccaugccauuuauuuguuuuauaucuacaguguguggcacauuuaccuggcacguauuugcagcagugaauugcacuguggaauugaacugagcucugcuuuggaauucuuaauacagcuuugaugauguugcauuucuaaagcacuugaggucaggcggcaaaggaggaugugcugagugguucauccaaaguuaaaagagagcuucagccauuuaaaaaaaagaagagugaaaucaugucuuuugcagcaauagggauagaacugaaagucauuaucuuaagugaaacaagccagccgcagaaagacaaauaucgcauguucccacuccuaagugggugcuaagaaaggcauacccauggauguagagaguagagugacagcagagucucaggagggugaagggaguggggaugaugagaaauuauuaauacuuaguagguacaauguauguuauucuggugauggauacccuaaaagcccuaaguugaccaccaggccuauaacaaaacugcacuuguaccccaugaauuuauauuaaaaaauauaaaaagagagcucaucucuacuugguggaaaagaccuugcaauuauauaguuuucaagaugaauuauuuuauggagacucaaaauucuuacuuugugaugagcaugcaaauuacuucuacaguucuuaugucaggcaauuuaggaagugggucgcuuccuugcugauauuuuauuuuuaagaagaagcuauucugggauuuccuucccccgccccuuuauuuugcccaaaccagucaguuggguagcaacagaccacuuguggaaaagugaaguaguuggccuuuuauggacaugaucccaguaaccuuuaaaaauaugaaucuuccauuacuucguuuuuggauaugagagagaguguguacgcugccugcucuucaaaucagucaggcagcuuugacuuucucaauucacauucuggaggguacaacguggagcucgagcaacucagcugcagaguaagagcucgcagccgugcguguuuccacgugugggagcgccucucauucccccaccacacacgcccaguuuccgcuucucgcccccaagggcacagcuuugccugcugggugcugugcccugcuggguacacgcgggccucugcacacugcugugcuccgccagggugaagaggccacuguguaaaccagauuccagggcucagguuuggcuguugacccuuggaacuacguagauaugcguuauuuugcuuuuucuucucgcuuuaaguguucuuaaagaauacuucguguucuuuuauuuuuauuucauuuaaggaaggaauuuucaucucuaccucuuuccuggaauaucuugaaaacuugucuuauuagucuuugcuccugaacauugaagauccuguacucuagcggaaucuagaaguagggcauuauaacauuauaaaauaaagacagccaugguuuggcaaggcaugguggcucaugccugaaaucccagcacuuugggaggccaaggggggcggaucaccugaggucaggaguucaagaccagccuggccaacauggugaaaccuggucucuacuaaaaauacaaaaauuagccggaugcgguagugcacaccuguagucccggcuacucgggagacugaggcuggagaaucacuugaacccaagaggcggagguugcagugagcugagaucaugcugcugcaccccagccugggcgacagagcgauuuuuuuuuuucaaaaaaaauacaaccaugguuugaaagguggugaugaauguugaauugacuuguucuuugagccaauaccugcuggaaaccacugugaccagcuguugcucagugaacuuggaaugcauggucaagauaaggcucagccccggaugcugcagaagcuugcagaggagggaggggcgggugucacagacagaccccaucagcagacaccgcauuggaaugugguggcgugaaggcugcaggaggggcccuggcacgguguguggggcccagagaagaaaggagcuacucugcuugguggguuugauaauugccucuaaguggguguauuuuaaaggauagaaauacaccccuucuagccuggugaggcaggcuagaaaauguuuaauagacaacaaaauuugauuggguaauguugaugguaaaaguucugugaagcuuggaaaaguguuaaugggcucaacuuaagaaaauuuucuggggcuauguaguuaggacugucauagggacagcagccagcggagaaggaauaguguuccuuuucuugaagcuucuccugacgccagggcugacugcacuuugaaggggcgucugggugccaagacacaccucaaggaggguacgggaaggucagcacuuugaaaaaucagagggaggagauuuuccagguagguggauggugaagauuggcugggcuauuacagagaugaaaucuaaaucuaaauccaaauucauauuguuauuccaaguacaccauucaucgucaugcuggaaacagcauccugacgagaagucucugagcacuugauuccacuacggggcucaugcucacgcgcucucacucucgcucucugucugaccguagggagaauugccaggucgcaaagauucuuggagcuguacaccugcucccucucccugggugguuuugcauuuaucaccuguaauauuuuuccuacuccuuaucuuagaucuuagagaucucuguccuccuaucuauuucacaagaauuugaaaugauuaagaaaauaguuacauaaagaaaaacacguaaauaaaauacaagaauuagaugaguucagaaacauauucuauauucagaaaaaaacguauuaaaauacaggaacaagaguauaaaauaaagaaugaugugucugucuaaaggugaaugaaaacauucuagcauccugaccucugugacuccuaauaaacacuggucagaguucaugccccacggccugugugucccucuccuuccuccuuggaguugcugcauuaaaggccacgcugcaguguuuucacggcgccuucugugugugacgcauuuggucugagaaacacccauagagcuacugcugaguuuaaaagaaguaaacaucaccucacaugacauaugugaaacccagaucacuuuuuaaagauagucuccuugguaucuaauaaacuggcuaaaguuggugacaguccauccuucauuaaguuauucauucaauaaauggcaugugcuugaaauacaccaaacuuugcggguacuuugugucuccuagaacuucauaucuaaugagggaauucuguuuuaaacaaucacacuaaugaauacauaauugcaguuacagcaaguguuuugaagcaaaauacaaaaugcucugagaaaguauaagaaggccucuuauaggggaauaacuuguaggggauuauggaaggccucacuaaccggggauguuuaaccuaaaacuugaagaaugagugggaaucagccaggugaagcagacacaccuuaggagaaggcuuuagagagaagaaacagaaugcagagggccaggggcaggagaacuugguggucauggaggaagggagaaaaggccgguaugucuggaacugagugaaugaagaggguggaaugguguggauugaggcuggagcugcaucaggccucauuacagguuagaacuuucuccuuagcucguggaaaugcccguucuucauuccucucaaaaggguuacacacagcacccuccagaggcagcacugaacaccagcccauggcuccagcagaaaaacuuguccagccucuguuguauuuccugaaucacuuguuauaggugaccucacagcauugaguucucagccuuaaaauaaaaaauuccucuugauauuugaucucaaguucucuacccacgguuuccuaccccgcagacacaguguggccaccaaagcugcuugguugguucuuuucugcauuauuucucucucucucugucucugucuuucuccuuuuuuuuuuuuuuuuuuuuuuuuuugggagacagucucacucugucgccaggccagaaugcaguggcaugaucucggcucacugcaaccuccaccuccuggguucaaacaauucuugugccucagccucccgaguaguagcuuuuuguauuuuuguauuuguuuuuuuuuuuuuuguauuuuuaauagaguauuuuuagggguuuugcuauguuggccagcuggucuggaacuccuggucucuagugauccucccaccuuggccuccccaagucccucacccugggauuauaggcaugagccacagcacccggccucugcauuccuuuucuuuuccaugucgcggucgccuguugcggcacauucuucagugucuuccacuugcgccccauggccuuucuggcuucagaugcagaaccucucccguuauaaacugaaacucaaggccucauuuuauaugggucgagaaaaaucucaaauacuuaagcuuauugcauuuccuuuucuguucgcuccugcuaauuuugagugucauuuuauucuugguuugccugauauuuuaagguucuguucauacagucuuuucccccaggaguuacauaaugacuucagucacuuuaaagaaguuuuuaaucugucugacaaaauuauuuuuuccuuugugaaaugucaucucuguuucuucuuuuuccugcuaguuuuuuucaggauggacucaaagccguggaaagccucaaaccuuccauugaaacgcugucuacggaucuucacacggugaguagcuucccucccacugugguuuaaaaccaucuuaaugcaacagacauuuucaucuaaaugucacuucuguguaauccuguguuuucaugccgugccgcccacguggaguguggcguucccacgccuguccucugucuuggugggagggaagguuugaccagcgagggaggcaguugucgcauuguguggaaauggccccaugagcaccaacguuucacuguaccucagucuuaauuuucugauugguucuguuguguguguguguuuuuaaagaucaaacaggcccaggaugaagaaagaaggcaguugauacagcuucgagauauuuugaaauccgcauugcagguugaacagaaagaggugaggggauuuaauuuugaaagauugcaguuuucaccccauucuuggaggcuuugggucugaagaacaugaaguucaugucuucuaggagcucacaguucacucgggcugugucaggcaccaguaaaacauuuaauguauucuugcaauuuaguucuauaaaaccaucuuuuaaaauauguuuauuucaggaggaagcauuuacuacaugcauggccuuaauggcgguguauaaacccugugcucugucaguugcuagauaaggagcucucaguggcuucgucacagagaccaugugucauuugugcuauuuauccuguaccuggcccugugucauuucccuacccugacauacguggacucugccccuuuaggccuaggcacguagcaggggaccagcuggggcucugccagcccugagauuguguucuauaaaauaugaggcaugagcuuuucuuacagcugccuccaucaugacaggcagaaauccuuaguucucuuacuuccccucuuucuguaaugacgucucugugugcuaacacgucagcagggacaguuuguguuguggggacuuguuuuuaaaaagccauuaaaaaguaaguuuuaaagauaauuuuacuauauuuucacuacaauguggguaucauaaugugaauuuaguauaaauccauuuccuuguuaauaaaaggaauguaucuaaacauauaucuagugauuuuagagaaauugcuaaacuacuugacagcauaaaguucccuguuggcaguuuggugagcucuauuuuauuguaaguucuuguacuauaacugaauauuguuguuuuucucccaaaugcguuuaccuuuugugaccgaagucuaggagaguaaguaguucaguauuuuaauaaauugcagaauuuugcauguuuuauucgugaacauacauauauauauuccuuuuauauauuaaugguuaguagcauuuuuuauuuuaaccccucaccuuucauuguuguagacuuuauuaaaggcugaagaguuugcauaaauauuagggaaguggacauuuucuggguuuacaguuuacacuuuugcugcuguuccuuuaugaagaugaagcaggucccucccucccucccuuucucuccccugaguggcugaauucuacacaucucucuagucccucugaagccccaccucuggagcgcugccucugaucaccccagcccacagugaucugaguucacagagcacauccuguuugaaugccccauuugaaucacagccuauuccucuuuuugaguguugguugugccuuaagugcacagauggcuuuucaccagcuggaccucgagcagccugaggaugccacccugccuucugagccauucuuccaucacacuguagugccacagcgcucauuuaguaggauuuugguaaacaugggucaacuaagugagacacuggcagagcaagguuauauuuagugcuagaaaggaccuacaacauggugacuuccuccuagucuagagaauguaggcccugacgcuuugauauucccaauaagcaaaaaaaggaaaaaaaacuuggcguaaggagaaaauagugggcuagcgguaacgaggaggagguagugcgagggcaggagccagaaugccguccaagguggcugcuccccagcgcaccguuggaaaugaucgagaacugccuuugucuaagaaggaagauccaacccaugaagcaaagcucagguuuaaaauaaggcagagcagcugcuggggccaaauggcccucugggcacagugcaaaggcuguguuugcuuugccugugcagaauuaggagguuugggaaaacgggcuguugugagagaacugguuauuuacagcuucgcaggaaaguaauaacaaauuuaccagcacagaccagaaguucuuuauaguuuguuguuuuuuguuaaccagcccaucugccccugauugcacagagggaucaaaugaaccuccuuuacuauucuucuuuggcugucugcccaguuggcuccuugucaagaccuaacucaacagucuccuaguugugggcguguuguguuuucuguguaucaugcucugcguugcuuuuaggugauggcauucagcaaguuggacaaucuuugaacacaguugcaaguaauaagcagaugugaaaaugcuaaauuuucuguuuuaaaaugauuuuuaugauggggguuccaucuuguauaccucaaauuugcaauaagaauugaucauuuggucauuauuguuuaggccgucauucccuuugguuggauuuucuucugugacuuagacaacugaagguguuaagaggauuuuuauucaguguuauaaaaauucuaacccucccuguguaauaacaguugauagaaauuaaguaacaugccccaaagaaacugccuugaugguugguagaagccagugcuccucauucucuuccuguaaaucccaagcaucaguuauugaaggaaugaagaguggccauuccagugugguagcuucgugcugcuguuuccuugugacccugcagcuuuguuuuaguguggagcuugugccguucuggucccggugaccucacaccucccaaucacuggccauucauguuuuguucuugauauuuucugcucucuguaaggagaauacuacucuuugguauuuccauuauuuuucuuugugaagguuuucauacuuggagaaaaguugaaaaauugugcagugaccacccauagugcaauauuauacaaugaggaucgaacuauguaccauaguguuugauuuuuggagaagauccuauuuacacaguuaaacucguuggcacugcucaucuuugguugagcucucuccccgucagccucgccuccugccuuccccaucccacgucguccauccgaugguguucugccaggauggacccuguuggggugcuggcggagucccaaagccucaucacuugugugcaggcucucucugcuguuugauguggagaacccagacuugugugcuucuauggggaggaucaggcucuggggcauggucucacaggucugagugcugaaaccaccaugguuuuccacucugcagaucucaaguaugguugcucucucucucucucucugucugucugugucugucuaucucucucugucugucucuaucucucucucucucucuuucucuugcucccucuuuuucaagcauccugucuaguaggaugugauagaacaguuugugccacccaggcagccaagguccaccacagccauaauuuucuucugccucuggguucgcguaucuuacaugcccaaaucuggccuucaucacagagaucucugccaggggccaccugccugccucuccugccaagcugcuagguagccuggcucuggccuccaugucacccucaguggaggacucguuuguugauucacacauccagcuacccuuucuuccacuguuacccuaagccagcacuccacaaacacaacagaacaagauggaucagguuaucaucucuucaggggaucaugcucuggggguggggacagagaagcaauuggggugcaguguaaugagagcacucguggacaucagcuccaggaagcagugucugcccagugcgggcugggcaggugccaucagggaugacuucccaaaggcugugauaccugggauggagcuuagaaggaugauuaggaguuggcaggccaggcaugguggcucacagcuauagucccagcacuuugggaggccaaggcagguggauugcuugaguccaggaguucaagaccauccuggccaacauagugagauuccaucucuaccaaaagucaaaaaaauuggccaguuguagugacaugcacguguagucccagcuacccgggaggcugaggugagaggaucccuugagccugggagguggagguugcagugagccaaaaucgcacugcugcacuccagccugggcagcagagcaugaccucaucuccaaaacaaaaacaaaaaacuggggacggggcaggaguuagcagagucccagcaggugaggcugguggagaggacagcuucugacuaggacgggguugccuggggagcugucuagcagagcagaagagcauggaucuuggcauuugaauccugggucucccacuuccuacccugcccugugacacugggcagguuccuggaccucuccaugucauggucuccccgucugucaaauaggaauaauacagccaaccucagaguuuucaggagaucuaagagauaauuucuguagagcacuuaccauauuaucuuaauaauaguaaaauuauuuauuaauaaucuuaauaaauauuaauaaacuaucuuaauaguucauucaacaaauacugagcuccuaggugguaaagauaccguagugaccaaauucccuucccucauggugucgcgcucuuagagguucaacaggaauggauacugcugcugucguugugugugacauaucccuuagccuccuuguugguccguccucuggcccuaugucuucauggcucuugccccucuuccuucuucacuaucugacucaagaugcugucauacccagcucuaggcuucuccucuuacuccugacccaggccuuccagccucaccugccucucacccaccucucuguguccagccugcgucacauuccacauucacucuaggggaggagggaccuguuccuauccauugcagggcauuuccuguuuaccucacuuuucagguuuuccaggcacuuuacaaguguggccaacgauccuuacaagccacuuuacaggguaggcaauguuugcccaugucugcagcuuuuuguuuguuuguuugagacagaaucucccucugucgucuaggcuggagugcaguggugcaaucuuggcucacuguaaccucugccuccuggguucaagugauucuucugucucagccucccaauuagcugggauuacagguacgcgccaccacgccuggcuaauuuuuguaguuuuaguagagacgggguuucaccauguuggccaggcuggucucgagcuccugaccucgugaucugcccgccuccgccucccaaagugcugggauuacaggcaugagccaccgcgcccggccagccaugucugcaacuuuauucugugagagagagaggauaagugcccuugcugggcucacacaguggcaucagagccaggauuugacccugaucuauuccaugucaaacugguucuccggagucuuuuaaaaauuacccuuaaauaauggagaauaggugguaacgauauuugaaagcauuguucuuagaccauggcucagugcuuggcucagcaaggcuuccagcucccaguugugcccauguggguggacauaccugucauaucuucagaagaugggggaaugaauuggacaucacagcccuccugggcagagaaauuuuaagcuuccaaaaaugacuccucgacaagcuugucaaucacaggaauugucuggacacugacuuucuaagaagugggcaaaaugucaguuuuuaagcuauccuagagucuuuagagucuuagacagcucaaggauucuacuggucaucugggcagauucuguguuggccagacccaauggcuaauacuucauagggccacagaaaaguuaagaucaaggaugaugccugagcucugagaacuugucugggugucacaggacagaggauguuggacacugauagaauuucaugaaagccuuuugagguuccaccaagugcccaccuacccugcauacucaggcacacaaacagucccugcacguugaggcuuugucagucgaguuuagguugucuucgucucucuuaggaaaguggagaguacauuggagucuccaggaauuggggcaacauggaccgcccuggccucucuuacuuuuuauguuauucuucucuccagaaggagagguucuuuuuccuugcauaguauucuaaaagucagaaccuuggucaugugaaagggccgguuuucucugucaggccuucaccuggucaggcguuuuguacaggcuaacaaaggcuauuguuacggggucgccugggagucaccuagaggauacugaaguaauucgcacuaaaacaguuucaauuuuauguuaaacagauuauauuccucuuuuuuacaaaugugaaguuuaauaggccagcuuaauucagauuugccugcaugcuucaauuggccuaaagaaaagaauaaaacagggugauuucauugucaccuucuggcauagggucugauucuguugagaagaaugucccuuauccuguucgugagaccugaaaaucgcucugauuaauaugcgcggcacgaacaguguuagcgguguugucacaugauuucaccacuuacuuugugcagggcuuuuuuucucccccaaaucaauagacguauuucuugguugugcaguugagucuccugacagguuuauuuuuagucuuucacagagacgcuguacaggugagcaguauuucuccacauuccuuccacagcauuguucucagcaacguugaaagcuggauuugcucuaaauuuuggugccgauguuccgcccuucugagaaaauguggaagcugggaccauccucaucccaugaaugcgugugugcccuaguuuauccagaggcucaagugcugugugaacuuucuguggaaaugaguucauuucuccccuccugggcucugcuuguuucaggguugguugucaguucaguaauggagagugccuccgcauguuacugauugcucacguggaguuuuuugguuuuucuuuuuuggcagaguuuaaaaagucagugcuagacacucaugugcauggguuggaagacuuauugugaagauaacaguacuccccuaauugaucuacacauucagugcaguccccaucagaaaucccagcugccuuugugcagaaauugacaagcugauccugaaguucauguggaaacgcaaaggacccagaaucgucaaaacaauccugaaaaagaagaacaaaguuggaggauucacauuuccugauuucugaacuuaccacaaagcuguaauaaucaagacagugugguacuggcauaaggagagacauauagaccaaugaaauagagcugagaguccagaaauaaauccuuacauuuagagaugauuuauuuuuaacaagggugccaaggcaauggagaaggaguagucuuuucaacaaauugugcuggggcagcuggauagccacaagcaaagaaggaacuuggucccuuaccucacaccauaaucacaauuaauucaaaaugagucaaagagcuaaaugagagcugagacuauaaaccucuuggaagagauuuauaaguauaaaucuucaugaccuuggauuaggcaauaguuucuuagauagcacccuuacaguacaagugacaaaugaaacaguagguaaaugggacuucauuaaaauuaaaaaguuuugugcuucagaaucuuuuuucaaacucagaaauccaagaggcugccugugccuugggaugcagucgaaacucugacuccagcccgucuuguccaccccugggccuuacugccucagaugcaguauuugucuagcuucccugggugcugaccacgugaccgugaccucccugugucuucuguguacuauccacuuugccuugaagauccuacccugauucugugccaguucuugccuucauguuuaaaacucgcuuuuuccugugcuuuucucccuuugacucuucaguuccugagugcucuuguucucagcuuccaucacacugauuuuccugcguuaguucuuucaucguuuggggaugugcuucguucuccaaggauggugagcugcucaguggcaaugaugagaguggcccuagacucugaggauguucuguggggaaagaagaugguguaauggaaggagccucagaguggaaggcaggauuccauuccacucucugcucuugcuuuaaggagcucugcaccuggagcaaaccacuuauuuucauugugucccuguuucucccauuauggaaugaacuggauaggcguucucauuaaacaccuacgagcagcccucggcccuuuccugguugaccugugaacacuugguucacaucuugcuccccucucguuuccuuuaagucucagggaaauagaauuuccugcacuggcacugguggccuccuacucucaacucagagugucugcuacuguuuguuuuguuugguuuuuguuuuuuugagacaaggucucgcucugucacugagguuggagugcaguggugcuaucaugacucacugcaaccucgaucucccaggcucaagcaguccuccugcuucagccucccgcauaccugggacuaccagcgccugccaccauaccuagcuaauuuuuguauuuuuuguagaaacgaggucuugcuauguugccuaagcuggucuugaacuccugggcucaagccauccgcccaccuuggucuccccagauguugggauuacaggcauaagccacugcgcccagccugauaucauuuguuaaacaccaguugagccaccuguuggaugccagacacuggacuugggcccuggguguucauugcuaguccucgcuuacccuaagaagcugauaggcuggaauuucccaacugugguagauucaaucagauucucagcugaccauguggaugguuuaccuaugauuaagcucccuuggucagggucagaccccccuuacucaagauugguggagggaggaagugaagauuuuugcaauacuuguugauguucacaugugugauccuauugaguccuuacuguuuauuggccuuacuggguauucuuuucuuauugcccaagaagggaacugaggcugagagcuuaugugaugguucuguaguaagggacagaaagcugguuuugucguuuugcuuggaaaccccugccuuuccacucacugcaucaccucccuccucgagggcuacuguggccguagugggagccucaugucacugucaggggguuaaggcucguaaugaaauaaaaccuggaaacuuccagggcucauuccuucagccaguuugggaauauugguuuccugacauuuccuucuccagccugauagauggcauuuaucaguuccuagagcagaaucugaugucccuuuuuugcuguguugagaaagggaaauuucuccaauuuuuguuguuguuaaaaaaaaaacacauuaggcauaaguuuccuuuguguacugcuuuucuaaaaauuaggaccuggacaagauuaaaaacacacucuucaccauuuuuuaggacucccaaauucgucagagcacagcuuauagcuuacaucagccucagggaaacaaggaacaugggaccgagcggaacggcagccucuacaagaagagugacggguacgugaggggguguggcuagaguuuaaauguacguucguuaucuuguguccaaaaugucuaaacucuuauuguuucucccacuuauccacaaggauccgaaaaguguggcagaaaaggaaauguucaguuaaaaaugguuuucugaccauaucccaugguaccguaaguauucucuuuuaauccauggugucugcuguauuaggugagguugguguuggaggacuuucugaaguuagagggcaggaguuguucuccgugugugaugguauuaaggaugugucuuagagaauuucccugucagaaacgcuugcuggccuccgucuugauuuggugcaccugcagccuguuuauguuuuuuuuuuuuuaauuuuaauuuuaauuuuuauuuuuuauuuuagccagauggagucuuguccuuguuaucuuccacucccuagcagagucaggaguaacugauaagccagguugucuuuauuuagaagccugugacuccagaaagcacagaacagcaaacugcucccccagcucucuuugucucuggaaaucaaacaucucacuuaggaagauuucuacuuuuccauuaagagaaaaaaaugggcaggacucuggggaccagaaauccaugagaaaagacaucucagugauuuuauuauugaaaucuuaacauauggugcccaacuuuaaggccucuuuccaucauccuguuuaucagagucuaugcaagaaaaaacggagcccucuauguugagcuuaugaaaagccggucaggauaaaguuccuuaccaaucuagcuuucagaggccaggaacuuggaucacagacacagcccugcacaccacacuguucuuuccauggcagcguuauacauacuauugccucaccuggcaugacuagagcuggugauaaccacaugggcugguagacagcuuugguaacaucucaaggccgaggucguugccuuuuuguugcuagagagaugcugaggguuguuugcauucccauuccccaagcagaggccuaguagugcaugcaagccagcagccuugggcgugugaguggaugauaguaaccgucuuuccugccccuugucccuccagucccuggugaaggcagagcugggcaggagcucagaggggcuuuucuggccccuauagaaaugucaucacucaacaugggguccagagaaacggcccugagguucauaagggaauagaguaaaaccccagccgaagcaugucacagcagcaaggauuguguuccucugggggugccuuuguuuuugccaacuucgauuuagaaagggagagaggagcuagaauaguauauacccaguggagggauucucggugaccucuggucuagggguuugaaugugucucugaacuuggaaaugaaggucauuuucuauuuucaaaacccagcuuucacuggucaugugaucaccaccguacucccccugcccccgcgaccccagggccaugcaguauggaucuuaaugggacauuaugggcaggugcaguggcucaagccuguaauccuagcgcuuagggaggccgaggcgggcagaucagcugaggucagguucgaggccagccuggccaacauggcaaaaauccugucuuuacuaaaaaugcaaaaauuagccaggcaugguggugcaugccuguaucccagcaacuugggaggagagaauugcuugaggcaggagaauugcuuaaacgcaggaggcagaguuuguggugagccgauaucacgccacugcacuccagccugggagacagagcaagacuccaucucaaaaaaaaaaaaaaaagccauucuuuccaugcguggaugugaggguaugaguucuguagaccaagggaagcaaauuuauccagcuaucacugucuuuaauauuaggaauguuagauuagaugagacuaggcacccuucuaaauaccuuccagaucucaacaccugugguucugugguuugcuuucgaauugguguccacucgcuguuuguuugaacuccgauugacugccucagugcagaaacugucauacaacuaaguucuaguucaugcuuuuacagcucugaagucaaggggcauauuugcuucauugagaguuccccuagauccaggccucagcuuaagccagugaguggcucuuuccauggcagcuggaaaacaggucugguaauccuuugcugacagcauaaacuucacuucgagucacuuccauagcuugagcuuccucucaaaagauguggaggcuuaguugucuuuaaauuuggauggguugccccaguuuuuggcagauaguacgguuauaaccggcauuacugggaugcugagaacucagcuugucacacagcgugugcauauuuaauaggugcuuuguguuuggaggggaaaacccucuccagggaaucuccacuuccagaggucuccuccugccuuuagcagccaucgccgccuacauccugcaggggugguagguggggcugucuugauucacuuccucgcugccaugcagaaaaauaaaguaguuuuccagcccuccguucaguggcugaguguuccuuuucucaccuuuucccuauuucccugcgugcucuggaagucagaauccagaggaccccucuguaugacugcgucuacagagagguugcauguggggaagugaguucacccauaccaagaaagagaauugagagaugcccuuuugguuugguuugguuuugacuugauuucuugugcagcucaccuguuuggccagcagcuccugagugugcucguuuacagucaggaaaaaagggcacauuuccaaagacuugauuaaguggaagucuaagagcagagccuggcacauagcugcgaagcaggucuuuaagaaauggaagcacacaggguguauuuacacugguaggaaaacccuucccaggaagcuggcagccucugggaaaugaaguuguuguauucugauuggagcagaggauugaggauaacauccgggagauucguucaaagcccgaguugaauuuccuucuuagccaagucuguuuucuggcccuaggaagaagugauccuugagacaaaauaacucuaauuagauauccucuuugccagauucgcaggauugccacaccacugagggcuggggacuguguuacacuggaaggaauguccacuggcucuuacacaaucuaaaauuuuaaaaaaugaucagucaugaagaaagaagaaaacaccuuccuucuaaaagccugacaaaucgggaaaaaauagaacggcacgauuagaauggagaaucacugauaaucucugccugcauggcaaacucuaaagcuguugcaucuuuuuuuuaccauuccuucccaaguuuucuacuaaacuagggcuucucaaauuaaauucucaagaaaauacugguauuuugugaauuagaugaaaccguucuguaucucaauuaacugaugacacuuuuuugucuguuuguuuguuuguuuguuuguuuuuuucuuuuugagacggagucucgcuguguugcccaggcuggauggcucacugugaccucugccuccuggguucaagcaguucuccugccucagccucccaaguagcugggacugcaggugcaugccaccaugcccagcuaauuuuuguauuuuuaguagagacuaaaaaucucuacuaaaucagccaggucaggcugaucuggaacuccugaucucaggugaucuaccugccucagccucccaaagugcugggauuacaggcgugagcuacugcgcccaggugacacuguauuuuuccaaauugcaacagggaaggauuuuaauggauagaauuuucucccauaaauuuuucuaauagcuuuacuguuugcuaauacuuaaucuauguacuuaauauuuaaccugaauagcaaacaguuauuaauguaaaacagaacugcuggugauauugcuuaagaucaacuuguguguuuuguggacccauucuuaugguugucauuuuuuaauauguaggcacauuuaugucuucauaaauuauuccuacuucaaacaaaggugcugaauauuuuucucuauuuugugguaugcugcgaagugagaaaucuaucuuugauaguaguuaagaacgaacaccuuuccccguaucacagggaaaaaggaagacugcaagguggagguggggagggagaaugaguuguaguaauuuaaguugugguucuuugcugcucuuaaagauaaguccaggcaagcaaccgccuuccauggauacccacgucgaggacagggaggguggcaguugagccccgagcccuggagccagccugacuuguuggaauccuagcuuccccgcucccuagcuguauaaccucaaccagauuauuuggucuguccgggccagugucuuuagcuacaaaauugguguaguuccuaccucaaagggcaguuaggaaaauuaaaugaauuauuucaugaaaaauguuuagaacagugccugccuuguauagguauauaauaaaaauagcugaguaaauguagcuauuguuauucaaagucauuauuuuguccaugaaggugcuucuguauuuaucaaagcacacaaaccuuagauauaggaguuauuccuauaucuaagaccccacaauuuggaaguagcccuaaaauuugcacguguacaguugugucaucacagggagguaacagaauagacacaggcuacguauggguggguguacacccguguuaaaguacuugguugcauacauguuuuguaaccauguuucuagaaauagaucauuugcuguauugguuccuggauaaguuagguaauccgauugguaacaauccacgaucaguggugcuuucacuugaaaguguccagauuuacaagauuaggcagagcuugguaucuucuaauacugauuucugacgauccaggaauucucugagauaucuacagauuauggagaauaucugacuaaccuguagaggaaaagaccaacacagccacgaaccaggagagucuaguacaacccuguuuaucugacuuuaucugacuuucacuaguccaaacuuacauuuauuaacccaaauccuucacgcugcaaggauggguucaacucucccacccuaacucuguagacuuacuggaaggaagcugcugggccuguaagugcuugaggguuucacaggucuguccagguguagaugcauauguguauguaucuggauuaaucccaaauucagguuuuuuucaucuugaagugaccgguggccaagggaaguggggcccaagaacgauggaaguuuaagacauucuuauuugaucuuuccuuuagcagcuugguagguggguaagauaagcccacucccauuuggauauuccuccaagauuucuaagagguauucugcuguucgaaauuuuuguuucugaaauuaucuucuuacccucaguccuuugcuuucuuggacuaaguaugaucuuuuuuuugaaacuguaauaaaauagccauuuuucauacaccucugaugaaaguauguugugaucgcuuggugucgugugugggggagaggguuuggggguuacagaugugaaugaaguauguuuuguugaaacuuaagugacagugaugguuggcauuuaggaaugugagucuguuaucugucaccacuucaaacaguaggaaaauaauuucucugccauuuuuguacugugaaauuaccuucacuggaagugagguuuaugcuaagaaaaaacgcuuuuaagaucaccagaaauugagcugggugcccaaguuaccuggcaaaucaacuguguugucgguaggaaucagaacugaauguuuugggcuuagccaugcaauaucuugaucugaaggcacccacugccagcagccucaaagcuggcaucgcuuguccucuuguccagguggguuuguguagaccaccaaggugcccuugcagggaggcaguugcccucuguggagaugaaguucaaaggccucuguaacuugucccagucaagccuuccucugucaagucugaaggccaccuuugcaaacuagugaagagcuugcuguugcuguaucucgugaggauugauacuguaugauuuuccauuccuuccacccaaccccaaccuuuuuuguuguuuuuugcuuuuaaacaggcuaaccggccuccugcaaagcucaaccugcuaaccugccaggugaagaccaacccugaggagaagaagugcuuugaccucauuucacguaaggcucccucugagaugccgcgccauagagacguugucuuaugcucuccucuggggcguccuucacauuucaaacacugcauucggaagaauugguuuuugaagagacauacccuuuuucuagugauaugcgugcuuuguguuccauuaguaacugcuggcuugccagccuuucuaguugagaguuugacuuugagggcuggcccugcuccuugggggcacuguaguccugagacauuaccuggcucucugagccucagcauuccuguuccuaaauagggagauccuacaagagaagcccacaagccuaaaacuccuucacuugaaaaagagagaaggaggacaauucuguuuucaagaacuuacauaauuugggugauguuagaaaugcuaaaaugagggucuucaacaggucccuugaaacuucaguguuugaaauuguuuuucuuccucaccacaggaauagucuuucugcuucucugugcuuuuccuuuuuguggcguucacaaaagaauccccacagaaccauccauuguggugaauguuuacucagcacccccuaaauuaaagggcccaugaugucuaaaagaaaauaagauaaaccuuuuuuccuagguaguucuguguggcaggguuagagucuaggggaagaaagggccagucuccccuuugaagaggcagucacuagggauuugggugcaagaguuacauuugcagaggaccacgccggacuguguacuguaggaaggcggugcuguucucugugccucaguaccccugagugggagauggcuaccuuuucaaaugucaguugaccuguauuauugagggcuaggaagucacuuguuaugugauucagcgcucccagcaaacugcggguaauuaucacuccaccucacccacaauggcuugcucuuauccucccuguuccccuucucauacccucugugugaaucucuggggaggguugagcacugugauaugugcagaggguuccaguaccauuuauucuguucuucagacucuagacugauuuguaaaauaaaauggacuuuauccugugucaaacacccauccugacucagucuaguaagguccacagauucucaucaaagcuugccuuucauucauacaagauguuauaaaaugcugaguacuggccagaguuuaaaaugugauugcaagccaggugugguggugugauccuguagucccagcuacucgggaggcugagguaggaggaucacccaagcucaggaguagacguccagccuugguaacauagcaagacccuaacucuuuaaaacacacacaaacacacacacacacacacacacacacacacacacaaacacacacaccacugcugggauaccugugucuagcuagcaaaaaaggcuugaauugaagaguuucagaaaaccugaugguguaaucugaugucugccaguggcuggggcuaacucaggguuuuaggccuuucuguuuucugaacuaguaacacacaagaagccaugcguuaaaaugcccauccuuaacucauaagcaauaauagugaaccuaucaccuggagguggguguagggacuucuucccucaacugcccuaggccccuccagcaugcuccacagggagacccugcuagaugccauaugugcagaagcacuugcuccaauguauucccagccuccaccuuuuuacaacacagcaggcagcagggaggaucaguagacggcaagugugcaugccucccuucugggugugaguuacugcagcccuuacacgugugggaaugcaguccucugugaaucuggccacacacaagcucuguggccaacugauauuuaccaagauccugccagugucuuugcugcagccugaugcauugaaacaucuucaggaaggacuuguagccugugaugcccagacagguuugcugagcccaguugggggcagugucgugaguuugcuagaguccauugucaucuuugaaaagagcucucaucccuccuccuucccugcuugucuuccaguggguaaaaugaauuccaguccugcaaauucuucauccucagugaguuuucaaaaggugccuuccuaugaguaucuguagugaaaaugguuugugcagggguauguggguuuggguugaaaacuggccagauaccccagagagucaucacaggaaaccuggcugcaguauaagccgugauuugaugaacauccugagaaggugagggacauggggucaagaccugauucuggcugauugaggagcaucugucuucaccccucucagauuccuccucuacuuccucaccagccucaugggaugaguaucaccaagaugcuuuugaacucucaagaugcuuuugaacugccugggugggccaggcaguggcucaugccuguaaugcaagcacuuugggaggccaaggugggaggauugcuugaggucaggaguucgagaccagacugggcaacauagcaagaccuacaaaaaauuuaaaaauagugcaguauggugacaugugccuuuggucccagcuacucagggagcugagaugggaggaucgcuugaguucaggagguugagguugcagugaguuguguucgugccauugcacuccagcuuggacaacacagcaagacugucuaaaaaaaaaaaaagacauuugggcaguuggggaagucaaguggaggcacaugcauugaggcagugagggugauauuuucugugugcaucugccaggcacuccauggucacccauuccuccucuuccucaucuggucaguucaucuuggaaucugcccagagaacucagaagagcaauagacuggcuggcugguugcaguuacuuccuacaagauguuccuuuaccauccuugcuccuaaacaggggcuucccauucucaugaagguggaauuggggccaggggcaguggcucacaccuauaguccaagcuacuugggaggcugagguggggggaucacuugaguccaggaguuugaggcugcagugagcugugauugugccacugcacuguagccuggguaauagagggagaccuugucucuuuaaaaaaagaaaaagauguaaaugagcaugggcuuuucuaggaggaugguucuguggcaaggccggcccuucugggagcucaucuaauccauugccugcagaccgaccccacucauagcaaauucaaguccugagccauuauccgcgaaccccauaggcacccugggagggauggaaggaacaguagaauugugaggugacccaagugaguccccugaguaggauggagccagagggagucaaugaccuuccagguccacauggcagguuagcggccaguagagccagagcccuggccacaagcugcccuucacuggccaccagcaccugagugcuccgaucgcccccucugucuccuccugcucuucucccucacggcugaagcucuggaagccguccgcuuauuuguagcaucuuuaaagagaguguaguggaggggauucuugcuugaaguuuuuccucagagguuugccuccugcuugugcaguuuuuacacgucagaaugcagaaauuggccaggugcgguggcccacgccugucaucucaguacuuugggaggcugaggugggaagaucgcuugagccugggagauugaggcugcagcgagcugugcacugcacguuugcaccacuccacuccaaccugggcagcagagugagacuccgucucaaaaaaaaaaaaaaaagaaaaagaaaaagaugccaugguguuguagaaaguggucgggccagaaguccaggaaccaaguucugcugcuggcuaugcuuguuuuuugcagcuuagccucucuaggcuucagcccucacccagucacuuaccaagaguuguucuaagaaccaacgugcuuucaggaguaaacaccacuacagagagguggcguguccacucacuuuuaggagcacagauguucguuguguuucccuaagaagagaauugguacuugucaucauucugccaucugcaaaagcuggauuccccugccccugcuuuucuuuauuaaauauaauuuuauuuuuugcuuugguuuuagacugcuuuuagacagagaauauccauauaucccuccccuagcuuucccuucuguuaacaucuuaauacaguuauccaguaguccgugguacauguuauccaaucauauuuauguaguuaucaaaaccaggaaacauugguuugaugcuauuaacuaaaaaucuuacucagauuuuaccaguuuucccccaaauguccuuuuuucuguuccagaauucuauccagaaccccauguuacauuuaguugugauuuuauccuggucucuugcagucuguaucgguucuguagucucacuuguuuuucaugaugccuucuuaaagaguauugaccuguuuuuuggucagacuccccuuaauuuggauuucucuaguguuuucucaugaguggauugagguuauauguuuuuggcaagagcagcacagaaugaugcugccacaucccacacagccgccucccugcugcacacacacacagguccacagccuggcaaaacacuuguaaaacugugcugacaccagcaguauguaaguguaggauuuuauauucgaccauuauuuaacacacuccucuugauuuagcuacauuucuaguauuugauucucaaagcauauuauucuuagaauuucucauacuaaucuuuuucugagaaagccagaaaacuucuaagauauucuuuuuaaaaaagguuuuuauuauucaaagggcuugaacaauuacuuuuugggggccaacucuguagugaguuaaaaugaagcuauugagaggauagugaugguuuucauugaauagcuucaguuuuuagaagcggcgucuuuuaaaacuugaaugagggaaagggcagguuuauuuugcauuagaaugccaccguuggugaaggcagacauuuggaggauaugagggagugccugauuuuauacaaaucaguaauuucguaacagagagcuaagauuauuccagaggcuaauuagaaacuauuuucuuuuggaauuguguauggauugcugucugggcucacaguugaaauuccucuugcuaugcagaugacagaacuuaccacuuucaagcugaagaugaacaggaaugucaaauguaaguuacaugguggugggacuuugggcuggacucagccguuguuuguggaauuuaacacagcguugcucuuguuuuucuagauggaugucugugcugcaaaauagcaaagaagaagcuuuaaacaaugcauuuaagggggaugacaauacuggagaaaauaacaucguccaagaacugacaaaggagaucaucucagaagugcagaggaugacgggcaaugacgucugcugugacuguggggcgccaggugacccagggaccccacccgacccugggcucuaggacauuucaaucccauucugauucacagaauccguucauugauuuucacuuucauuucaaacacgaaauuaagugcagcucagccugaguucaucccauuacacaaaugcuuaaugaacugugcagaccgcggcaggggagaggggcgggaagauguuugccugccgggccccagagcaggacugaguaaagaggguuugacagagcugcaaaguuugaaaugcuuuuugagaaaugaaaacugaaggguacagugagagugaacucaaggucaugugggcugagaggcugcauguggaugggcuuccuugcuuggaaucugcucucuucucccuuuauccuacuuugcagaacuucugaaguagcuuuaagccgcugucuggcucugugacccugggagagccacuugcuuuguuaaacaucgauuuuccugucuguaaagugaagggacaggacccuuucagcugacacauucugugaaauaagauuuuauuuuuacauuuugauaaagcauauuaggggcuuuauaguaggaugugauuuaaggaauuugcuuauucuaauugagacacaaugguggggagugggggucggggacuacacaggugcauuuucugaacauuuauaaaaugaaaaagauggaggcuuggcuagaaugguuaauccccuuuucauuccucuaauucuaugacaauuuuucuuaaaaaaccaaacacaaccaaaauaagaguggacaguugagaauuaccuuuagguucccaugacccugaagacuguauuuggccuuggauccauuaaaaaaaaaaaaagaauaccgacugggugcagugacucaugccuguaaucccggcacuuuggaagacugaggcgggcggaucacuugaggucaggaguucaagaccagccuggccaacauggugaaaacucgucucuauuaaaaauaccauaauuagcccggcgugguagugcgcacauguagucccagcuacauaggaggcugaggcaggagaaucacucgaauccagguggcagagguugcagugagcugagaucacgccacugcacuccagccugggcaacagaacgagacuguauuuaaaacaaacaaacaaaaaacccgaaaauacguuuuuggcaggagaugagguagggggugauaaguagugaaucauggucuuucuugagaaaggguaaagacagucuaugauuuggguguuucauacgcuuugauaaagaacucaaagguauguacucauuauuuuaaaaugccaagacaguguggguaauauaaaaaugauguagagucaccuaaauggaugcuuguaccuccgcaaagcacaaauacaguggagucguccuacacaagugcagacacagacgccaagaagguuuuccaacauggauaacauuuuuaauaacuugaacauuuaaaaaauaacuucaugauuuccuacugacuaaaguugcgauauuuaccugccgugaguuucucagggcaacaaacaguucugaagagaauuguauuuauggguugugaugauguacucaaggacaucuuauuuuuaauuucccauuuuuagcaaauuccacauucaucugucaagcauuuugugggucccuaucaucugcuaaauguaugguaggucauguuagugaguagccgagcugugaggggaaaacguggcuuugaacucagguagaggcagggccacagucugcucugcacucccuggcgaccucgagccugagcaucgcaaagcugucucugccauauagugagauaaaaaucccugcccuggucaucucauggaacucuuagauuugauacaaaagugcucugugauugcugaagcucuuaacaacacaaacuguuauugcuacuaccagcaugcugaacacagcauaucuuauguacauaguacguucucuguuauuaucagcaucuguagaugcauauguuuuaagccuauuccccuuuuacaaguagacuuuggcuggucucauuguuuuccucuugcuccauucugcuagugugaccaaguuggugaugggcaugguguguuuucaccaccagccauugaggagcccuuggucacuggaguguguccuguuuauuuuugcacacacagcaccugucacaugaauggaaggauggggagauggagagagagggaagaagagggagaguagaugugugcauauuuggguauugcauguaaauuggugguaauuauggacaaaguuuccagcuguguuaaggaucagaaaaugcucaugcucagaacugcuuguucaguaacuaugcaggaagaaagaugugacuccugacccucuuuuuuacuggaagcucaaaucugcccuguucucuuuggcagauccuacauggcuuuccaccaaccugggcauccugaccugcaucgaguguuccggaauccaccgagagcuggggguucauuauuccaggaugcagucccugaccuuagauguacugggaacaucugagcugcugguaauuuuuaaauccuugauuucagauuggaaacaaaugagcuguaagcuaaauuuuacuuuuggcauucuaauccauuuugguaagcuagugguuguugauauguugccagauugguuuggauaauuagaaacucauugauaauucuucauuuuuagcuacuugugguugagggcacuucuuguugcaaaacuuuauucuuaaaugaauaaaggggagugaaaccaaaacaggagcauugagaguggugugagauucuacagaaauggaguaagauggugacauagaccagcucaccccauccauuagacagauguggaaugcaacgucuaaagacaggaaaguacuuguuuucccuuaucaccagcgauuucugacaaggcuguggugacaacuugccucaagccuccgacuucucccuaccccagauugucccccauggggggagauauuggucuucauuuuuacugccuuuguuucuuaagucuuucauucuugguucagugguaacacuuaagccaugugauagagauaggaggagacagaagcauuuucugugaaguggcuuucaagaguaucgagacuguagucccacaagguccaucagacagggugcuucuggccaccuaauacaugagcuuucaugacugucuucccuagaaagcaguucuugaauucucuccugggauagcuggauguugacaguaaacaguaaguagauagugauuggcauugauuuuaauguugaauuuaaaaguuuacauguagggaauuuaacgucaagagcaauagucuugacagaaaaucaauaguuguggaccauguuccucucaaggggccaucagucuuauugaugacuucgaauccagugugucugaacuucgaaugcauuuugaacucucuugucaaaccuuuccagucuuucuaggaauuccuuuauggucuugaaagacagaguugggagaaacuacaguggauccuggcagccuaguuaguaacauccuuaguuacuuacaguuuaaaacuaagcuagacucacuuaaaauguaaaacuaaggaacuccaaacagugccuuccugguuacauacagcaauuauuguucauguaauaaugcacguaaccuacagcuuagagaggugcacagguguacaugugguaucucuuggauaacugaugauggcauagauuggagguugucaugguacauuuucaaagaagcacaaaguacuuuucaguaaacacuggugaacuauggcaguuguuucuuuuacugauuuucuuaaaacaauggaaaguguuaagugauucaagaugauguaauaauuguuuauuuuguacuauguauuuugcaggccacuuuauauauacuaggcucauuugaucuccaguaacaaccugaugaccuugguauauuauccccauuuuacagaggaggaaacugaggcuuagaauguuucaguaugccuaggguuaugaagcuuuuaaggugacagaucuggggugugggccucuuuaaucugauaccagaccucacacuuaaaccuuugacgagccugggacacaaauuggcauuuuaguggguugucuugcuagaugauaaacauuuaaacaucucuacuguccuucccuaucaccguccccaacaaauguuuaacagucaacucuggagaaaaaagaacccugguuugcaaccugccuguucucaugguguaaauacucccacaauggccaauuucaagcuaccuaagugaauuacucaaugugaaguuggaaaaagauguucauuauauaguacauucacuaugcaaacacaguggauguaaauaacuucaugaacauggacaauaguaaaaugcaguauaauuaggaagugaugaguuuugaguauauacuuguuauuaauguaacauaauuaugaguuuauauagcauaauuuuuaauaguagcagugcuuaacaguuggcuugcaaaauuccugaaauuuuaacaguugacucauaugagcugguaggagcccgaccccaccaucuguuauaauuuuuuaaaugugucucagaaauuucauguucuucaugagacugaguugccuacuaaagaagaaaaugccaaagaaaggugaaaggaauauguuguucugucuugaugaaacgaugaggugacuucuaaugccugguuaaauucuccauuucugucucccagagccuccaucugcauucuuguaggaguuuaaaguuugguuggcugucacccacaaugagaaaucagccagugccugcuuaaucaaugucugcagauauuuucaaaaucuaauugcuuccagaguuuuaaacucucccuuacccaagucuuuuuuccucagugguuaucaggaaaaguagagacagcagugaauuguguaggauuuacucccuucaacccugcuuucccugagcucuggcugguccucugugguucacaggagguggacaucuccccacggcucccccaauccauuuuuuguaugcuaggaguguggucauggugucguggcucuaaaccuuauuccuuagcccuucaguuaagcaguacguagggugucagguguuaguauucauuggcaaagcuuggaaauuucaaggcuucuuucuuucuuuucuuuucuuuuuucuuucuuucuuuccuuccuuucuuuucuuuuccuuuuccuuuucuuuuuuugacagggucucacuccaugacccaggcuggaguccaguagcacaaucuuagcucacugcaaccucugccuccuggguucaagcaauccucccaccucagccuccucaguagcugagacuacaggcaagugcuaccacgccuggcuaaguuuugcauuuuugguagagauggucuuucgccauguccaggcuggucucgaacuccuggacccaagugauccuccugcuuuggccucccaaaaugcugggauuacaggugugagccacugcgcuuggccucaagccuuuuaaaaguauccagauuguuuuauuuugcuuagacaaucagguacugggaugaaggauuuccugaagucuuuuuaccucuuuaucuuaucucuuucucugcguguguguguguguguguguguguguguguguguguguauuuagaauuaugucugacacaccguuaagaaccauaaaguauuaguuaucauuguuaucuccuuuaacaaaauccuuucagaaaaaugguccccaugugcuagcaugugaacccccagggaggccaugcauggucugucugguugucuguucuuacgaaccuuuccaauucagaguugcaugccaugcagggccucggcugacuugcuuauugaaguauguuuuauuguauagugaguguucauuaggccccuuggugccuugugaaaggagaguggugggugcagccuggacagguucucucacaggaguagcaucucuccucuuuuggguaaauagaacagccucuguuucagggugacaugcugugacagcaaaggauuuuauuuuuuuaauuaauuuuuuauugcauguauuuauaguguacaacaugauguuuuaguauguuguauacauugggugugacuaaaucaagcuaguuaacauaucugucaccucacaugcuuauguuuuguggugagaacacuuaaaaucuacucucuugagccuggugugguggccggcgccuguaaucccaguacuuugggaggcugaggugagaagauuguuugagucugggaguucaagaccagccugaccaacauagggagaccuccaucucuacaaauaauuuuuuaaaacuagcugggagugguggcaaguaccuguggucccagcuacuugggaggcugaggcaggaggaucaccugagcacccaggaaguugaggcuacagugaacugugaucuugccacugcacuccagccugggcaacagagugagacugucucaaaacaaaauuuuuaaguauacaguacguuauuauuaaguagagucacuguguuguacacuagaucccuagacuuuauucauccuaacugaaauuuugcaugcuuugaccaacaugcccacccccaaccccugguaaccauaguucugcucucuacuucuaugaguucagcuuuuuuagauuuugcauauaaaugagaucuugcaggauuugucuuucuuugccuggcuuauuucacuuaguauaauguccuucagguucauccauguugucacaaaugacagaauguccuuuuuuucaggucgaauaguauuccauuauguauauauaccacauuuuuaaaauccauucguccauugguggcauuuagguugauucccuaucucgacuauugugaauagugcugcaguaaacaagauggugaagacgugucuucaacaaacugauuucagaucuuuuggguaaauacccagaaguggguuauauggugguucuaguuuuucgaggaaccuccauaaccauuuucuauaaugguuguauuauaauaauuuacauucccacccagugugcaagccuucccuuuucuccacaucccugccaacacuugcuaucuuuugucuuuuugauaaaagccauucuaacaggugugagaugaucgugguuuuaauuugcauuucccugaugauuuguaugauuaaugcuguguacuuuuucauacauauaccuguuggucauuuguaggucuucucuuucucuuuuuuuugacagguucuugcucugucgcccaggcuggagugcaguggugccaucucgguucagugcagccucuaccucccaggcucaugcaauccuucuggguagcugggacuauaggcaugugccaccaugcccagcuaauuuuuuaaaauuuuuccauagagacagggucucacuauauuggccaggcuaaucuggaauuccugggcuuaaguggucuuccagccucggcuucccaaagugcugggauuauaggcaugaaccgccugcagccuagcauuacuucuuuuccaauggaauggaaguugcauaauugaauuauuaauuaguucuggggaaucaugucaucuuaacuacuuuagcacacaccagcuuaauaucuuuagauucuaaagcaaaccuacuuugggaaaaacuuucugguaaacacagauuuuaaaaagauaaauuuccuucuuaauguagaagaucaugauuucagcuuugauuuuucaggucauaugaaaaacaguaucacugguacuaggguacuacuaucaugaucaauuucacuaucauacaugaaguuaauaaaggaauucuugauauucugaaauugaauuugagucagucauuuaaaaaucuuaugagaccaggcgcagugguucacaccuauagcuccagcacuuugggaggcugaggcaggcagaucacuugagcccaugaguucaagaccaaccugggccacauggcaaaaccccaucucuacaaaaaaaaaaaaguuagcugaguaugguaguacaugccugugguccuagcuaucagggaggcugaggugggagaaucaccugagcccaggagguuggcuauagugaacugagauugugccacugcucuccagccugggugacagaguaagacccugucucaaaacaaaaaaacaucaaauuaaaaaacaggcaucaagagcauuaccaaauauuuacugacucagcuuucuguuucuugacuuucuucuauuucuguucucauacgguuguuaauaagcugucaaauguuaaagcgggucaacacacagucugaucugaaagagagcauguggagaggaaagcuccucaaagacgaagaacuuaacgacuuacaacugucuucuaaguucaccuaggacugaaaugugccacccagauacuaaaagcaauugcuuagggcaacaggaaauugacuaucaguggucauuuacggaggaacuguuaugcuccaggcauuguuguagguguucuacguacacuguauuaucuaaccuaaauggagagcuccauuuuuaaaaaaagaccagagagguuaagaaacuuacccagugcaggauuuacauuccaacuaucagacuccagagccuguguuuuagccuuuuuuuuuaaagccaagauucugaacauuuuuuaaaccacaaagucuaucagaaaaaauugagcaccaaagcauguacuuacuuacauaugauguaccuacacuuacuaagaaauacauacuuuguaaacuacaucaaaaauagagcuuuuaaagggucagguaaagacaucauauguaaacuuuuucccugcacaccagaguguccuuuugugcucuuugcuuuggaggcagcaguuuggucaagccccuucccuugucugggccuuuacccucuguacuuuagagcuggacugcacucuucaggcccuccacccuucggggauccaaggggcccaguuaacaucagggaggagcugaccuuggggucuccugagcucagcggucagggaagucugguuucucucacuugccuguucucuccuggggugagucagagaagaaugucacagcaauuguuguccuuccucauggagacaugaaaacaggacaggagguuucccugccccaccccaaacucucaaaacaauguccagauaaaaccuaaagcuucauuuuggcucagugggcccugcucagguaggugcuaaggacguacaggugugugauucugugucucuguccuggguguggccaucagggagggagaugcccacacacagacgacucccccguauggugagugccaagaaaaggggccuccuggccaagggacugcucugcucaucugggccuggugccgcuguccucauaguguucaggaugaacuucuuuuccagggcuucuuauugacucaucgcuaccuuguugaagugagcugccauagagcaggagggugccucaugccucaugcccagcacagacgaggggcucagagugugcuccugaggccacaggaagggcgacggacugggcugagcuacccugggugauacagaacuuaaacacucccuccucuccuccauccagucuggcucaauuucugccucagugcagcccacaaauuccuucugggugccagugagaagcaggagaugccagggcucaggucgacagccaccuuccugcccccuugguuucugccugccuguccugcuggcaccugcagccuccauuugcaaaugcuuugcuuuugucgaugggucuggagggguucucuaugggcugaaacguaaacuggaacuuggcagaacugcaagguagcacguuucucuagcauuggaugagugugacacauggaugcgguggcucccuggaccagcugucucucaguuaaccagccaaguccaagcagaagggaagcagcucuucgauuccuggggaauucuccuccucccaucuccccacccccaucugcuuaacacaaacuaggaggcaucagggugguuggccccuggcucauagagggggccacagugauuuuugucacucaacuugggaaaaccauugugcucaccuggggacaguguccugcuuggauuguaugcugccuggcuauaaaccaggcgcucugacauugggguucaguccuggaucugacaccagcugccugagaaacccuucacagggcauuagcuuccuggugcauagguaccugucaccuuaaguggugugccaccugaccauucuguugucccugggaaaauugcaacgcagccucuaggcuuuugccuccugacugauggcuugaggucccagagccaggacugagcaaggagguggaguugguuaauguuuuaugcuuugggccgccuagaaaaagcuuuuuccacgugucaagggccggguugaauuaggaaagcucaucauccagcuauuaggcuaccccacauaauucuucuguuuuuaaaaaauugcgucugcauccuccacuagcccacuagcccauuucaccguuugauguuauuugccgccaggaaguuccaguguaucuaacccagaccucuugggcucuccuucagucaguucccuacaagagauagacccgauuucaggcugcagcagccucucccaaagcauguuuguuaacuccuuugccugcauaauuuuuuuuuuuuuuuuuuguagagauggagucucacucugucgcccaggcuggaguccaguggugugaucucggcucacugcaaucuucaccuccuggauucaagcaauucuccugucucagccuccugaguagcugggacuacaggugcacgccgccaugccuggcuaauuucuuuuguauuuuaguagagaugggguuucaccuuguugcccaggcuagucucgaacuccugagcucagccgauccacccgccucggccucccaaagugguaggaauacaggugugagccaccaugccuggccugccugcauaaucaauagagagcagaaauaucacaagcgucacugacuccccagcagaacauggaaaugaaaauauguuuucucaaagcacugagcuuggugcucccuuuugguauuauuucauuaaacguuuaagaaucugaccuggccaggcgcagcggcucacgccuguaaucccagcacuuugggaggcugagguggccggauugcaugagcccaggaguucgagaccagccugggcaacauggugaaaccccaucucuacaaacaauacaaaaaucagcugggcgugguggcgugugccuauaguccccgcugcuugggaaccugagguaggagggucaccugagccuggggagggcaagguugcauuaagccaugaucaugccacugcacuucggccugggcaacagagcaagacacugucucaaaaaaaagaauguguuaauuuaauguuuaacaugucagaagauugauuggcaaguaaagaccuuacaucuggagcuaauauauuacauuuuuaguguuucaguuuacuguuuucaccuaaauuuuaucaacccagaaguauagguaucaucccauuuuacugaugaaaacucugccgcucagggaaacugacuugccuguggucacacagccgguaauggagcugugauuugaaccugagucuuagcuuuccuggcucagugccgcuucacucuaccagaacuaccucauagcuggcauaaguaaagguuguuugaggaugugaaauagauucacuuugguugaggcacaggucauugggaggaguggguaaggauggaaauucacauuggaccaaguuacugguucucccugucucugucuguacucuauccagagcgcguuuuaugacaaugcgucucuguaauaggcaugccgcuucuuaucuuuaauuuuauggguaccuuugggcuuuggguuuuguccaucuucauuaaaggcaaaccacuuuauugcucuauuucuuaguggccauuaaauaaaucaucagauggggauggguaauguguagcaguagaauguauuaauaauugaguauccugaaauagacuuucauuuuugcagcucgccaagaauauugggaaugcaggcuuuaaugagaucauggaauguugccuaccagcugaggacucagucaaacccaacccaggcagcgacauguaaguaugggacuggcuauucucauuugcugaguaaagguuugccuuugcccgagccccgggaggcaggggaauaagaaguuuugggugcauccaucguugcuucuuuagggaauaaaucagccuauguuggguuuucuuagucacuuuaaccuuuugggugaccaaauagaaauuuuuuuaggaagaagccaaaagcaggcagguuucgcagaugcugugcgugugugcagcggguauguagagagccucacucgccacugguggguggaagacccuggacuuuucaccugugcugucuguucuguugagucacuuccccgucuuggucucucugcauaauccugagccaccgagauggcugguugugguagauaugugauuauguagcguccuucuugccaacguccuugccuccuugcaaauguggaauguguuacuuccuucaaaaaauguuuguguuuguguuauuguugauacacaacuugacggagaagcuuuuuuuuuuuuuucugggagacggaguuucacucuuguuacccaggcuggagugcaguggcacgaucucggcucacugcaaccucugccucccagguucaagcgauucuucugccucagccucccaaguagcugggauuauaggcacaugccaccacgccuggcuaauuuuuauauuuuuaguagagacagaguuucaccauguuggccaggcuggacucgaacuccugaccucaggugauccacucgcugcagccucccaaagugcugggauuacaggcgugaggcaccgugccuggccagcggagaagcuuuugugucuacuggugcagagcugacaacagggaauguucuugcccaucuuaucagagugucaguggccaugucacacuagucuucgagaagagguggacagggagacccauggguucgggcaguggguguccggcucgccuuagacuucagcucuguuuaguauuauggcucuuaugucuauagggggacaugggugguuuaccuguuuuguugugaugcaaagugaaacagacggaaggaaggagagaggcuacugggccaguuaacagagcaccugcauuugaguggugaggcugggucagcguguccuggcaggacagagaaaaaugaaaaauaugugauaagaaaaaguauuuaaaaauucauuuacagaaacagcauuuucuguggaauaagccugaaguagaauuaaugacacgagucuucccaaaggacagugagcaacagugaacaaugucuuuaagggugguuucacaaauaggugguaguguauggacccuuuguaaagggagagaauuuagauuuuuuuuuccccuucaagaccucuugcccaggcuggagugcaaugaugugaucucggcucacugcagcauccgccuccuggguucgagugauucuccugccucagccuccugaguagcugggacaggcacaugccaccacacccagcuaauuuuuuguaucuuuaguagagaugggguuucaccauguuggucaggcuggucuugaacuccugaccucgugaucugcccaccuuggccucccaaagugcugggauuacagacaugagccacuguaccuggccuagauuuuuuuuaaccauuuuguguggcaugucuuugagaaacggagauugcaggaccuguauucuuucugcguuuugcugauguaacuugauacagugaaagagccagaacauugcgagggagugaacagggaccaugugcauuacagucuuucagguaucagguaucucaggugagcgauuuaguuguuguuggauuaaagucaguuuauguuugaauccuguaacaaguguuuguggugucgcauuuccuugagaauuggauaacgugugguuuuacauaccaggcaugagguugacaaugugaucauccucucuugaugaggaucuaaguuucaaaucuauauuuuuacccaaaccuagagaggcaguagggacauagauaucucaguccuuaucugagccaugggacaccggcagauuguuuaacuucucugagccuaagcucuguaauaaaaaaagggagauaacguucccccucacagaggcauugggggcaugagcgggaugauggggucagacauguggugcuuaguuuuagugccugguugacauuagcugcccugcuugcucuucuuccugugggugacagaagucacaucuguacccugcauugauuccauacacccugaaaaugagguuccucuccaguuaaguuucaguggagaguuacucaaggugaaggagcucuuccugggcgagccugagggucccgcuuggugaaggaaacgucgugaauccagcauggcgaggucaucuccugcugugcaguugacaccugcucuuucagcugcuucaucucacacugacgguaccagcacccuguaaugcugucauaucggucaguucugaacaaagugugugucguuucuuccaagcaccagggguaccuaacgaaagcagggcauuugguuguucuggggcuaggcgauucuaaaaaaugaacacugucaauguggaacccuucaguaugaacguucugucugcacuguagcccuccuccagccuuggcacuguugaaaaagaaauuuacaucccccaaccccgggcuuuuuucaaaaugagggcggaugacccgugugauggcgaaacaucagcuacuuccauuccuucucaacugaaauuacuuucuuggcucugugcuccuauagcauuuggcucuauuuuaaaacauuucaucccacuucauaguauacucaggcauuuacauauauuuuucugaugaauuacuucuuacucauuuugguuuuucccaccguaauauguugcuucuggugaaccagugacuauuuaaugaaucagcgagucaaacaaguacucccagcucugugccugcuuaaauaagcuaguauuuuacuuccagaugaaaaggaauacacugcuucuagcuuuauuucagaacagcacaccaucugcagauaaaucuguugaaggggaaaccaaggacacccucuaguggccugugaaucccaagacggaucuugggggugucagggacguguaacugggggagguggagcagggaagcuaggcuuguauuugcucacaggagccagaacuguuucucccugugacuugggaccauuauacacacccuguccuugagaaguguaaggagagccccuccucugaacaccaaauguaucauuauguuaauuguuuuucugcaaaagccugucauuaaaaaaaagagggagggccgggcgcgguggcucacgccuguaaucccagcacuuugggaggccgaggugggcggaucacgaggucaggagaucgagaccauccuggcuaacacggugaaaccccaucugagggaucacauuagcaaagcaaaccuccuucacaaaaccagggggcauguguggaguuaaacagaccugugcccauguuuguguaggagcugccuucggggccuccaagcccugggcagaugaguaaauacauuaaaaaacaaguaaaggaaguccacuuucucucuaucccuuuccuguggaggucgcaguaaugauugucccacagugaugauugaaagugcaugaaacuggacaacuguccagucuaacugccugucagaagaggcauuuacaucauuaaaugggcugcccaccaugacacucgccaggccaggaauggagcaucucccugggugucacacugugcuggaggcccuaagaggagaaccugcaggaauaaaaugggucuucccuuguaggcccaccagcugccugaggaaacagaauccaguuucccuuuauggacuucaguguacaguaaauccugaauguuccagaaacucaaagguuucuggaaaccugugacuuuaagcaaaaugauguauaagaaaccaguuuuacccuaugccaauugauguaaaccagaguucaguuccuaccauguauuucugaucaugagaacaucaccaaacuuuugaauaaaggcccagaacacuucuaauauuaaacauugaaauaugagcgaugcauacauuuaagaaagauucuggcuacuaagugggauaaagaaagaucauaaaaaccaguaagauaaugauucacccacuuauuccaguucagggucagagguggcuggagcauguccuggcagcugaaguccagggugggaacaagcccugaacaggaccccgucccacugugggacgcagucacacccacguccacacucagucgcaguggggccuuugagacacagcaguuagccgaacgugcacagcuuugggaugugggggaaaccggagugcccagagaaaacccagguggacuccacacagacagggacccugccugggaauugauuuuuuucuuaacauuauaacaaaaugcuguuauucgagggccuguugugccuacagguggagaugaaaacucauggcacuguugagggaacccacugagaccacguaucucacacacaagucagccagcaccgcagugagcucagugcacggguuagcgcuguguggacggggagcaugugccgggggacguugaggcacccgccuuaaccuaggcccuguagagcgggcagaacuggagccggagcaggagggaggcagugugauaaaagugccagagcacaaguucaccaggugccccuggaaguccuuccugggcugugaagcaugcugccugcucagguggaacgggcacccuggggcgugauuuccucuccagcugcaccagccagccucacgcugcggcguguccaggagccacaugcacccaaggacaagcagauuugaggccuggcagacgcuggcaagagaccucugcccacucaguuccgucugggugcugugggaguaauggcuucucaucuuaggcuggcccaucuucaagggaccccaggguagacaggaucucuacucccugccuccaguggcauguccagggagcucaggcuccccuucuggggggccaguuguuccacggggauuuagggcagguacagaaaagucaacaacugcuccagcagccauggccccuugccauagucagcugagugagagagcggaggucaggagggaaccgugcggggacuccagcucgaaggggagcagccgcauuuguccucagauuguaggcagugcuguguuacaaauggaugcaacugaucugccccugccuggcucuugccugauucucaagauucaaagagucccugggcagugacccucaaccuucagaauugggauuguaaaaugcauguacucugugaccagugagcugcuguuucgcucucccucuuguaaguucacugggucuuuccaaggcccgggacccacugugugugcugcagguguguugacgcacauacgucucauggugcuacugugaggauguauugugugcauuuucgcaagucagacuuacaagucuagagagaugaaauacuuauucaaguucaaagcagcaguguguggugggagugggauuugaacucaggcuucuuuggcccccuuuuguuccugcuucuguaggcucuuuggauggggcggagucugagcauguugccacauaaaggccagaaaguagaacacaaagaggacugccauuucauuucaguucaucugauagugccuuucauaccaggcauggugccuacaaaaaagaggucauaguccaugccccaaggagcucaugggccugucgggcagugaggcaggcaggccuucauguagagaauguuggaacagagguuggccagggcugcauggagggcaggggcagggccuuccugggggaggaggcgcagggcaugcggauuggaaggaccugaauaagaaggguguggaggugacgagggcgacagugaggucagaucacagaacuuaggagugaggggagggagacaaggcagagaggcgggugggcugagagaacauggggaguugucccccuggccaguucccaggaggucgcagugaagaccagugcagccguagaaccacauggcggccacucccgcuuuguguuucggggccagcggugcuuaccagggacauggcgcaggaaccguuaacauggccuuagacaaagggaggccggacggcggguagaagcccuucaugauuugcaaggcaauuacguuugguuucaggaaugcaagaaaggacuacaucacagccaaguacaucgagaggagauacgcaaggaagaagcacgcggauaacgcggcgaagcuucacagucuuugcgaggccgucaaaacgagagauauuuuuggauugcuccaagcuuaugcugaugguguggaucuuacggaaaaaaucccacuggccaacggacauguaagaguguggguuguugcuacuuuaaaaaaaaaaaaaaggccggccacgguggcucaugccugggauccaguacuuuacuucaggaggccaaggcggaggauccuuugagcucaggaguuugagaucagccugggcaccauagggaggccccaucucuacaaaaaaaaaaaaaaaaaaaaguaaaauuggccaggcauggugguguacauuuguagucccagcuacucaggaggcuggggugagaggaaucgguugagcccagaaauuugaaacuccagugagccgugauugugccacuggacuccagccuggccgacagagugagaccuugucucaaaaaaaaaggaaaacuggggcacuguggcaggucuguggaaucagcaguacugaccaaagcuggguaauucuccagaggaagacggcacggagagggguacugggguagaauaaacuaggguuuuuucuuuucaguaggaaaauaauuguaucuauguucaugggguaugcugugauguuuuugaucuauguuuacaucauggaaugauuacaucaagcuagcuaacauauccauuaccucacaggcucauccauuuuuaauggagagcacauuuaaaaucgacucaguuuugaaauagacgcuauguagucuuaccuggagucaccaggcuuuguaguagaucugcaggauuuauucuccuugucuaaaacuuuguacccaccuagugguuuauucuuacaccaaaaauguaaugccagcucuggaaagaaaacccaucuccagguggaggagaagacaucucagaagcuaggcagccugagagggaccccucaucugcaagcagguuuaaccugagcuucaugcuaacgagagaagcucucugagaggggcgguucccuggaacccacaccccacugugcucccccucagagggaauagaguaggagcaagaccccuccuuuccugggggagcugucuugagagggugggcauccagcuggaguggguuugcaguaacauaccagcacccaagugggguggcauguguccagauucugguccacaaauacccuguagaugcacauuugguccccuggaaccuccugaccucaggacugggcuggcugccuaucagcaaggaugccucacggcugcagcaucuuucucuugguaacaggcauguccgugcaggcucugagcuggucccacucucuccccauccccagaaagaacucaugcccaccaaugcaguguggagggugcccagcacugagcugugcugccgccagagggcccagcaggcagggcaggcggccugggaagcaccuuccuuugcccucaccuccugucuucuguaucuguccuucuccucugguucucucacccacccaccugcugaaacaauccuuguucaucucuucucccccaccugccagguguacuuucagaaaaggcaguggaguuggggaauccccaguaugaguuggagacagugcaguuauuagcauucguagccuugucuguaaguguagaacgcaaaacuuuaagccugcuuaagaaacauauguuucuacucaaggagcagguaaagagauuggauuguagguggccugggggaccuuccuggauccuuugaacaagauucuugcuugcaggcagggaucugccuuguggugcugaugcagggauggggacaggucgauugagaggacuuagaaaugaaacuccugaacuucucauuuauuucccauggagucaggagaaacaggacgaaucuccaaauugcacguucccaagggcaaagagcuuguguagagauuaaagagacucuauguaagagauaaguuucucgaagggaaagauaaaagacuuuuggaagaguuguacacgauuucaccgguguuggacacagaauugaaugcucccauuagaauucuggaaugccuuuguuugguuuuucaggagccggaugaaacggcccuccaccuugcagucagauccguggaucgaaccucucuucacauuguagacuuuuuaguucagaacagguagguguucugaaauuaagggaggcacucguuuucuccuugguauuucuggggaaggaaucggacgcugccucaucgcuucugauguguugucaggagaaccuucccaguucuaaacaugaauuaaagacagaaaaaggacugccaggugugagguacuccauggcaauccuuuaaaaaagcacuagaaacucuuuugugguaauugcaggguccaacuucuagugucugguacucagggagacaccaaguagauauggcuacugaacuuggggaccccaugaccacccucugugcacaggggccguccucgccucauccugugagccaggucaucguacugcgcaagcaguguccugagcaguagggagguagcaggcaaggagggauccacacauuagccauggucugagccagagauuagaaaccagagcacuggauuauggguguuuuguuugggucgagaaguuguuuuuaugcuuugauuagaaauggccuuuagagaugugcacaggcaguuuaccacagaucugggaguccccgugguuuggggcauauugcuucagucauguguuaccugccuggcagcugaaggcuggacuucaagaccccucaacguguauuuugacucccugaucgugguuugagccauguguguacuggaggaggaggaggugcuguuaaaagccacagaaauugcuccaaaggaaauggaaaauuccaaaaugcaaaagccaugggauaguuugcauuuuguguccucugcuuuuuccucccauuucugagcagaggagugaagaaauggccagaaaguaggggagugugggguggucaaccccaagaccugcagcuucuuccugaggaggcugaguucacuggacucgugguggaagcugcccugaugccccaucucugagugccagcccggcuccuagaacgcagcagggguuucguaaacauuugguugauagcugcgugaugccucucccuccaugcacauuuucagggggcaggagagggaaggucccaguuucuuuuuuuccagaguggaaggaggacaaaagugggggagaauucugaaaaugaaacacaccccccgcuccccaugcccacaauuuggugaaaaagaaacuccuuuuuugauauugaaaauguaauugguuuccuucucauggaagcagcaggugccacuuccugagaucgccuuucugucuccacuuugugcaggggcacaaagcucacugccccuccucagaaugugacaguggccauguuugcuaggauugagggccugucccaugucugccaagccugagcaccuuuugugggugaccuggucuugugauauguuggaagaacuuuugaaaaucucaagauuccccuuuagccuguuuucagaggguauucccagggcaaacaggccgaggagccuggggacucugggcuuugggaaagugacuuuucccuuuccuggagggaauaucaaauaaugauagagaaaagcucagccuccguccucccgugggacaggauggaugagucacacaggcauccagaggcccugcauccagcacagcuggccggccuagcacagcagccucggcgcagccagugggacgugagaaggacgcugggcucuagguucaccccgguagugcacugccccaccuuggccccacaugcucagcaacaacagggaugccccccuccccuuuugaccucuucugccaucaucguguuauuucccugaugaccuucugcuaaggcuuccccagccauguaggcagggacggugccaggucccaccaccuuggcgaugauuuacagaaaccguucacucggggacugucugccuuuccugugcccguagcccaggcucccugccgggcagucccuggucguccagccugugacacacuaugcucucucucuguuccuguucucgggcagugggaaccuggauaaacagacagggaaaggcagcacagcccugcacuacugcugccugaccgacaaugccgagugccucaaguugcuccugcgggggaaggccuccaucgagauaggugagugggcccgggccccgggggugggcucagcugcacccuggccucugccuccugucugccauccaagcgcugcucuuggaaacagggccaacccugugggcucuuguuagugccaaagagaaggagaaccuaccgcuaaugagaaagagccucucccugccuguuccacgaggccgcauucaccaucuguuacuuagacuuugggcgcguuuacaggcauuuuacagaucauaagacaagcaaagggugggucuugcagcucucacggaugccaggugaauuuggacaagguuggggaauuuugaccuguucacauacccugagucuacucacccccaccugaggccacacuuggccccuuucuuggcucuggguuuagacggauuacagggggagaugcuguuuacugcccucuccuuucauuugcaccacugcuuccuccaugaagggcccugguuguuacuuggccccggucccucccucucucgaggaccccgacaugccaacagccaaggcacaguugugccuugagagcauccagcuguuguccccucaggaggaaguauuuuugaaggacuguuaaauaaagaggaaagaauagaaaaaagacacacaucugccugagagccgugcuuaucauuaaaaaacuaauaaucagaccucauugacugaggcuuauuuagaagaaauuauaggccgggugcaguggcucacgaggucaagagaucgagaccaucuggccaacauggugaaacccugucuccacuaaaaauacaaaaauuagccggguaugguggcgcgcaccuguaggcccagcuacuugggaggcugaggcaggagaaucacuugaacccgggaggcggagguugcagugagcugagauugcaccauugcacuccagccuggcaacagagcaagacuccaucucaaaaaaaaaaaaauaaauaaaguauauacuuucaggguuuauagacugcuugagagaagguuuaaaaguuuguuauauugcagugcauggaaauaggugagcagugcuuuucguuagagguuuaugaugaaucgcuuuauucaaugaguuacaguuuggauguggauuuuaauuagguggcugcuucaacaguuuuuguuuuuguuuuuguuuuuuguuuuuuuugaggcagagucucgcucugucaccaaggcuagagugcaguggcacaaucucggcucacugcaaccucugccucccagguucaagcgauucuucugccucagccuccugaguagcugggaccacaggcaugugccaccacgccuggcuaaucuuuauauuuuuaguagagacgggguuucaccauguuggccaggcuggucucgaacuccugaccucaaaugauccacccaccucugccucccaaagugcugggauuacaggcgugagccacugcgccuggccaguuuuaguuucuugauuaguucaaacuucaucuuuuaaaguuuuaccuucuguauuuagcuguaguucuauacaauuacaagauacauucagccucgacuaggucaaacucacuguggauuucauuaaccaggcccaauuuaauuuagugcugccuuucuguuccuuuuaaaaauuguccuggaugucaggccuuugcuggguuuugccuuaacgccuccuuugcucgcccuugaauuuuagcaaacgagucaggagagacuccgcuggacauugccaagcgccucaagcacgagcacugugaggagcuggugagucucccaccacaaggacgggguggggcaccugucacgggacagggagccaagccuguccuccuugggcaggguuugcugugaaccaguguccugagcagagcucaguguuucugaugggaugagccgagaaucagccugccuuggagaagguaugcuagggagucuacagggaaaccuagggggacccaccccucgcagugagacuuggggugugagucaguguuugcugguuggccguguugguaacaucacugcuguggugggacaacuggaacagaggcccgaggccaccacaagggccugcucucuggccuccguaagcuguuuacuugcuacuuugcaggacaucaaggccaaccuccuuucuuuguuccucagccccagaucauguggguugcucaauaccaucuuuuccuguucuggaagaaaagacaauguagacaguagaaagagcccaccaggccaggcagcccuggccuugccgggggcuccccagcuuggcuugggaaggaaacucucuuaggcuguuuccuuauuucuacagugcagucaguuauaccaguauauaagguuguugugagaauuauuaucaaaugcuguaaagcaguugacacacagcgcucaguaaauagauuaaggccaggcacagugacucacgccuuguaaucccaaagcuuugggaggcuaaggcaggggaugauggcuugaggccaggaauucgagaucagccuggcaacauagugagacucugucucugcaaaugauuuaaaaacuagcaacgcaugguggagcaugccuguagccccaguuacccaggaggcuaagguaggaggaucacuuugagaccaggaguucaaagcuacagugagccauaauggugucacugcacuccagccugggcaacagagcaacacgccaucuccacaaaaacguuucgaauuagcugggugugguggcacgcaccugcagucccagcuacuggggaaguugaggugggagaauggacuugagcuuaggaguucaagacuacagugagccaugauuaugccaaugcgcaccagccugggggagaaaaaaaagaacuauuaauaauaaaugcuauacaaguguaagauaaguaacagguccucuuucuaagcacuguacauccacgagcucauuuaaucuuuuuuuuuuuuuuuuuuuuugagauggagucuuacucugucacccaggcuggagugcagugacaugaucucuguucacugcaaccuccgccucccagguuuaagcaauucuucugccucagccuccugaguaacucggauuacaggcaccugccaccacgcccagcuaauuuuuauauuuuuaauagagacgggguuucaccauauuggucaggcuggucuugaacuccugaccucaagcaauccacccgccuuggccucccaaagugcugggauuauaggcgugagccaccacaccugaccugucucauuuaaucuucauagcuaccuuaugacauaguuucugcuguuguccucauuuuacagaugaggacacaggcacaggaaaguuaagugacuuggccagggucauguagcuacuaucugguuaugggggaaauuaagcccugagguccugagacacccauaguguguaacgaauuaacuucucuucugcacauguagaacggaacuagcuaucuaccuuccuugagagaacugagaaaauagccacacagaucauuuucuacagcguuuaauucucucauccugguugaaaaggcuggguuuacagugaaugagcacauucauucuccugggguugagcuuucucccauauggaguauggauacuugcaggcugaucagcauccuuuagaucucaaauauccuuugccuguuguuuuggggaaaacucuagcccuguuuuuucuguacgguuacacuguugucacaacaagcaauacagaagcagacugcugugaccaaaggugugggguucucccccgaccccauacaccaauuguagucgccugacagguucuucuugccugcugcauagauuaaacccaauucaugagacagugugauugcagcagagaaagaguuuaauuauggcaagcuggcugagcggugggaggacaggaauuauuacucaacuguguccccacaaaggcucagagguuaggguuuuucaaggaugguuggaugggcaagagggcuaggaaaugggugcugcugauugguugggagugaaaucauaagaguaugagaaacagcccuuguccacugcauaucaucucgggggggccacgggacuguuugagucaugagucagguucaguggagucaguuggucaccaggaugcaaaagucugaaaaaauaucucaaaagaucagucuuaggauauguuaucuauaggaucaauuggggaagucacaaguaucguggccucuggugcaguaaacaauuuuuuuaaaaaaagacagugucucucuguugcccagguuggagugcaauggcgugcuuguggacagccucaaacuccugagcucaagcgauccucucaccucagccucccgaguagcugagacuacagaugcaugccaccacgccuggcuaaaaaaguuuuuaaauuuuuuguagugauggggucucgcuauguugccugggcuggucucaaacuccuggcucaagcaguccuccugccucagcuucccaaaaugcugggauuacaggugugagccacuccacuggaugguaaacaauuacauuaauagagaggcaagcugcaccuacauuuuagcagaauucagacccuucccauaauccuaaucuugaggccuuucauuagucuuccaaaggcacuuucaaguucccuaacaagaacagagucaguuuucacaugcacacguauguuuauugcggcacuauucacaauagcagagagacuuggaaccaacccaaaugucugucagugauagacuggauuaagaaaauguggcacauauacaccgugcaauacugugcagccauaaaaaaggaugaguucauguccuuuguagggacaugaaugaaacuggaaaccaucauucugagcaaauuauugcaaggacagaaaaccaaacaccgcacguucucacucauaggugggaacugaacagugagaacacuuggacacagggcggggaacaucacaaaccggggccugucaugggguggggagacgggggagggauagcaucaggagauauacuuaauguaaaugaugaguuaaugggugcagcacaccaacauggcacauuuguacguauguaacaaaucugcacguugugcacauguacccuagaacuuaaaguauaauaaaaaaauaaauuaauuaaaaagaaaagaacagagucaguuuuagggagggacuauuaccauccuugauucaaacuuacaccacaaacuaaauucuucccaugguuagcuuggccugugcccaggaauaagggaggacagccagccugugaggccagaagcaagauggagucagccaugcuagacuuuuuucacuaccauguucuuguaaaggcgguuucacaagcagcagacaccagcuggcuguccuccaguucaauuagacacuaucuacuuggagguaguguuagaucccacaggcugggggcucaguccccaagacugucuuccaccccagacaccagucacaaaucaaccuccagaacuucugaccaaccggcuucaaguugggguucccacagcccccucuuuggguuugaauaauuugcuggaguggcucauagaacucagggagacacuuguguuuacugguuuauuauaaaggauauugcaaagcauacagauagagaggugcguagggcaaggugugggggaggggacauggggguuccaugcccucccugggugccacccuccaggacccucugugugguuugccauccugaagcucgagaaccaguccucuuugauuuuuauggaagcuucuuggugucagcaucucuucccccaggguacagggugagacccucucuggggagggccuuaagacccacagucagaaaagugggggacgauaagaguccugccuuggggcaggagaaguucagagagauucugucuccugaggccuuaacacuccauguuauaaccgaagacuguaacaagggauuugagaguuacgagccgggaacuguggaugaaaacuaauacaguuuacaaagccuuugcugggacauaccagcuuugaguuucaagguuacgcugugaaguaggcagaggggcgggggcuucaccugagacccagagauuuccaugcauuugccuuggacuagaaggcaggccuccugccugcacacuucaguggguccagaugcauggccgaguguaugagcaacagcacugaccaucccucuguucucucagcugacccaagccuuaucuggaagauuuaauucucacguucacguugaauaugaauggcgacuacuccacgaagaccuggaugaaagugaugacgacauggaugagaaauugcaggucugugccagguugcuaaccauuaagaguuuugaucagcuucauccagaacaguguggguccuaaucuguaauuaaggcagaaagcuguuuuauagaaaugaaaauguagcuuacuuuaugcuuucauugaucucaguaggcucuugguuuuacccuucccacuaccaucuccugucucccagcuccugcacccauuaauuuaaaggaauggcuaauuauguacuuauaggcagccuuuugcuacaaaggaaagguguguguggcggggggguugauuccaguggauuuagaggaaggucucuugcuauggagucaugucauaaagagccagauuucccccagucuaggugaucacauucuccugguugaucuuauaaaaacaucaacugaaaucaucagacgaccuuuagagcucacuggguccaaccccuuccuuuaucaguuugggauauugaagccucaagagaaaaguugacuuggccaaagugaagcagcuauuuagaggcaggcuugggacugcacgaaggcucuugccuccuccuccagcucccuucuuaccauccucacugcuucauacgcaggggugagccccaggaagguugcugccuucacgcaggacuuggagcugagagucagacuuaggccuugugacccaaagcccuggcuccuagccgcgacccacuuccaucuguccuucagcauggugcuucgaggcaugucuggaaugugcucugugcugaauuaguggcaaaugccacauuaaacacauuuucaugguuuggcuuuuuuuuuuuucuguaaugcauuaauguucugauguguauugaggauaucuaauuagauggauggauaggucaguagguaaccagauggcauuucugaaaccuguuggacugucugcucauggaguuaacauccauacuuaacugcuucuuagaauacagaauaagaaauuacuucacugaguuagcuacaaaacacugucaaagugagaagaguugacugauuucauacuuaaccugccuuaaaaaaaaaaagcuggaagcagucugccccagccugccucuucaucaagcggucagaugccacauucccauuugaugagcagugaugaagcagguugcauaguccaaggaaaagcacaagagcaggggcugguguggaguccuaagacucauccacgcugcucaccugauucucagcagacagcagccgugggcuuugcaauuuagaaauaugugugaagaaccacugggugcuuaguucugcacaccugagcuggguuugaaccauugguuuguccagaaccuagaaaggguuggugguccugugagggagaggcagggcugccacaguucauacugagcaccugcuaagcaccuggcauugugcuagaaaagcacucgucauauccagugaacagacaagaauguggucagcaagguugagucauuugcucacaaucauaccuaguuuaaugaagcuggcauuugaaauagaaguuaggucuaaguuaccugagucaucauuccaugcauucacuuccaagaaagcacaugaccggccgagcgcgggggcucacgccuguaaucccagcacuuugggaggcugaggcgggcggaucacgaggucaggagauugagaccaucuuggcuaacacggugaaaccccgucucuacuaaaaaauacaaaaaaauuagccgggcuugguggugggugggggggcgccuguagucccagcuacucaggaggcugaggcaggagaauggcguaaacccgggaggcggagcuugcagugagcugggauugcgccacugcauuccagccugggcaacagagagagacucugucucaaaaaaaaaaaaaaccauauaaccuucaggggggagcagggguggccaaacucuuaaagggccagauaguaaauauuuuaagcucuacgggccuaaagcgucacaguccauguuaacaauuacucagcucugccaggauggcucaaaagcagccuuagacaguaucuaaaugacaggacauggcuauguuccaauaaaacuuuacugacaaaaaacaggugguaguccauaggccacuguuugcuaacccuaauuuggaggaaucucaggagcuccuguucauaugggaggaaaacaucgaucucugcugaaugagccauauagcuguuggagauugagugcagcgggcuggccagagcuggccacccugugggguagcauaagaaggcauguuugggaaggggaacuucagggaaaaugcugacuuagguugagauaacuucgacucauaagauaaauagcuuauauuuuaaauccaucacagaauggagaauuuuaaccuguaauuaacagauuuuuugguauguguguguuuacuagucaguucuuacacugcuguaaagaaauaccugagacuggguaguuuauaaaagaaagaggucuaauucacucacaccuccacauggcugggaaacauacaaucauggcagaaggggaagcaggcaccucuucacaggguggcaggagagagagcaagcgagagcagggaaaacugccuuauaaaaccauuaggucuugugagaacucacuaucccaagaacagcagaggggaaccgcugccaugauccagucaccuccuucccucgacaagugaagauuacaauucgaggugagauuuggguggggacacaaagccaaaccauaucaguguguguuuccuucacgagacacaaggaggagugaauuuucacucuugcagcucucacgcaacuuguagcucucaggcaacaguugagagcucaaaugguaccaggcccagcagaguuggugucagugagguuuucaccccuguguugaauguuaucaccaggagcaguucauauuugucucacacgccucugccccaauguucuccugcagcccagucccaaccggcgggaagaccggcccaucagcuucuaccagcugggcuccaaccagcuucagucuaacgcuguaucuuuggccagagaugcugcaaaccuugccaaggagaagcagagggcuuucaugcccagcaucuugcagaaugagacuuacggagcccuccugaguggcagcccaccucccgcccagccugcagcccccagcaccaccagcgcccccccgcuuccuccacggaauguuggcaaagguaugaagcuguccgucaucccugugaauauauagagggucuuguuuugugguuugggaaguuugcagcugcccugccuccaacucagugaccuuugggcucuuuuguuuuguaguuauuuucuguuugcuuccuaaagggauuccaucauucuuaucaggccagauggugguagagucucuugauuugacucuuauucugggcagaguuguggcaucugccuggcuuggguaacaugggaacucccccagggcagccugagguggccaacugggcucccggggcugggccaaaagacacacuccuucaggucuccccucugcacccuucuguuuaccuuucuccacuccuucccaggccuucauucuuccuuuuuauuucucuucugccuucaucugguccagcucauggccccugcgauuacuucuuacccaugauccccauaaaagauauuggggaacgaugcucggccuaauuguaaaauacaaaaccagcccugugggccuaccagugucuuagggcaaaaagcaugcuuuucuuaccucagcuguaaccuggagguuuugacucaacaggugacacuuucuguuuuuagaaauacgcaaaccaaagcucucagaaguuaaguaauuuguucauuccugaagagcagcuggcuacggugcuucuugaaggcagguccggcgagugacccacucagcucugggcugagcuccagucguggccauggccuucagaggguuucccacaugaaggaggcugcugagacuuugaugcggggcggggggcccaggaaggacaagagucugcacagagcauguauccaggcauuguggccgcugugagccgcugauggaguggagcccacguccccaaauacaucccaaacuguccuuaugugguagcugcuagcugggcaggcugggucggugcgugaggguggcugaggccgggagaccuggcccagggcugagcagacggcugcagcuuugugcugcacguacacucggcugugcugcugggcccaucuucccugccguccugggugucucacagacccucacacggcucugccccugucauucagggaggcccagagaagugacagugaaccugucaugugagucacugagucauaccccgaagaacaaaccugcugagagcagaccuucccccaggcaggcccagaagccagcugcuugcuguccccacacagcccacaucccagaccgcguccaucccuggcuugaugaggacgucccugagcacagaaggcagcuacaagaugaagccacacagucgcaucuccucccugucaaacccccaggcuggcuggucggggcccagggugggugcggcuuucuccccgccucucccagauccugcaggcaggcaucaauuuucuacggcccacaaucaagaugauuuugaucauccuccuucccagcaguggcuuuugcugacugugugugucacgggaggaaagauuuuauuuuguuccacugggucauggagggguaaacucuuaaucuccugguuucccgaagucuuggaauucaaggguuuugauuuuuuuuccuuuuucuuuuugccguuccugucccuagcaucauuucuucuuccaguaauguaggucauaccccuuaccugccaucuccaccauucucuguguagcccacauguggucuuggauggaauucucacaugcagauaaauagcaaauggaguugacagugucagccuugcauuuggggcggaccuggcuccccaggggaggagcucgaaggcuuccucuggacccaguggccuggcccauuucuaggccuagccuuugcccuacaggccgugcacagccuccaacauggggucacaccuagcaccugggcccugugcaccugagcuuggagguuugugaggcagaagaagggcuugugaccuggaaaaugccaucucuugugggucaccugaaccugauuggugucaucugugucugcuuccagccagaaauauguuugcgggagggagggagagagagccccuccucuagugucugauuugcacucugcccccaaccugugccagcugggcacacgguguuccucuucacaugguggugacucccacagcccaugggaaggagucggugggaggguggagaggagcagaaguuccagaagcuccaagugcaguguucgcaagagaacauugugacuguuuauuuccuucuucaaaugauacugauauuugauaaauaaacucaggaauuuuaaauuucauggauugagaaaaccugcugagaauaguccuuggagccucuucgguuucgcgaguaucagugucuaucuuccacaugccggagacaggaguaaaagcauugaggguucuagguagaagggucauacugaccguuucauaagggggaggaucaauaacgcaguguucuguuucuguuuuuguucgugugugcacguguaugugugcgugcaugcgucugugugcaugcguguggguucaguucagacagccuccucugcuaacacccuguggaagacaaacucuguaaguguggacgguggaagccggcagcgaucuucgucagauccgccagcuguccauccaccgcugcccccucuucgcgugacaucuaccaguacguuuuuuuccuuuuuccuuucuugcccgugggcuuuguagaucuggauggcggggggugcucucuggagccacacagcugccagcacagacacgugccaagugccccguguuguauggcucccuguggcucuugugcagggcucucagcucccccagccuccuucgucacagcugcaaaccccugccuguccccacacugcaccaccaaguagcuuccucacucccuuccucugucuuccaaagcauuucagcaacauuuccuccuuuacacaguaccccaggguuucuuuuuccuuuggccauuuggugauuuucaauauuuuggggacagucacuuggauuagaaucuggcuuuuuguuuuucuuuucuuuuucuuuuuuuuuuuuuuuuugagacagagucucacuccaucgcccaggcuggaugcaauggcacaaucuuggcuugcugcaaccucugccucccggguucaagagaucguccugccucagccucccagguagcugggauuacaggagccugccaccaugcucagcuauuuuuuuuuuuuuuuuguauuuuuaguagagaugggguuucaccauguuggccagccuggucucgaacuccugaccucaggugauccaccugccucagccucccagaguucugggauuacaggcaugauccauggugcccagccuuguuuuucuuuuuaagacagggucucucuuugucccccaggcuggagugcaguggcacaaucauggcucacugcagccuccaacuccuggguucaagggauccuccugccuuagccuccugaguagcugggauuauuggugcaagcguauuuuuuguagagacaggguuuugcuauguugcccaggcucgaauuccugggcucaagugauccacccgccuuguccucccaaagugcugggauuacaggugugggccaccacgcccagccuggcauguuuucuuuaauaucaacaugugguugaaaguccugaaaaccuuggguaaagaagcgggaggagguuuuuaggaagaaguuuuucuccaguguacagaacuaaagucuuuuuucacuggaucagagaagcgagcccuggaugcugcccugucuccugcugcagcagcccuggaguggggaguccagcaucucugggcuucauugcuuccagagcaugagaauucuagagccgaggugcucgugacuuccuuagaguaaguuaaaauuaaaagcagcccagccccagcuagagucagugccaugugugcacaugccggcagcagagccgggagcagugggucugggagggucuucagagguuuccaaggcgaacacaccaaaggccagaaggaaccacuuuccugccucuccgucuggugguccaggggcugcauuugugugcuagagucagacuuuugaguuuuccuuuaaauuggaaaaaggaaacaauaaugauaaaaagaaagaucauaagcuggaucccuucauguuuccccacgccaguuuccucucuguguagcugaaggccucauucuuccuggcuuuuccuggcagagggaaacccagcgccuuauguguuacccauccugaggcccaguaugauaagcccgacauuuagagagggcuuaaugccuaucaagggaggagagacggaggaaggagacuuggacucacagccucccuccaggucuuaccagcucugccacccuugacgagagcucuuccccuccgugggccucagccuccuugucuguaaaacguagacacuaagaaagcucuucacccacccacuccggagacugaggagccguuacuaaguuaguagcucccaucucuccucagauccacccugcccagcagcccgaugaaguggguagggccucaucccuuuggccacaggucagucgaugugcaaagcaggcccugcuuccccgggcagagcugagggccccggccuccugcuguugggucuuugaguggagagcaggaaacugcuggcuuucccccagggaguucuagcugagaaaauacucacucacaggcugauagaaaaauugucauccuaacuuuaggcucccagcuuccuuauuaguuuggaaaggacucccugcuuccucccugugaaugguuuucugaaaacuggcaaggaaauagcagcagguuuuuccuuaggaaauagcaauaaaaaacugaagcccuucucagaaaagccuccagugaggaggccugagugggaagccuggcggcugacccucugcacgucucucccuguccuccgcagauccccugacccccacgccgcccccacccguugccaagacgcccagcguaauggaagccuugagccagccgagcaagccugccccgccugggaucucacagaucaggcccccaccucugcccccacagccgcccagccgccucccgcagaagaagccugcgccgggguaagccacccccagccagcucggccauccgugcuccugcccucugaccucaccugcccagggcucugcaggaauguuugcaauccccagggcuccuacuccagcgugggcgccacauaacuaauucaucggggcugaagggucuuaaaaauaacuggaggauuuuuagacuguaaaaaugucuuacaaauguacauuuuaaguccacagaaugaauucagacaaaguguccucaacacacaaggcuucuggguucuauuugcugcucaccccccagguggucucuguuucuguuuucuauuuucccaagguuguuuugaacacauagacccucuguggugugaggcguggauuucccacaaacaaggacauuguccuaccucacacaauaccaccugcaaaaucaggaaauuaacacggauguagaaacaccacccaauccuuagacccaggucaagcuuagcuguuuguccaaauaaugccccuuguugcagaugggucuaguuuguggcuuuuuuuuuuuuuuuuuuuuuuugagacugagucuagcucugucacccaggcuggagugcaguggcgugaucucggcucacugcaagcucugccuccaggguucuugccauucuccugccugagccucccgaguagcugggacuacaggugccucccaccacgccuggcuaauuuuuuguauuucuaguagagacgagguuucgccguguuagccaggauggucucgaucuccugaccucgugauccaccugccucggccucccaaagugcugggauuacaggcgugagccacugcaccaggccccaguucguggcucuuaaucuggaucuuuauggugggaaaugguuccuuuuaguggaaaugauauuuagaggccaaguucugggggcuagguggagagucacugcucccacacaggcccucugagcuguuagaacuuggaaauauacgcacauguacauggauacauacauacaccacuuaucucucuauuccguauauuucuguauugaaauccaugaguucacauugacaucucugauuucaguuguucuaguaacaaaccacaccagacugacagacaugaggcacagccaguuuauucugcugacagauugucaggaauuuggaugguacuguggggucuucgucuuuucuccacagugucuggagccuucgcugaaaggacucgaagccugggggugguuggacacaggaggugacucguuggcuggggguuacggucagagucucuucacgccccccgugguagcugacgcugccugucagccagagccucagcugggcugugaccagaacaccuacaugucccuggcaugggcuuccucauaucacgguggcuggguccacggacagguccccagagagaggccuggcccuggaagcuggcacggaaugacuuccgccauacgucacugcucaguuacaagcucagacacagucggggcagagaggacuguggaguggcacaaggaagucaucaguuccaccucucaauaaagaauuuggggccaggcgccauggcucacgccuguaaucccaguacuuugggagaccaaggugggcggaucaccugagguccagaguuugagaccagccuggccaacauggcaaaaccccaccucuacuaaaaauacaaaaaaauuagcugggcaugguggcaugcaccuguaaucccagcuacucaggaggcugaggcaggagaaucccuugaacccaggaggcggagguugcagggagcugagaucacgucauuguacuccagccugggcaacaagaaugaaacuccaucucaaaaauaaaaaaauaaagaauuuggagacuaggcaccauggcccacaucuguaaucccugcacuacuguguuuuuguuuuuuuguuuuguuuuguuuuguuuuucuuguguuuuuuuucuuuuuuuuuuuuuuuuuuuuuuuuuuuuuuugagauggagucuugcucugucgcccaggcuggagugcgguggcgcgaucuuggcucacugcaaguuccgcuucccagguucacaccauucuccugccucagccucccaaguagcugggacuacaggugcccaccaccacgccuggccaauuuuuuauauuuuuaguagagaugggguuucaccggguuagccaggauggucucaaucuccugaccucgugaucugcccuccucggccucccaaagugcugggauuacaggcuugagccacugugcccagcccaucccugaaguuuuuuaggaguagagaaauaaaguuaaacuuuuacuuagucccucuguuuuucaagauauucccaauagccgcaccugguaucccccauccagacaccguccguuuugcccucuccaagaauagaagcuuccuguccuuaguagguugggcagggcagcggcuaaggcuacucagagcuggggcgagauuccagggguucaggagcuccucagacagauuuuuggcuaauucuucugcauacuaccuugccuuucuccccuuccagaggguccugagccuucugaggacacuucaggacuacagauaggagcauuucagggccuuccucacugcuggagugggauuccauuccugagaucaacuagguugacugugauuuaucuuucacucuguugcccaggcuggaguacaguggugugaucacgguucaccgcagccucgaccuccugggcccaggugauccucccaccucagccuccgcauagcugggaccacaggcacgcaccaccaugcccgguuaauuuauuuuuauauuuuguagaggugggggucuccuuauguugcccaggcuggucucgaacuccugggcucaagcaguccucccaccuuggccuuucagaguacugggauuacaggcaugaggcacugcgccucaccucuuuuagguuuaauuuuuaaaaauccuuuuccuuggaaagaaauggaaguaaauguacuuaaaucugccauuuuaaccagaagacucccaaaacuuuuuaaaugcuacuuugcaagauaacuuucuaaaauauaacaugcagggcugggcacaguggcucacaccuacaaucccagcacuuugggaggccaagguggguggaucacuugaagccaagaguucaagaccugcauggccaacauggcaaaacccuaucucuacuaaaauuacaaaaauuagccgggcaugauggcacacaccuguaaucccagcuacucgggaggcagaggcaggagaaucacuugaacccaggagguggagguugcagugagccaagaucacaccacugcacuccagccugggcaacagagccagacuccgucucaaaaaaauaaaaauaaaauaugcauaucugugcccuccuagucuuaaacagcuacugaauuaugcuguaauaaaugggcuuuccagugcuaauuauuucugccucuauaccaaaguggccacaggccaugcuucucuuggcuucugggcucucuucugccuucccuuaugacucccugggauuuacgcuuuccaugcugcuguuuuucgagagaaacaaaucacguguugaaguccuggcuaaggagccgucagcucccagcaguuauugggacucugagaaccgugguugucagcugugaggugcagguuccuuguucucagaagcguucuagcuggcgggagcuggacagguuuccucuggaacacaauuuuaccugguuucacaucugacuggcaggaaaaagggaagcagggcaagugagguuagggcuacccgggacagacggggauggacggagccaugucgucagcgcccaguggaguucugacuguaaaggaacacaccgguacgcccuccuugugaaggaugcuaucccuuccccaccaccggugauuuugucucugggauaaaugugaauuuucacaccuguucucuuaggguaggagucagcaaacuauggcucacaggccacauccagccugcugccuguuuuuuagggccaugagcuaagaacuaagaauggcuuuuauauuuguaauugguugggaaaaaaaaaucaaaaggauauauauauauauauauauauauuuuuuuuuuuuuuuuuuuuuuuuuugagacggagucucgcucugucgcccaggcuggagugcaguggcucgaucucugcucauugcaagcuccgccucccggguucacgccauucuccugccucagccuccugaguagcugggacuacaggcgcccgccaccacgcccggcuaauuuuuuguauuuuuaguagagaugagguuucagcauguuagccaagauggucucgaucuccugaccucaugauccgcccgccucggccucccaaagugcugggauuacaggcgugagccacugcgcccggccucaaaaggauauuuuguggcacaugaaaauugugugagauucacuucagcacucagaaaauauuauuggaacauuagccacaccuguuuuuuuauguagucuggggcugcuuucacaccacaguggcagaguugaauacuugaaacagagaugcuagaauccacaaaaccagcugggugcaguggcucacaccuauaaucccagagcuuugggaggccgaggcaggaggauugcuugagacuaggaguucgagaccaggcuggaaaacauagugagaccaugucuuuacaaaaaauuuugaaaguuagccaagcaugguggcgugcaccuguagucccaacuacucaggaggcugaagcgggaggaucacuugaccccaggaguuccgaggcugcggugaacugauugccgcacugcacucgagcuuggguaauagggcaggacccugacucaaaaaacaaacacaaaggccaggcacaguggcucacacccguaauccuagcacuuugggaggccgaggugggcagaucaccugaggucaggaguuugagaccagccuggcccacauggugaaaccccgucucuacugaaaauacaaaaaauuugcugugcgugguggugcacaccuguaauuccagcuacucgggaggcugaggcaggagaauugcuugaacccggguggcagagguugcagugagccgagauugugccacugcacucuaacccgggugacagugcaagacuccaucucaaaaaaaaaaaaaaaaaauucacaaagccuaaaaaguuuacuaucugccucuuuaaagaaaaagucugcucacugcugucucagaggaucaggccuucccugcgaguguucuguaguuagggaugacugccggccagggggucagccaggucaguguagugaugucugcagagacauuuacacccagagacacagauggaaaacaaauggcuagacuggucaaaugggaggggucuuuguuuuauggaauaaaacaaaguuccuuuucaguuccuucagcguaugagcaaaacccaugugauguuuucucucccuucauucugggacugcaagcauugaggccagacaggguucauuccgagcagcgaagggagugucgacagacgggagcguacaguggaaagaaucccauccuugccuuccccuucccuuccucccuggucuuccucuucugcuucuccagcccccguccugugccuggcuuuaugcuagguccaggagauccaccggggagcugaagccacuggcacugguccuuagcucuggaguugacggaucuugugucacaccuuuugcagaugaaaaugcugacucuccagaacccauuuauccagggcugccagguggcagguucgagaugagggaccccucucugccagcccugagaacuacuuccucacucauguguuucuaccuuguggcuuuggggugugcuggcccagagguucauggauggggcuugagcccguggucagccacauugguucccagaagcagggacggcagaggcauggacagcgcugacccagagugcucggacccguccuggcaaagccaucugggccugagguuaagguucagcccugcccuuucaugugaugggaccaaggcagggaaggggcugagcagacucggggcggggccaguggccagugcccagcaucacuccagacccuggccaucgguggcaggcucacguggacagagugcucuggaaaagcccugguuuuaggaucagaaacguugaauuuagcacuuuccucagggccucucauucuuccuuuucccauaaaaaagagacagcuaagugacaguggaggaaaccaccucacacacucugagcuugaacucagaagguucucugauaaaaggggaugagaaaggggcaggugcccuccgguagcaguaaaucuacuuuuucccugucuuuguagggcugacaaguccaccccacugaccaacaaaggccaaccgagaggaccugguaauuauuuaauuugggacugaguuuguuucugcuugguccaugggggcaaugugggggauguuuccugccagguggucaggacugagggagggcccagcugucugccauuccacagcccuccugcccccuccccuccugcccccuccccuccugcccccuccccuccugcccccuuccccuccugcccucuuccucuccuuccuucccuccuuccuuccuuccucccccacuccugccuuccucugcucccuucuccuccucucccccucccucccccaucucaugccuuccucccccgccaccugccuuccuccaccccucccuuccccuccccuccucucacccuccucccugccuuccuccucccuccucccuccugccauccucccuccucccucggccucugagaccccugcuccugagcagcucaguccuggggccccucaccuguccccuccugcugacauggcaggcucacugggggacacucgcugccacacaagcucuccaaggucugcauccaagucagaagguucccuuuccccucaacagaucggaacaccuggggaaaccugcuuucagacacacccuguggcuuguacauuguuuacaucucauggcugugauugaugggaugucuuaagcugcuucauuuuugcccuacaguggaucucucugcaacggaagcucuggguccucuguccaaugcuaugguccugcagcccccugcacccaugccuaggaagucgcaggcaguaagugacgagcccccuuuccugccucucugcucuagccaggggggugcaggugguuucacaagggcucaggggaagcaagucuuccccucuuccccuggcuggggcagggcggggcucuucuugguaccugacugcuuggaucugggcagcugguggguuuggcccuccugccgcagcuccacaaugggcccacucagaguacccugccccggccgcuucguuucccagcccuuggccccuucucucugcuugguggggagcucuucccuuuucucucccuggcuccugagcugcacugaccugccccaccuuggcaucugcaggcuucucaggccuagguacgggacuccugagaccggggaaggcagggugcuugagcucucugcccugagagcugaggccugcagccacacuaaccguuguucccucuccugacccagaccaaguugaagccuaagcgggugaaagcgcucuauaacuguguggcugacaaccccgaugagcucaccuucuccgagggggaugugaucaucguggacggggaggaggaccaggaguggugggugagucaagggugggccugggagguuccugggggcugagccacgucccugcccaccuggcuggagagacgggcuugcaggugagguuuucucagccugagcaguccagauguaguuccuggugccuccgccccuuagcauccucaggagcugcuuccuccauggacacccccuucugagcaggccugauuauuccccaggguggcuuccuccccuguuagggugcaguuuccacagcacucaugagggccugaaaugacacuccuucauuuugaggucuugaguuucuaggucaucaccccccauugcuggauuaguggaaucgggugucuggagagagcugaccuagagcgcagagccccaggccugagucugguccugaaacaagcuguggccgcccaggcguccagcagggugugggagcaagaugagugccggccaccuaagaauucagacuuggccacucaggggcugguggcuuggggcagguugcuuuuaucuuuaagcauuagugggaucaucugugacagggaggucacacacacacagucuggugcaggugaucuugugagcacccacuaagcggcagcugcagacagugagggcgguggaugaaccggcuugaauggggcguggacagaaagccccaggcugagcccaccacacaguagacgcaaguggcacagcuccgcaacugagcucagagcagacaguucagcugggaacucacaggauuuaggggaacuucuuugucgagugcgaggaguuuggacacugucuuuagucacugucccucccagaacucccacuaguguuuaaacugcaugucuucagccuccagaggcgcugugagcucucagggccaggcagcacugccuucauuuggcagagcuggguucaccggucuuuccuguggccucguuugcccuuaauggauugaaagugucuguggccugggcgcgguggcucacgcccauaaucccagcacuuugggaggccgaggcaggcggaacacuugaggucaggaguucgagaccagccuggccaacaugguucucuacuaaaaauacaaaaaauuagcuaggugugguggcaggcaccuguaaucccagcuacucgggaaccagccagcucccacaguugcccacaacccaccauccggaaggggcgccaaccugaccacaggcuuagccauguggaaaauaccugcucauuuccaaaacuggaaaauagaggcauaaagaagaaaacagaaguugcccauaaccacagcaccccccacccacuccacaaaaagcccaccauucauauuuuggcuguuuuuagccuuuuauuugccuacaucauuuacacucuugagaucauauuuggauauaauuuauguaucuacccaagagggaacauaaguggauagagugaagccuuccacaaguacuuaacucauugaaauggggccaacuuauaccuuugccacuuuaggugacguugcagcucacaaacuugugacacucaguucauucauucauucauucauugaaaaauggcaagugggaaguaguggucagacagcugaccugugugccucccaagaacagguggggguggccauccccacgagcgaacaucugggacauggcugggaagagcuccuuacacgggagaggccugcacuauuugaaauguggugaggaaaaacggacaaaaaucauuuggauguuuuaccuaaguaauuccuugucggaagagucuucugaaccaaucuugcuuuucuucaccaaacgcucuauguaaugcucuucaaaguuuccaccaacauuuggaauuuuaauaacaaccuacacuuuucuccauuucagauuggccacauugauggagauccuggucgcaaaggcgcauucccggugucauuugugcacuuuaucgcugacugaauugcuacugaacaaaagcauuaacaguuauguuccuguuucguuauugguaccaaaacucuugccagauaaccaguuucaugaacuguuuguauggcagcccauguucucuaaugccacugcucuguuuuaaaaacucagaggcaauuuuuacauaucaguaauuguuuuuauaauuugugguuuucaugaaacauugcuaugcauuuauuaggaaaaacugaauuucccaacaggugaacugaaaaguuauuuuaacuauuauacauaaucaagauccugccucuacggaauuagcuaaaccuaaaaauguuugcauuaaugaauaaauucuuccugcauuccuuggcccaguucuggaguuggugaccuuuaucacaauuauuauuuuaggcggccagugaacugcugcuucagaaguccauagcccagcucugaacuuucucgauaaaaugccaucaguucaccuuuaaagacacacauuccuuugaaauccacccaguguuuaaaaagcaacuuggaaauuuacacauuagcauuguacuuucuagcccuaauuugugagguugcagcuaucauuauauucugcauguauguauaaccuguugugaacaaucauacuuaacaaaacuacugaugguuuaugacaacguaggguaacuacaguucauucuguuccagguuauauaaaacugcauuuccugaauuugguuaaaaacuaaggaugauggauugcaaaacaguucuuuuaaauuaguuuauaugcuuuagguguuuuggaauuugccuucuugaacuuccugagucacacagaaagcaacuguacacaguagaauucuguggcgcagaccaugcuguauuaacacaucacuugcuguuuccuacugaguguaccacugccuucccuucuagcccaggagaauguuuacucaguuuagugucuuguauuucuauaauacuccaacaggaaugguagucacacugucuugaaauugaaucuguccaucuguuuauaaucaagaacauaucagaaauauauaggucccagguaauacucccaaacaucccacuuuuuacuguuucaggccaucauaucauucuuaagcuacuuggggugguaguagaggauuagguugucuauuauaaaaccaaaacucauucguuuaaugaacuugacugucauaccucuauuuaguaauugcgaggguaagauucauaguaggaauauuggaaauuuuggcacucugagaauaaauaggcauaugauacccacuuggacuuuuaacaaaaguaaaggaauaaauuugcauauaggcuuggaaagugaggcagcaaugcuguuaacugcauuuguugugauggugcauuugauugaagcagcuugucuuuauuaugcaagacuguguagaguuuuuuuuuuuuuuggcauuguacuuuuuguuuuuguuauaaaggaagacagaacaaacuggaauguuuuaugauguuguauagcaaucgcuuuuuaccuuucaaaguuccggguaaaaauguguuauaucuguaguuuuuuguuuuuguuuuuuuuuaaagcacuacaucuguuuucacuaauuguuaauuucuguuugaacccuucauuuaauuuucucauagauuuaaguaaacagauguauuuugcacagugcacuuaugucuauuuuaacaauccuccugcaucuguauuuuauagucagccuuuugaccaccuggugccagcuauauaaggaauaaaguugauucauaucaacauuagaacuccagucccaaacuaaucugucagguucacugguacauaaauaccuaggaaauauuuuuccagucuacaauuuggugcuauugugcaguaacuaauaguacucuuaccagaggagaaauuauauuaacgacccugcuaauauccuuucuuaguuauuugcuccuugcaaauuaaaaaagcaacuaagagaaagaaaaacauuguagauaucuauuuauauuuaaaguuuauguuucaugaacugcagcugcaggauucuggcauuuugcaugccauucuccaucagaucugggaugauggcucagaacauguacacagacuaagaguaacugugugaucuguuaagggguggauaacauaauaugcagcuuaggaugcuauuuugagauguaugauauucaguucauucaccugauuacuuugguugcagcacaacuguauauauuguauaaccgaaauugauuauuuucauuguccuuaaugcagugauuuauaauuagagcauguuuaauaaguuuacucuucuuguuaacuagucauuugacuggaaaaaaauaaaauacuuuuaaauggacaugg

SEQ ID NO: 192347 - RNA, 66507 nt, Homo sapiens
accugcacuucugggggcgucgagccuggcgguagaaucuucccaguaggcggcgcgggagggaaaagaggauugaggggcuaggccgggcggaucccguccucccccgaugugagcaguuuuccgaaaccccgucaggcgaaggcugcccagagagguggagucgguagcggggccgggaacaugaggcagucucuccuauuccugaccagcgugguuccuuucgugcuggcgccgcgaccuccggaugacccgggcuucggcccccaccagagacucgguaaagacccaggggaguuggcuuaggccggcgccuggagcgcucguuugagggaagagcaggggagcugggucuaucagguguuugggggcgggguauuggcgaugguggcgcgucccuaaguuuucaguguagaaggggguguggcucucggaguuuggggaaagaauaaaggagaugggccugucucugagugggaaagggcuacuggacgggcuccauguagugacugagcgccugagagggguuugcucccuagcuuuguguucggggaggguguugggaaagcgguaaggaguaggguggcuggaucuuguuuggagagggagauguggucaggguucuugccuuaguagggaacaaaucuaguguuguguguuccuaccagagccagaaaggaagggcccaaagcuccagaauucuuccugguccucgaaggagggaacuagaauuucugcuguaggagguacuuaugcaguaaucucguugggaggcggagacuggaguuggagucuuaagaguuguguuuuugcgaacauccuaagcacguucuugguuauuucaauuguagcuuauuggaggugcuugggagauggggggaggcggaaaccugguaagccaacucgugaugcugccacuaugaaugcuuuccuugcacuuuuaaacaaagaaauuaucaagagugacgaguuugaugaauuuagaggcuagaaaguagaggguuccuauuucauuagauuuuccagagagauuggauuuuaaggauggagaugcauuaagggaucugaacuuugguggaaguaaguuugcgugaacuuuuaguguauuuuaaaauccuuuuaucuuucaaaaauugacguguaagauacuuuaauuaguaauaaagugugaaauaauguuuucccagugugugaaauuguaggcuugcaugguuguacugguucccaaauuucaccaugauaccauguguaguauuuuuuuucuuuauauuuaguggacagaaauuguaauggauugguauggauacuaaagguguugagaguguuaucacuugaacagcugucuuaugauucuuuccgauugaaauggauuacaagugacuaaugaaaggcaagggaucuuguuaggaagugcugagaagugguaagucaguacaaauugaaggacauuuugagguaggauugugguuaggauggagggauaggguaagggucuucauuuuaaggauaaauguuaguaaaaagaauaaauauguauuuugagauauuaaaauuauauuugcaccacccugacacaacuguuucacuuauguuauuaaucuguuguucguagguaaaaauaagcaugagucccaaggaagcauacaguuuaaagagaaacauuacuuucuagaucaauucauaacauuugcagaucguaagguuuuuuagaccauuuuuuuuuuccaagacagagucuugcucuguugcccaggcuggagugcaguggcgcgaucucagcucacugcaaccuccgccucccgggguucaagcaguucaccugccuuagccuccugaguagcugggauuacaggcaugugccaccacgcccagcuaauuuuuguauuccuaguagagacgggguuucaccauguuggccaggcuggucuagaacucuugaccucgugauccgcccaccugggccucccuaagugcugggauuacaggcaugaaccaccgcuccuggcccauguguuuguuuuuuauuugcaaaaugcagaccaccugugccagaagaaugcauagacuuuucuuuuuucuuuucuuuucuuuuucuuucuuuuuuuuuuuuuuugaggcaguguuuugcucuuguugcccaggcuggagugcaauggcgucaucucagcucaccacaaccuccgccucccggguucaagcaauucuccugccucagccucccaaguagcugggauuacaggcaugugccaccacguccggcuaauuuuuuguauuuuuaguagagaugggguuucuccauguuauucaggcuggucucgaacuccugaccucaggugaucagcacaccucggccucccaaagugcugggauuaaaggcuugagccaccaggcccggccucuuuuuuuuuuuuuaaacgaaauauuugaaggacacacaaguauuauacguggcauuggaaauacaaagaucagacgauauccaucuucaaaugguuauagcauagggaaauagacauucauuuaggacacuucuaaaacagcauagaggagagugcuagaguacguuauagcaaguguuaucaccaaaugaaucuuagagaucaagucuaguuuucaaauaaaggaggaggaaaaugagucucaggaagaugcugucaguugucaaugaugaacauaggccuuguggguauuuuucuuuugaagaaugacuuuuuuuuucaguuuguuugacagcuuacaauauaauuuguuacuuaaccuuaccauuagauugaguuggucaagacuagcaaauaguuucauaguugaaaaacaugcuuuauuauuuauuuuuuauguuuauuguccuacaaauacuacuauauugcaguacucaauaucgauuaggcauaugacaacauuuuucugaaaggcaaaaaauaccuaauaaaaugaagccugguuuuuagaguccucuaugggucaccaaaaaugauuucaauugaacuguuaugaauugcauaauuuaggaaaguuaugagucauaugagcuuagucaugaugauaucuuguugaaguugcagcugggguguauaagucucacuuugauuucaaaaucguuuucccuuuguguuacuuuuaauaaaagaggauguagugggugggaggaaaaaauauaggucacagaugagggaugagaaaguuuguaucugaaacauguauuuucaaauuuaccuugagguuauuggcauggggauucuccauauugcagugcugauuucauuauugacagcaccauuuuacucaguauuuugacaucuggcuuucucuuuugauguuaauuuugcuuacuggcugcauuccuuugaaaccuaaaugcuuaacugcccuaacugcuccaagggagauuuaauguaacucugcuuuauauuagucuaagagauaaaccauauuucaagaguagaauggagaggaauuaagcagauaauugugauggggaaacuggagagauccuuuugacuuucacaggauuuccuagaacauuaaauauagguuuccuccaaggccaauugugguugauuuuuggauccuucaccauuuucuauuugugagauaauaaguguauacagcuggaaguguaaugugaagaaagucugaaaaagauugauaggaaaggaggacaggaaugggcuucauugagguaacggaagugaaaugaaaggcuuuucauauauggguugagcaucccuaaucugaaaugcuccaaaauuugaaacuuuuugaaugcuggcaugacagcacacauuaccccuaacacacgauuuuuucacuguuagugguauauuuuuuacuguguaguacuuaugugugaauagguauaacaaaacgauuacuuauuguagcauguaaaaucagucaggaaugauggugaugccagacaaccacagauuauuuauguggguggccgagacagugacaccuuugcuuucgaaugcuucguuguacacaaacuuuuuuucaugcaaaaaaaguuacuuaaaaauauuguuuaggccaggcgcgguggcucaugccuguaaucccagcacuuugggaggccgagcuggguggaucacgaggucaggagaucgagaccauccuggcuaacauggugaaacccugucuguacuaaaaauacaaaaaauuagccaggugugguagcaggcgccuguagucccagcuacucgggaggcugaggcaggagaauggugugaaccugggagguggagcuugcagugagccgagaucgcgccacugcacuccagccugggcgacagagcaagacuccaucucaaaguaagugaauaaaugaaacauaaaugaauuuuauauuuagacuugggucccauccccaagauaccucauuauguauaugcaaauauuucaaaauuuaaaaaauucugaugaaugaaacacuucuggucucaagcauuuuggauaagggaugcucaaucuguaucucuuuauuuacuccuaaaaucagccaaggaaaugggcaucucuccguucccccccuuccuuuuuuuuuuuucuuuguuguuacaugaguuguacugguuucacuucauuugacaguguucugcuaaugacuagacguguaucucugaccuggacuuguucucuggaguucauauucagcugcccauuuggcacuucaaauauaacauguccaaaauuaguuaccuuuuuuuuuuuuuugagacagagucucacugucacccaggcuggagcgcaguggcgcaaucuuggcuuacugcaaccuccacuucccagguucaagugauucucgugccucagccucacgaauagcugggauuacaggugucccccaccacgccuggcuaauuuuuuuuuuuuuuuuuuuuuuguauuuuuaguagagaugggguuucaucauauuggacaggccuguguugaacuccugaccucuggugauccaccugccucagccucccaaagugcugggauuacagacgugaaccacugccccagccaguuaccuauucuuuugauuacaagaaugaguagcuggacacaguggcuuacaccuauagucccagcacuuugggaggcugaggccggcggaugacuugaggccaggaguucaagaccagcuugaccaacauggugaaaccugucucuacuaaaaauacaaaaauuagccaggcgugguggugcgugccuguaaucccagcuacuggggagacugaggcaggagaauugcuugaacccgggaggcagagguugcagugugccaagguugagccacugcagugcagccugggcagcagagugagacuccaucucaaaaaaaaaaaaaaaaaaaaaaaagaaugaguaucggauacagguuuagccuaggacuaggcagggcugcugguaauuguggaaguagucucauugccuaaccugaaacuugcauccugguuacuggucuugcuggagagucuuggcucagguuacgucccaggucuguugaggagcucuugauagggaauuaguugaagcagcucauacucuauccuccuuuacugguauaaauccauaaaauuguuuaguucccaggcucuggggucccuggccuagcagagagcacugcucccuuuuucucauuccuuagucccaacaacccgcaccugacacuuacuacacguggccugcuucccuguccuguguguuuuggggggugcugaagaggaaggcuccugugucuucagcacaaacacaauaaacacuucacagcaguacuggcuuuauguuuuccauuucugauaucagaaguaggagcaugacauugauagugucauuuugggggaacuuuucguacuucaugcagcagagcagugaagagugagcugagugccuugggguucugcaguacacucucaaguaguauuuuaggaaaaugcaauuugcugaaaaaauaaaagaaauuaauguaaaaaauccacaagcugggcgcgguggcucacgacugucaucucagcauuuuggaaagcuaagggggaaggaucacuugagcccaggaguuugagaccaggcugggcaacauggcaagaccuugucucuacaaaaaaauagaaacaaaaauuagccaggugcgguggcaugugccuguggucccagccacccggaggauugcucaugcccaggagguugaggcugcagugaguggugauugugcccugcacucuagccugagcaacagagcgagacccugucucaaaaacaaaacaaaacaaaaacccacacguuuccagaaccuucucauauaacacuuuauuuacauuguucuuaaauacgugugggacgguuauauacauaccacuauacuuauguguauauauguugauauacacacaaaauuauauacauaauuuuuguuuguuuguuuuugagauggagucucacucuaucaccuaggcuggagugcaguggcgugaucucagcucacucacugcaaccucugccacccggguucaagcgauucuccugccucaggcuucugaguagcugggauuacaggugccugccaccgcgccuggcuaauuuuuguauuuuuaguagagacuggguuuuaccauguuggccaggcuggucuugaacucccacccuugugauccacccaccucggccucccaaagugcugggauuacaggugugagccacugugaccugccauauacauaauuuuuuaaaguuucacgauuaguuuuagcuuaaaaaugucagcucugggcuuaaugaagaaaauauggauauacuuuaugucaaugcauuaaagugaauggccauaaaagcuuaucccagagacaaaacaauucagauauaagagaagugggagaguggaagguuuaucuaaucuucuguaggcaacuccacagcuacaaccagaaggccauuuuguuacaggccugaaagccccguuuucuuuuuauucuucuuugaaaccuuuagaaggaacaaaguauuggcuacuuuuuaccgcugaugucaguguuaagaaucuugugauaacauagauuuacucucccugcugaaaaucacuauguggcucaucaguaacacaacuagacaugaugacuuaaugcaaaggaaguccuauguaaaugagcaaugaaauugcaacuguguauaaggaacaaaauagaauaugaaacuccagaaucuuuuguuuucauuucuguuucucccaaggcucuaucauucaaaacuccagaaucuuucagcaugcaauugucuccugauaucagccccucucuuguuuuguuuucuuuuuuuuuuuuuuaaucacagugagccacaaccuaggagucuuuuagugguuucuacuugguuugcucugcagccuaccagcagauuuccuacauuccggucuuguuccccucuagcccauucuccacacugcagucauaaugaaauuucuuucuuuuuugggggggauggagucucacucugucacccagguuggagugcaguggcaugaucucggcucacugccaccuuugccuccuggguucaagcgauucucaugccucagccucccaaguagcugagauuauacgcaccugcuaccacgcccagcuaaucuuguauuuuuagcagagacaggguuuugccacguuggccaggcuggucucuaacuccugaccucaagugaucgcccaccuuggcuuucucucucuuuuuuuuuuuuuggauuuugagacaggaucuggccucguugccuaggcuggagugcaguggcacgauaucagcucacugcaaccucugccuccugagcucaagccauccucccaccucagccuccugagcagcugggacugcagguguacaccaccacgccuggcuaauuuuuguauuuuauuuuauuuauuuuuuugguagagacgggguuuugcuguguugcccaagcuugucuugaacuccuggggcucaagcgaucuacccaucuuggccucccaaggugcugggaugacaggcaugagccaccacagcuggccuauaaugaaauuuccaacuuacagcuauugccauuauccaaagcccagaaucccugauuuccuuccauagcccuucauggccugaccagugccugacucuccagccucacacuucauauucucucuguacugcucugcacuguagccucauugaguugcuuucacgucuuuaaguguuguguucuauuuuuuguggaauucagcauauguuaugcccuugaccuaaggccucuccuuucuuuuccuucucuggggugcugccucauccuucuggucuucaaaaccguuucccugggaaaacaucuuugacucagcaggcagggaucaugccccugcugugucugugcauaacuuucuguggcuacuucugucuuggucugugauguacuuuauaauaauuuuggucuuuccuccagugucacaauacuggaagucuguuucuuuuucucuguguuguauccuuagugccugaaagguaggagguucucaauaaauauuuguuaaauaaucaaguaaauggagucugguggaaaagagaaaaaauaaguguagaaugugugugcaagaaaggagggguagggggaugaaaaagauaacaaaagcacauaacaaaacaacaaaaagcaaaaacaacaaaaaaugcagaugacaaaaaagauaacaaaaugaugacugcuguggcaacuuguagaaaguaaggaaggugcucucauucuagagagaaguaggcagccauuguaguuuuuuaaagagagaauaugggcugggcucuguggcccacgccuguaaucccagcacuuugggaggccgaaguggguggaucacgaggucaagagaucaagaccauccuggccaacacagugaaaccccuucucuacuaaaaauacaaaaauuagcuggauagguggugugcaccuguagucccagcuacuugggaggcugagacaggagaaucgcuugaacccaggaggcggagguugcagugagcugagaucacgccacugcauuccagccuggcgacagagugagacuccauuucaaaaaaaaaaaaagaauauggccagacacugagcugagauagacagugcggcagugucugguauuaacuguaauaaacucuacugucagaagcaggugguuuauacuuaaguuuauugagagaauuggauauggauaagagauaaacucuugggaaauggggagaaauauaaauucuguuguaaagccuguaaaaaauugagauuacuagugguuagaauuuuggaagugaagugcagugaaauauugaguaccugagagguuacuuguuagugaaaacacaauagcaguaguacguagcuacaguuuggcuccaaaggaagaacuguuuuuacuauaguuuguaauggcuucagaaucuucaauuugagauauccaguuauuaaaagagaaucaauugcaguugaaaugcauuaguuaaguauuuuaaagugcuuuagcaagcuacauuuaaaaagugcuuauuauagaaaauauacccaaaauaaccaaugauguuacugucuugugcuuauuuuuucuagaccuauuuuuauacauaguuaagauuauacaauaugaauauuucugaaaucuauauuuaacauuauaacauauguauuuuuccauguucuuucuuuuuuuuuuuuuuugagacugggucucauccugucacccaggcuggagugcaguggugcuaucuuggcuuacugcagccuugaccuccugggcucaagugauccucccgccugaaccuucugaguagcugagacuacaagcacaugccaccaugccuggcuaauuuuauuuuuacuuuuuggagagaugagggucucacuauuuugcccaggcuggucucgaacuccuugggucaagcaauucucucaccuugaccucccaaagugcugggauuacaggagcgagccaccgcccucagccccauguucuuaaaaaccuuuugugaacgacauuuaaaauaguugcagauuuuuuccccugucuuuggaaguguuacaacauccaaccauuucacaguuacuaauuuaccaucauucugguuuuuguccuugaaaauaaggcaaggcugaauaaugaacaucuuuguggcuaaaguuuuuuucuuuacuuugaguuguuaccuuccuuuagcuuaguucagugguuuuuucuuuuucuuuuuugagauggagucuugccuuguugcccaggcuggagaguaguggugugaucucggcucacugcaaccuccgccucccagguucaagcaguucucuugccucagccuaccgaguagcugggauuauaggcgucugcugccaugcccagcuaauuuuuuguauuuuuaguagagacaggguuuugccauguuggccaggcuggucuugaacuccugaccucaggugauccacccgccucugccucuccaagugcugggauuacaagugugagccaccaugcccagccaguucagugauuuucauauuugagugugucagccuugccuggaagccuuguuaaacacagacuauuggaucccacugggcggauuucuguuugagcaggucugaggggagaccugagcauuugcauuuuuaacaaauucccaguugaugaugaugcugcugguuugggaacuacacuuugagaacuacugggcuauauuauugacaaugaaacuauaauguugagguuaaguuccuaagucaguaggagugauuaugaucuugaaugaaacugaguucauguaccaaccuguaucagggaaauugaagaacuaaaggaccauauugcauuucagcacugagaauucgugcaguuugugaacaugugagugcugauaugugcaagguuuuugcugaguauugugaggcaaggauguuguaaugaauaaaaaauagcccuuuuuggcuuuuuuuuucuucuuuugagauggagucuugcucugucgccaggcuggagugcagugaugugaucucagcucacugcaacuuccgccucccagguucaagcgauucuucugccucagccucaugaguagcugggacuacaggugcccgccaccacgccuggcuaauuuuuuguauuuugguagagacuggguuucaccauguuugccaggauggucuccaucuccugaccuugugaucccccugccuuggccucccaaagugcugggauuacaggcgugagccaccgugcccagcccggccuuuuuucccccgccuagagauggagucuugcucugucgcccaggcuagaguguaguggugcaaucucagcucccugcaacaucugccuccuggguucaagcgauucuccugccucaaacuagcugggauuacaggcaugcaccaccaugcccggcuaauuuuguauuuuuaguagagacaggguuucaccauguuaaucaggcuggucuggaacuccuggcuucaggugauccuuggccucccaaagugcugggauuacaggugugagccaccaugcauggccucauuugggaaacuuuugauaucagaaucuuagguuuuucauuagagauugucagauuuccauauuccucuggaagguaaaggccuaauugcuagcauucuggaagccaguuaggguaggaggguaggaggguaggguauuggguagaggauaaagaagggguuugggaaagguggggggugucucuuggcaguuguaugguuaaauugaguuuuuguuuuauuuagugauauguguuuuuuggguacaugugauauuuugauaccuguguauaauauguagugaucaaaucagggugauugggauacccaucauuugaaacaucuuuucuguguuaggaauauuacaagucuucuagcuguuuugaaguauacaauaaauuguuaacuauaauuucuguacuguacuaucaaauauuagaacuuacuaaucaaacuguauuuuuguaacacuaaccacuuucuguucaucuccaccacucccacuucccuucucagccucugguaaccaccauucugcugucuaccuccacgagauccacuuuuuuagcuuccacacaugaguaagagucuuucuuuuaaaacugguuuugugagcauauuuaacaucaguagcaauaaacuuguauuuuaagcuccuguugcuguauuuugaggaccuucuaaguccauuggaaggauuuugaauaccauagugucugcagugauaguuguugaaagaaagggaaggcaucagugcaaauauuuuuagacaguuuuuaaagagacucaagucacccaauuugucuucuaaaaauccugauuuuggaagaggcaguggaguuucuguugauaaaaaaugauuuauaguuugugcuuggcacuuccuaauggauuacaucaggaaagauuuauugucuggcacucucauuuuaacgauacuacaauugauuauuagguuuagaugcuaauaccuuuuuuaccuuuauuucagagaagcuugauucuuugcucucagacuacgauauucucucuuuaucuaauauccagcagcauucgguaagaaaaagagaucuacagacuucaacacauguagaaacacuacuaacuuuuucagcuuugaaaagguaauuugaauuauucauggaauaauguuggggcacugggggcuugguuuggcaaaaacaaaaaaguaaggguaucuacugaaaucuugggaaauuacauuuuaaagauuuguaauuaauuuccaguauaaugcuuauucuaaaauucauacuggggcugggugcaguggcucacgccuauaauccgagcacuuuggggggccaagacauguggauugcuugagcucaggaguuugcccaagcucagccugggcaacauggcaaaaccccgucucuacuaaaaguacaaaaauuaggcauggugacacgugccuguaaucccagcuacuugggaggcugaggcaggagaaucacuugaaccagggagguggaggcugcacuagccgagauggugccacugcacuccagacugggcaacagagugagacucugucucaaaaaauaaauaaauaaaauaaauaaaguucauacugaugaguauuuuuaaaaaaguaaauagauauugcagagguguuaaugaugguaacgauguuuagaaaauucuaacauaauuuaaauuaauugaaugcuuauaaaaccuuuuguuuuuggugcuacuuuauaaccaucaaucaugugcuaaauauuaucuuuauauaugaagagauaaagauuuuguucaggaccccacagccugguggugagcugggucuagauuuuacuguucuauuuauuuauuuagcuaacuaguuacuuaguuuccaggauucuuuaaccugcuucauauuuauuuauuuuuaaaaacagggucuugccauguugccaaggcugaucuugaacuucugggcucagguggucuuuccaucuuggccucccaaagugcugggauuacaggugugagccaccaugccuggcccaaauuuaauauucuuucuacauugaguuccucuuacuucuuagcauaaauugauggauauguucuauuucaguaguaauuuuaauaccacguauuguuuugcacauugaaauguuaaauaauugcaggccucuuuuuaaagucuuuaggaagcuuuauucaguaucaaaaaacagacacauggagaauugacugaauuauucuuuauuuauuuauuuuuuugagagucuugcucugucguccaggcuggagugcaguugugugaucuuggcucacugcaaccucugccuccuggguucaagcgauucuugugccucagccucucaaguagcugggacuacaggugcacagcaccacgccugggugauuuuuguuauuuuuaguagagacagaguuucaccauguuggccaggcuggucuugaacuccucaccucaagugauccacgaucucggccucccaaagugcugggauuacagacaggggccacugcaucuggccaucuuuauucuuuauauaggacaagccuucucaacuauguuaaaaaauaaaaggaauaugugcgucugguuuaaaaaacaagccauggaggauaugcaaaguuuuuacuucuaacucaguuagacuucucagacccagagagguuuccuuuguaaacuuccaauuuuuuguuuuguuuuguuuuuuguuuuuugagacagaguuuuugcucuugucgcccagacuggagugcaauggcacgaucuuagcucacugaagccuccaccucucggguucaagcaguucuccugccucagcuucccgaguagcugggauuacaggagcccacugccaugcucagcuaauuuuuguauuuuuaguagagaugagguuucaccauguuggccaggauggucuugaacuccugaccucaggugauccaccugccucaggcucccaaugugaugggauuacaggugugagccaccgugcccgacccaaaauauuuuaaugcauguuuuuugccuauaggucucuguguguguauaggugauauagauagcauauuuaccucauuuuaaacagcugcauaaauauuccuauugcauagaauuguaacaacauacugacuaauacacuacagauggauauuguuuaaccaaagugauuuuuuuaauacaacaaacagugcucuagugaguaucuuuguaaauguguaccuugaugagguguuuuuauaggauauauuccuggaaggagaauuacugggucaaggauauguauacuauguuuauugauauugcucuuuccucccaaagagauuugacaaauuuauucuuccagcagcaauauaugaguuuaccuguuuccuguuaucuuugccaauaguagguuuaucagccuuuaacugucaccccucuaaagggcauggcauuuuauaguuguuuugauuuucauuuugugugacauugagcaucuuuuuauauauuuguaaguaauuuguuuuauauuucuguaaacugccuuuuuaucucuuuugacuauuuuucuauugaauuugucuuucuaacuacugaauuguagcagugcuuaguauauuaaggagauugguucauugucaugugguuauuuuaggcaaauuuuuaaugcaaauuaauuuuuccuagcuauugcaauuauccuuagguuauuuuuuaaugacuucuuuuuauucgauuuuaugucagaauauuauaguauugguuauuagcuuucaacuuacaccaaauuugagcagauugguaauauuaauagcuacaguuaaucagguacuuauuuucuguaauuuacuggcauuuuacauaaguuaucucuaaaagugauuccuuuuuugaaggaacaaaaaaaaaaaaauuaaggcuuagacagcuuaguaacuugcccaagauuacucagcuaguaaaugacagauacaagauuugaacaaagguuggacuccaaaacuuguguuauuucugcuauacugguggagaguuuggugaagaaguggauauaguagcaagaaauaaguaggagcgaaggaagagugaggaaacuauaaaaugaaaagaacucaaaguuuagcuuuuuggguuucuuuggauuugaaguggccuguagaauccguauucuagaggcaaaaacuuccauagccuuacauauuucucuuucaaguuucguagaugacauugauucccuaagaaaauauuaaaucguagccacuuguuaucuuuucucuguguaagaaagcagggaaguauguaauuuauuuuacaaaguuuccauacuaaauauuuaaugggaaauuuaucuaacagucuauggaauuuuauaccagguguuuuaaaauagguuauuuccuuuaauccccaaaaccguucaguuauuaggugauauuauuuccauuuguagauaaauacuuaggauucaaagauugaggccaaggucggacagugaguaaaugaaaguaggacuuaagccaaguuugucagacuccaaagcccauacccuuucuuuucuaucauauugcgucauuaaaguuuaaaacaagaacaaaaacaaagauagcugaaguaaucaguuuguaucagggcugaauuaacucuaugaaaccccucauuacuugaugguaaaugagaagauuccguuuuucgauagcaguggaaggcaaaguaauuuaaaccaagaucauugcauuaaauuuggauguaacuauuagagguugaaaaagcauagaaacacugagagguuguaugaagaguugaaguaacuuaagaaaaaaagaaacuuguuuaaaauuugccuuacaaguuucauuuccuuuuuguuauaaaucaagaaauuaucagcuaggcguggugacucacacauguaaucccagcacuuugggaggccgagcuggauggaucaugaggucaugaggucaggagaucgagaccauccuggcuaacacggugaaaccccgucucuacuaaaaauacaaaaaauuagccaggcgugguagcaggcgccuguagucccagcuauuugggaggcugaggcaggggaauggcgugaacccaggagguggagcuugcaguuagccgagauugcgccacugcacuccagccugggcgacagagugagacuccgucucaaaaaaaaaaaaaaaucaagaaauuaucuuauuuuuaaauaacgaaaaagcugcggaguauauacuguuuugauacuuuuuugauguugccugaauuuuuuuggaaaaaguuaaauguuucuccuaaaagugaaauauaucagauuacuugagaaggucuagaacugauaaagaaaugaaagugauauaccugacuaaauggaccauuaaaaaugguuaggguaauaauguuaauucaaacugguuagcuggucuuuaguuacuguaaauucuuaagucaaaagucagaaagauaaaacguuaaagaaaucuguaagaaaaugacuucacauaauuuugggaggauaaaguaaaagaaauuuugacauucuguuggacguuuuauaacucaaaagcuaauauuggaaaaucaaaaaacaugaauuuuauaaucgcuuggucuuuaucuuuagaaaagauucuuaauguagcaaaugaaaaaugcaauuccacugauuucuuucugaaaagaacauuaaguaauguugcaacucuuagcuuuaaaacaaaauaauaagacauuuauaauaaguaugcuuuugaaaguucucagcauaacuggagggaaaaaucauaacugagaaugugugggaagauauguuuuaggauagcagaagaaaauguuccaaggauuuacgaaauaauguucuauugucuuuucccuuugaccauuaaaaaaccacaagcaaacuaaaauuaccuuguuaugcucaaaaaguuaaaaauauuuguugccauggagauagucccagucuagauuucuuuccgguaguuuaaagacuuuugcaaucccauggggaaguaauauauuuucaguacaacagcugacaaaauuuguuucugugggugagaugaauaauauaccuuucuuugucuuugguguucauggacacauugaaagacuauaaauaauacuugagaaagucuugcucaccacuccuaguuuucauguaaggauggaaagucauagaaaacaaaaagaauaguaagccaauuaaagaacuggacugaaacucaacaaaaagaauaguaagcccacuaaagaacugaaguguauacccccuccccucuccuccccucccuuccccuccccucccuuccccucccuuccccuucccuuccccucucuucccccuccccuuccccucuccucccccucuccuccccucuccucccccucuccuccccuccccuccccuccccuccccucuuuuccugucuucuggugccaauggagucuauauucuaaugucugucuuagauaccuuguauuuauuuuccuaacuguaauuguggguuacuuuuuugcaagauauguuguuuugaggaggaaaaaaagcacgaguacuuuuuuuuuuucuuauuuugagcgggagucucgcgcugucaaccaggcuggcgaucucggcucacagcaggcuccgccucccggguucacuccauucuccugccucagccucccaaguagcugggacuauaggcacccgccaccaugccuggcuaauuuuuguauuuuuaguagagaugggguuucgcuguguuagccaggauggucucgaucuccugaccucgugauccgcccagcucaaccucccaaagugcugggauuacaggcgugagccacuacgcacggccgcaugaguacuuuuaaauauagaaagcagcauuuauuaauuuugcacagcaauaagaauuuucucauaguccacccagcuugauagagacagcauaguacaggguuuugaaauaaaccagguuuauuucccaguuucaccauuuacuagcuguguaacuuugaguagguugauuagcuuccaagccucaauuuguacuugugugaaguggggauaauagaugcauaguaccuaacaccaaguagguguucaauaaaugguauauaauaggauuaguuuuugauaauaauuuuuuuagauaaucaggauuccaacuuaacuacgcagucauguguguuuccuuauucuucaguguuuuccaggagagaugaauguauaaguucuuugaauaucuuuacccuagugugaguuuauugugaucugcuguuuuuauagcuaaauaaauuaguucauuugucguuacaggagauauauugcucuaaguaccuaauaagacuuuaguuguaacuugcauaguguuuuauuaaugucaaugcuucuggcuuuuuaagaaaguuuaauuaugugaaaaugagacuuaaaauuugugugcuuagaguaaaauaugaaugcauuuuucuucaggcauuuuaaauuauaccugacaucaaguacugaacguuuuucacaaaauuucaaggucguggugguggaugguaaaaacgaaagcgaguacacuguaaaauggcaggacuucuucacuggacacgugguugguuaguauggagcuuguugguuugccccugugucugguguauuaggucuccaaaucuaacuugauugcauauucuuuucuggugcaggauaguggggacggggugucauagaagugcuauucuuugacuuuucuuugagguauauaaguuuagaggcaggaacauucuaauagaaggaaaugaguauuaucuaaaugucauacuagcuggcugguuuaaugauuaaaauuaaauucuucuuaagugauaggaauuuaaccuuucuuuuccucagugacuguaagcuuucuuuaugauauuuuaaacagggaagcuuggagauaaaauacuuggugauccuauuacguauguauuugagaaaauuuaucaaacaagcaauugcaguuuacuuuuugaccuuuuucugcaaugagaaaaaaaaaugucauugaaauccacaaauaguauaguuccuaggccuguacauucuaaaucaugcuuucugucucucuuaguucuuccuuuaccuagaaguagauaaaauuauuccagaagaaaaucuuagcaguuuuguuuguuuugggaaagggauagguuucaagugacuaaacuugaggcuaccccuuaggaguugagauuaucuagcuucuuucuggagccuuuguuucuuguuuugcagagcucucacaguacuaggcaaauuccacccugaaggauuuaauuuuuauugagaguaaugcauaguuucuuauuugauguaaguauuuuuaaauaauaauuuuuuuuuucucuuaaggugagccugacucuaggguucuagcccacauaagagaugaugauguuauaaucagaaucaacacagauggggccgaauauaacauagagguaaauuuauaugugaauuuuuuuucaguagcuuauaucucugauuuucaaaaagcugcucaguucugcaaaggugaaaaguaauuauacuuauuucuuuccucuucguauuugaaguuuuuuacuaggaaaguagacuuuuuaaaaaaggauaaucucuaagaagcuguguuaugauacacccuguauuucuaaguaccauaauugagagaguuacaugugggauggauaauaggaagagaaaacuuucuuucccuccugacucauuuuuuaauucuuucucaaauaauaaauguaaacauccucagaaaugaaaagugaaguauuauuuuucaauuucucuguuuuucugcuagacacacuggaaaugcuagaucaaugaaaggugguaguucauagucugagaaguuaaagaggaagcuaggaaagucaggcuguggucacucuuccauugaaagaguagcaauagaaaucaagaccacaguggcugcauugguuaagacacauaucuaucugucagauauuagucuacaaaacaaaacguuuccucauaauugugaauugaaguugauucuguguuuccugaaaaaugagaagacucuggguggugguggugauaucacuaaaauagaucaccugugggaaaacugaguaagauuggucaaaaugaaauguucagguguauuugagugcuuaauagggguaaaacagucugcuggagcuauauauacuauauguuuuaauuauauccaaucuacaugacuguuaguccuuugacuguccauuauugugaaaaagaaaccuauggccuugcaguauguuauaguuuguuaauguuuaagcuauuuaaugucaauguuuugaggagucuggccuaccagaaagagucagaaauuuaguagaaaguaaaggaacuaauauuauaaaugcauucauucuagaauaggcaaagcaucacuggaaugucuuaaauuugccuguucuuucaaaucaauuuauuuuuuaagaauaccuuuauuuuaaaauauaugcucauugcaaaauucggaaaauagauuaucuguacuuggacagauaacuacuauugacauuuugacagacauccuuccaaauuuuuuuuucuauguguaaauacacaaauaaauauaguuauacccacuauuuuuuccugcaaaacuaggaccauacaauauguacaguuugucuucacacauuuuucguuuaacaauaugauuaugaaccuuuucguguuaauauagaucuaaauuaggguuuuguuuguuuguuuguuuguuuuuugagacggagucuugcucugucacccaggcuagagugcaauggcgugaucuuggcucacuauaaccucugccuccccgguucaggcgauucuccugccuuagccucccaaguagcugggacugcaggugugcgccaugauguccggcuaauuuuuuuucuuuuuuuugagauggaguaucacucugucacucaggcuagagugcacuggcguggucucggcucacugcaaccucuggcuccuggguucaggcgguucucccgccuuagacccuugaguagcucagacuacaggcacaugcuaccucaccuggcuaauuuuuguauuuuuaguagagacgggguuucaccauguuggccaggauggucucgaucuccugaccucaugaucugccagccucggccucugaaaagugcugggauuauaggcgugagccacugugccuggccucaacuguuuuguuucuaacuuuugaaauaaaagguauuguagugaacagccuugggcacaccuuuuggugcauguguuuaguuggaauagucuggaugauagguaauagucugggaaguuaaaugaagaaacuguaggaagcucugucuaggcugugcgagggcuucagauaaacucccauagcugaguagcuuaacacaagcaaaguuuuuucuuacucuccuguggcuugauguggguuaggugguucuccucuacuuuguggcuuugacuuuuggacacauguccucuguaguucucacagaaagaaaacagagcuagagaauuauacaggauauuaagggccaggcuuggaaauggccuuccguucaauacauucuagaacacuuuaucucugaccugcuacaaaggagaauggaaaagauagucguaauuugagcucagaaagagaaaauagugugguaaaugcacagcauuguuuuugcugcagugcauaugucugcuuauuuccuuagaauaauuuauucuuuuuuguuuuuuugagacugagucucacucuguuaccaggcuggagugcaguggcgugaucucagcucacugcagacucugccuccuggguucaagccauucuccugccucagccucccgaguagcugggauuacaggugcgcaccaccacacccagcuaauuuuuguauuuuugguagagacaggguuucacaauguuggccaggauggucucgaucuccugaccucaugaucugccagccucggccucugaaagugcugagauuaaaggcgugagccacugugccuggccagcuuauuaauucuuaagccaaaauaugugucuuuaggauccaaguuaaauuugcucagauuacauuuuuuuuuuuuuaagauggcaucucgcccugucacccagacuggagugcaauggcgcgaucucggcucaccacauccucugccucccagguuaaagcgauucuccugccucagucccuugaguagcuggaauuacaggcgugugccaccaugccccguuaauuuuuguaguuuuaguagagaugggguuucacuguguuggccaggcuggucuugaacuccugaccucgugaucugcccaucuuggccucccaaagugcugagauuauaggcaugagccaccacgcccagcuagauuacucauuuuuuucaaauacuuccuuuuggaaaaauaggaauucuguuuccauccauaccuuuguuucacuaaguacaaaaaugaguauaacuaauauuucauuguaagauauuuacuuagccaggcacaguggcucacacuuguaaucagcacuuugggaggcugaggcggguggacugcuugagcccaggaauuugagaccagcccaggcaauauagggagaccuugucucuacuccuccacaaaaaaaaaaaaaaaaaaaaaauuagcugggcaugguggcacaugccuguggucucagcuacuuagaaugcugaagcaguaggaucaguugaauucggaaggcggagacugcagugagcugagauuguacugcugcacuccagccugggugacagagcgagacccuaucucacacauacacacacacaaagauguuuacuuacaaguauacucaucagauaccuugagggacuuuugcaugaaauuaauaauguuuauugaaaaaaugauuuacuacuuacaggggugauuuucauacucuuuauaauucuuuugauacuuuuauaguucauaaguguggugauuggcuguucacacacacauaugagauguaccacccuagaaccuuguuacaauguuagcacauuaccagucugacaugaaaaaaaauaauucuuuacacuuaccuugaugcaaaaacauugucuaucugcacuaauaucuuaggaauauaagugagcaggaaaaaauauauaucuuauuuuuaacacaucaucauuaaauauuuuguuuaugacagucuuacuuggucacucaggcugaagugcaguggugccaucauagcucacugcagccuugaccuccugggcucaaacaaucccucuuuucugccuccugaguagcugggacuacaggugcaugccaccaugcccaacuaauuuguuaaauuuuuguagaguguaucagauuuuugaugaggucucacuguguugcccaggcugaucucaaaugucugacuguaagcaauccucuugcuuggccucccaaagugcugggauuacaggugugagccacugugcgcagccguuaaauauuuuaaaccgucacugacuuuaccauagcuuacuauuuauauaaauaauccuggguuaaacuugcauagugagauaauauuucccccaacuuuuauuuauuuauuugagauggagucuugcucugucgcccaggcuggagugcaguggcgcaaucucggcucacugcagucuccgccucccagguucaagcauuucuccugccucagccucccaaguagcugggauuacaggcacacgccacugugcccggcuaguuuuuauauuuuugguagagacaggguuuugccacguuggccaggcuggucuugaacuccuggucucaggugauccacccgcgucggccucccaaggugcugggauuacaggcaugagccacugcauccggccuaauuuuuguauuuuuaguagagacgggguuucaccauguuagugaggcuggucuugaacuucugaccuugugaucugcccaccucggccucccaaagugcugggaugacagacgugagccaccaugcuuggccucccccagcuucuaguuuuaaaaauguucagcuggugcaguggcucaugccugucaucccagcacuuugggaagcugagguggguggaucacuucaggccaggaguucgaggccagccuggccaacauggugaaaccucgucucuacuaaaaauacaaaaauuagccaggcuugguggcuugcgcccguaaucccaacugcucgggaggccuaggugggagaaucgcuugaaccugggagacagagguugcagugagcugagaucgcuccacuguacuccaaugugggugacagggugaaacucugucucagaaaaaaauaaaaaagaaaaugugcaaaucuacagaaagauuaaaaaguacccuguaguuacagaaagauuuuuuuaaaaaauacccuguagcccuuaaacaauuucuaacauaauguccuguuagcuuucucucuuuuuuucgugaaucauaugaaaaucauuugcaaacaucaugacccuucaccccuaaauacuucuguaugcauccuuaggaauaaaggcacucuuuucuauagcuguaauaaaaguaacauaccugagaaaaugacaagaauucuacaauauuaucuaauaaucaugccauagucaaaaucucuagucauccucaaaaucuccuuuguagauuuuuuuugguuuuccaguccaggauccaauccaguuuucugccuuuuagucaauuacucaucaaauuauuuuuuccagcaacuuacuaguaauaaugguaauagccuuagcuuuuauuaauaacaaccacuuuucuuuugaaauguuaauauaaaacuagauuuauuaccuacauaaucuucauaaucuucaaguuagguauuaucacuacuuuaccuaaugagggagguuaugcucaggguacuuguccaaggcacauagugagguaugguugagguuugaacucagauauaucugaucccaaagccagcugucuuuuucugugcuggacugacuauacuaggaaacaaucaaugugaacuuagaaauguuugacccaaaagaaaaaaaauuucacuccuauucauaggcuaaaugaacuuuacuaaauauggaagauuccuguagcccggaaguuggguuaguuaacuuuugagaucucugccaacccugaaauucuguaacccuuguuucuuacaucugccucauacauggauuaccaaagauguauaugcauauaauauuuaacaguuuuauugagauaaaauucacauacuauauuauucacccacuuaauguauacaauuuuguaguuuuguguguguguguguguguguguauuuuugagauggagucucacucugucacccaggcuggagugcaguggcacgaucacugcaaccucugccuccuggguucaagugauucuguggccucagccuguugaguagcugggauuacaggcgcccaccaccaugcccggcugauuuuuguguuucaguagagaugggguuucaccguguuggucaggcuguucucgaacuccuggacucaaguuaucugcccaccauggccuccccaaagugcugagauuacaggcgugagccaucgcgcccggcaguuuucguauauugauggaguugugcaaacaccaccucauucaauuuuagaacauuuuuaucaccugaaaaagaaacgcuguauccuuuagccauacuucccccuuccucccuaacucccccagcucuaggcaaccagggaucuacugucuauuuagauuugucuguuugggucaucucauauaaauggaauuacauaacaugucuuuuguguguggcuucaauuuuuuuauuuuuuugagauggagucuugcucugucacccaggcuggagugcaguggcaugaucucagcucacugcaacuuuugccuccuggguucaacugauucucuugccucagccucccagguagcugggauuacaggcuccugccaccaugccugacuaauuuuuguauuuuuuacuagagucgggguuucacuauguuggccaggcuguucucaaacuccugaccucaagugauccaccugccucggccucccgaagugcugggauuaaagacaugagccaccacgcccagccuguguguggcuucuuucacuuagaauaauguuuccaagguucaucuguguuguagcauguaucuguaucuuauuuauuuuuauugcugaauaguauuccauuguauggauaaacugcauuuuguuuauucauugauuaguuguugauggacauuuggguuguuuccacuuuuuagcuauauuuacauuacugcuuguguuuucauuucucuugguuauauacuaggagcagaauugcugggucauaugguacuucuacuuuuaaccuuugaggaccugccagacuguuuucuaaagugguuuuaccauuuuacauucucaucagcauaugugaggguucuggauuucucuacauccucaccaguauuugucuuugaucauagucauccuaguggguauacaggggugucucauuguggggguuuuuuuccccauugggguuuugauuugcauuucccugauggagauaaauauauuuuuuguguguccccccacaaacugccugguucugaugagaccaguguucuuacagagaauaacuuugcuuugaaacaaaacaaacaaacagccuuuugacuuggguaaccuuuggaguauguuaauugugauuuacucuggccuuguaacauuguaaguggagauuuuguuuaaaaacugcguucgcugaaacaaguaauaagguucagaccuauuguuacaaguucugaguuuucuuucauauaaauauguuuguucuuuuguguggauaaaaccuaacguggcaaaaaggugucaaacaccuaaguauuaaggaaacuaaaaugaaaaugcugcaugaacagaaaccuuguccaauuuucauuacuauagcaccaucaccuauaacagugccaguguacaguagauauuacauaauauuuuugaaugaaugaguggaaaaugauaugcauuuuucucuucugcauccucugaaagauuucacaacgugcaaaguauguaaggcuuuauuuauauacagauaaaauaaucagaguuuauaaucuauguauuuacuuuccugcauagaaacuccauaugauuaaaaauugagauuauuuauuuuaauaacaugacuaaucaguuuacuuaaccuagaaaugaauguuaucuaagaacaagcaaagaauguuagaagaauuuaguguuuaggaauuauuauuguuuuccaucucagucguauauauuuucuguuuuagccacuuuggagauuuguuaaugauaccaaagacaaaagaauguuaguuuauaaaucugaagauaucaagaauguuucacguuugcagucuccaaaagugugugguuauuuaaaaguggauaaugaagaguugcucccaaaaggguuaguagacagagaaccaccugaagguaagacuuaaagaguguauuucaaauaagaaacaaacauacuacaauugacuucaguaggggugguuguuauuuguuaaaaaauaacaugauugucaaguaacuauaguauuuggcaugaaaauaagagguuuguuccagaaauuuucaucuucuuuuguuuauaauguaagaguugaaaacucuggaaaauaaugggaacaacagagauuagacuuuaaaaaagauuagggaaaagggaaauggagugaucugagggaaaauauuccugcagauauuuagaaaugauaaaauaauaugguggaaagacaaucuuuagaguuuauaagaaauuaauugguaguaggagggaccuauauauauacugcuuagaauacaagaagguuauauccaucuugggacaauccauuuagggucauuuaaaaaacguaaccaucuuggaauuuuacugcccaaaacaccucugguuagguuuuuuguuuuguuuuguuuuguuuuguuugcagcgcgaucucggcucacugcaaccuuugacuuccagguucaggugauucuccugccucagacuccugaguagcuggauuauaggcaugugccaccaggccuggcuaauuuuuguauuuuuaguggagaugggguuucaccauguuggucaggcuguucucaaacuccuggccucaagugaucugcccaccucagccucccaaaguguugggauuacaggcgugcaccaacaugcccggccaaagacgguuauguuauuaaaauuauauauuagcauuuuaauauauaaauaaagaaauucuuaauuuauuucacaagaaaguuguccuauuaaacuaauuuucaaugugaauaucuugacauuuuuacuguuacauugguuaauucauaaacuucuuguuguagaauaugacugacagcuucauagcccagcauuaggugacuguuuuacucuguugagcacuauuuauuuauuuauuuauuuagagaugaagucucacuuuugucgcccuggcuugagugcaauggcacaaucuuggcucacugcaaccuccgcacccuggguugaagugauucuccugccucagccuuacaaguagcugggauuacaggcgggugccaccauaucuggcuaauuuuuguauuuuuaauagagaugggguuucaucauguuggccaggcuggucucgaacucccguccucaggugauucacccaccuuggccucgcaaagugcugggauuacaggccugagccaacaugcccggccuuacucuguugagcacuuuuuaaaguuucuguauuggaaaaauuaaagaggcacuuguccuugguuuugaauucuacaguguuuuaacuuuauguuacuuuucacuuuucugucuuccuccaaauuauuuuuuguuguuguucagaauccuuuagugauauuaagcucacauaauguuuguuucaaaaauauguuagauuuaaaguguuaccauaaaacuccuuguuuuggugaauuuugauuuaauagugcauacaaauucauauuagagcuuguucaucgagugaaaagaagagcugacccagaucccaugaagaacacguguaaauuauuggugguagcagaucaucgcuucuacagauacaugggcagaggggaagagaguacaacuacaaauuacuuaguaaguauuugauauugcaucgaguaauugaaaaaaaaauuuggguggguacauuccaugaaacuuaaugcaaccagaucuguuccagauacucuguuauuucccuaaaauauuugagggauauucucugagguuuuuauguuacuguauggaaauuauaguuucaaauuugugacaacccauuuuacccuugaacuaauauuuucugcauguuagaauuuaugcauauaggguuugggagagguuauaauguaguccuuccuccuugauauaagugaguucuuuaaaaacaucacugcuaucaugguagugaaccuguggugucacaugugaauguaaaaauauguauuugcaugaacccauguuuuucuuuugcuuauauguauauuucagagaggaaggcgaguuuuguuugucauguuaaagaccuaaucauuggacuucacuugaaauaggugggacuuucauggucauaacuaguucuagggcacagaagugaaggaaagauguaagaagugaugauacuggauuuuuaaguaugaacuauuaugauuuuugaagucuggggaaucauuuuucauugacauuuuuugcuagugugacuucauucgucaugauuacuuggcacugaccaaaauguuguuacugagggaauaauggagaaugcagcuauucaugaagcaagaagaagcuggugcaguaaagaugucuuucucauugccuugcuuuucccaugcuguccauuuuauucauacccucccaacuucuuucccuucccuuucaugucaaguggauuuuuuuuuuuuuuuuucaacacagagucucacugugucgcccaggcuggagugcaguggcacaaucucagcucacugcaacccccaccuccuggguucaagcaauucuccugccucagcaucacaaguagcuggaauuacaggcgugaaccacagcacucggccccauaucaagugaauuuauuaugaggcuaguaagagucacugugauucuuguuccuaaauaagagagauuuuuacuuuaaaaagcuucucucuuaaucuggguuuuauauuaaggggcuccucuuauuuuacuucuuuguucauugcacuauaaauaugaauauaaugagagaucuagucuuaaaaauuguauuuuuuuacaacuucuuaggcauaacuuguuucacaguugcuagaacaaaccucaucaacccaguuuuugaacaguagaauauucucuuugagaaaaagauagguaauuagcauuuuguucuuucucaugucauuuuccuuggaaacuauacugccuuccuucuccaguuuucccaaaucagagaacaaaagaaggaggguugcugaaaugaaccuuguucuuucuggcugucuucuuacccauuccucagugcugaacuuuuuggggugagagugggggaauaggguuggcaguugucugccacggccccuuacuuguuucuggggaagacauucgagguacucaccaagagauagagugaagauggaauucuuuuuagaagggaauacaguugacccaggaacagugcgggggugugguuagaagcacugaccuucuucccucugcagucgaaaauccucacgugacuuuuuuuuuuuaaggcucugucgcccaggccggagugcaguggugaaaucauagcuugcugcagccucuauugcccgggccaaagcaaucuucccaccucagccuccucuagcugggacaacagguguucacccuuccuggcuaaguuuuuugauuuuuaguagagauggagaauuucccaggauggucucaaacuucuaagcuuaagcaauccuccugccucagccucccaaggugcugggauuacaggcaugagccacuaugcccggccacuguauaacuuugauucuccaaaaauuuaacuacuaauagucuacuguugaccagaagccuuaccaauaaaauaaguugauuaacacauuuuuaaaauauguauuauuacuguguucuuacaaucaaguaagcuagagaaaggaaaauguuaugaugaaaaucauaaaaaaaaaaaaaagcccggcaugguggugugugccuguagucuucuguuacucaggaggcugaggugagaggauugcuugaguccagaaauucaggcuguagugagcuaugaucgugccgcuguacugcaccccuggugacagagcaagaccuugucucuugaaaaaaaaaaaagaaaaucauaaggaagagaaaaauacauuuacuauucacuaaguggaaguggaucaucauaauggucuucauguugaguaggcugaggaggaagaggaagaguugaucauauugucucuggugacagaggcucaaggaaauccauauguaaguggacacuugaaguucaaaucuguuguucaagggucaacuguauuucagguauacugauugacuuuuaaauuuaauuuuuauuauuggcugaaacgguaguuuuaaaaaagccuguuacuugucauuuugguuccaugugcaauugaguaccugaaauuuagguuaaacuauaccauuguuuuauucugguaacagcacuuuaaguuuggggccaaagguugggaauacucugauacaguaacaucucaaugcuaguuuuugcgaaaguagaaacuuuugcaauggccucuaaacugagauuuuuucuuuccccauagauuuuauauugcauugccaggagagguaaagaguuacauaaugucuuuuuucuuuuuuaaauacacacagauagagcuaauugacagaguugaugacaucuaucggaacacuucaugggauaaugcagguuuuaaaggcuauggaauacagauagagcagguauuuaucaauagauauggcuuauauuacuuaaguuuuguaauguaaauauuugucacuuguauucaaaaccuaaaaacuuguccuuaacaauaauuguaaauaaguuuucucagaugccaaugauuuuuuaugaugaauugugcaguauuuuugauguuaauuaguucuagauugugaaguuuucuguccuuagucucgcuuuagguagaaagccuuuuaugcugcugugcuuuguuccuucuuugaauucauggccuuuauauucucuguaguuuucuuccccccuccgauuaugcuuaagucuuuaguuaaaacucuggcaugcaccauugaauccuuagucagaaaauuuacuaaaaaauacuguguaccuuugcaaggcuguauuuauauauacagaaccuuuagguucuuuccucucagauaucuccuucugauuucuuguaaucuguuaacagagugugucuaguaauguuauauuaaugucaucuuaauaauagcucauauuaaaaguuauuucaaauugcuaggacuaauuaaaaaggcuucugacaaaggguauugcuuugggcagagagacauuuugauauguaaauuauauaaauuguuaucucuauuuuuuuccaagcuuuuuguaguaaaccauauuuuuauaaguuauauaguauagaauuuagagguugaaaaaauuuuuaaaaaucauucaccauguuuauaaauguuaaacuuugauauuacuuguauaaaacuaagagaauuauuuuucccuuuucauucucuuucacuguuacgcauuuucuuuuuaaguuauuauuugaauagguaacauguacacaguacaaaagccagugaaaaguaagucucugcagccuguuuauugucaaaccaguuccuuuccccaaagacauucaugucacuaguuucauauguaucuuucuagagaugucguaugcagguauaguguauguauaugucuguauuugacacaacggugcuaugcaguacacuuuuacaccuugcuuuuucauuucacaguauguuggagaguacuucauguucaugcauguaaagcugcuucacuuguuuuauuauaaauagcugcaucauguuugaguuucagggaaccuguaaauuuucuuuuugcuuuaggcauuuggaaccagucgaagaaacaggaauaauauaggagauuaaaacauuaacuucuuuacaucugaugaaggauggauuggagggugugguuuagauguguaucauggugggcuucuaaguaguucuaucccagauuugaccuugaccagccaccaucaaaacugcagaguccaccccaguaaacuuaccacacaguggcagaggagaccagaaugggccuucucugcaggcaggcaggcaggcaggcaggcagagagacucacagaaacucugagcugagcaugguuuccuucuuuaucucacacuuacuaaugggagccuuuguuacuuuuuuuuuucuucuuugcagguuuaauaugaauuugucugaaaugccuguauaaggagaagacucuauucuuagccuuuuauuccuuugaugcacaaagagauguauauuuuauuauucuuuccugaguugucgacuguagucguaauaaauauuuuaggcuccuguaacccaaguucuuauuuuuucaaaauaaacauggaggauaugaaaauuuaagaguacauuuauaauauuauaaauaauucauugacauauguuuuccauaccauaugcuucucuguuuguuucaaacauugaauauugguacugaagaauuuaugaauuuugguuuuaaaauguuuuuuuucuagaacgauucuuuuuuugaacagauaaaauaaugcaguauucagagccuucugacuuauuuuggaaguguucuaaguauaugaucucuuuaaguauagauucgcauucucaagucuccacaagagguaaaaccuggugaaaagcacuacaacauggcaaaaaguuacccaaaugaagaaaaggaugcuugggaugugaagauguugcuagagguaggucuuagaauccuggauauggugcuaacaccacuuugucauuucugauauguggauuguauguguuuuaaugaaggagcauguuagaaaagauggacacccagaagcagucuccuccagcugauccagcaguaaccccaucccauguagcagcauagacaacaaauaacaaaaacucuaugaaaaagaaaaacgcuauaaagcaaugcuuccuuuuuuuuuuuuuuuuuuuuuugagacagaguuucacucuuguugcccuggcuggagggcaauggcgugaucuuggcucaccgcaaccuccaucucccagguucaagagauucuccugccucagccucccaaguagcuaggauuauaggcaugcaccaccacggccggcuaauuuuuguauuuuuaguagagacaggguuucuccauguuggucaggcuggucuugaacucccgaccucagaugauccgucugccucggccucccaaagugcugggauuacaagugugagccaccaugcccggccaaagcagugcgucuuaaccuuaauaucuuugaggaucuaaugagacaaucaguggaucuucucuagaaaauaacauggauacccaauauauagaguuuuugcacacuguuucauuaguucugcacacuuaguucagcucucucugaagcuuaucaauuuaucuuuuagggcaguaauuaucaaacagguuaugaacauguauuggagaguagaaauauagcuuggagaucugaaaguucucuacaggaauuuaaaauuuuuguguuuuuauucuggcgauuaaucuaaagauggcuaacuuaaucauuuuaugucauuuggagucuugccguauaacagggugcugccaugugauuccagugucuugaguuugugugugcuauuacuuugguguagaaugacuuuauaugaagcgauaguuuuuaucuuuuaauguguuggcaaguuuauuaguuucuuguuguugcuuuaauuaucacaaguggagcagcuuagaacaacacuuauuuaucccauaguuugcaugggcuaguccagguaugguguggcucaucuggauucuuguuuagggucucaugaggcugaaaucaaguuuucaaagcuucaauagaauuaaaggauauuauaacuauucauccagauggagaagcauaaugugcagcaccugugugguacucauucauaccuugucuaauuugaucugcugagcacccugagagguugguugagacagcauccuugugaggaggcucagcaaguguuacuguuuauuccagcugacaugacaaagcagcauaggcugggggacuuaaacaacagaaguuuggguuuucacaguucuggaagcuggaaguccaaaaucaaggggucagcaggguugauuucuucugaggccaagguacuugugguguagaugcugucuucucccuguguucucacaugguccuucccucaguguguguguauauucugaucuccuuaucaggacaccagccauauuggauuaaggcccacccauaugaccucaguguaccuuaauuaccuccuuaagggcccuguuuccagauagagucacauucugggguacuguugaggguuaggacuucaacauuugaauugugggguggcacaauucagccaguagcaggaagauuaaaugacuugucugauuagucauacaacuggugauggcagagguugaauugagcacagaucuccugacuccuagaacagcugaaccacugcgccugucugcuuuucugugagccuccagacagcccauggcaggggaggaaccaaagagaaaaaugacuuauguugacagaugguccucuccaguuuucuucccuaagccuccuagaauauucuuagaagccucauccuuuuaccacggaacuaucagaauccccauguaaccacacuucauuccucauauagggcucucuggccucucauuuaaagcauuuuaaacauugaggguuuuggcuaggcauggugguucaugccuguaaucccagcacuuugggaggcugaggaugaggcaguggauuguuugagcccaggaguucaaggcuagcuugggcaacauguuguacaaaaaauacaaaaauuagccgggcauggugaggcacgccuuugguaccagcuucuugggaggcugaggugggagguucacuugagccugggaggucgaggcugcagugagcugugauugcgucacugcauuccagccuaggugacacagcgagacccugucucaagcaaaauaaaucaaaccccccccccaaauuaagguuuuuuuaaacuuggagacgcuggacgguuaugguagagguuuuuaaaguaauguaugaagcccuuuuaaauuaagaaaaaaaaaauccucucaaaccugcaguguugauuuaaauggauguaaaaucuuuauuuuaguaacauaaaacuggguauguaugcuuuucuauaaguguauauuuauauaaaugacaauauauuaugaagcucaaaaaaguuuaagauuaaaauuucuauaaaaccaauugaauccuugaaauacuugagagggaucuguuuuggccuggagugcugcaauccccuuaucgaauuggagcaucucuaguccugggcuguaugucuucagaacagcccucggaggagcagugaguuaguucugaagagcuggagcaagcucccgaacuauucccuuuugugucccuugucagaugacagugugugccucucaccugugcagguggagaagcacuuuagggaaagagcaaagcacugcacgagguugugauugcuggugcugagcugcaugccaucauaguucuguucuggaauguuuaguugauuuagauuacaucuuuuagucugauguaauuguuaaucuaagaaugcuuuuuuuuuuuuuuuuuuuuuuggucuuucaaagcaauuuagcuuugauauagcugaggaagcaucuaaaguuugcuuggcacaccuuuucacauaccaagauuuugauaugggaacucuuggauuagcuuauguuggcucucccagagcaaacagccauggagguguuuguccaaaggguaaguuuuuccauuucuugugugaauaugcugcugggauuauuaagaugauuggauuauauuauaauucuguauuuaauaagcaauuuaucucuguuuccuuuugacuuuagcuuauuauagcccaguugggaagaaaaauaucuauuugaauagugguuugacgagcacaaagaauuaugguaaaaccauccuuacaaagguauguucuuuuauuucuaaaagaauaguguuagaguuuauuguaguagaaccucaguuauauauuuauguagguauuuuuuuaaaaaauguaauauauacuguuuuuuaaauuucugccuaaauaaaauuuauguauuuuugugggauauaugaaaauuaaagcauaaagaagaaaauaaaaauggccugucagccuucuuuugaaacaugugaggaccacugcuuuucucgaacccucuguccuggaccccucugaccugcagcaacucuuagagcucccugucuccuaguccugcagugcagcugucauucaaggcaucccacacccucuuauuuucagaaccccauggucucccucuuucucagugccaucauuuugguguaguguaucuugcaggagcuuccuaagaaaacguagaugaccugcauauuguugggauuucauauaucugaaaaugucuuuauuccacucuuaagccugauugauaauuuuggcugaguauauucuuaguucucauguucucuauggucuucugugcauguugcuucuaaagaaucugaagucauuuugaguucuuaucuuuguuugucaccuguuuuuuucucuggaauaucuuaagaucuuguuuuucuccagcuaugucuguuaaaauguguuugacuacaaauaacagaaaauuaaauaagcagugguuuaaauaagggguuuauuugucucagucaacaagaaguucagggauagcauuuucugggugguacagcaacucagagguacccucaguggcucaagaacaagcaggaagucuuuguccucauggaugucaccucaugguuuuaagaugguucucuucuguguuggagaaaggaggagaaagagaacauggcuagccuagucuggcccuucuaaaaagcuucucuggaggccccauccuggcuuuuguuuauauguuacuggacagcacugggucccguggcugcccuuagccucaacggaauguggaaagcuggcuauuuuagcugaguauauugcuguccugggcaaaauuagggcucauuaaguaaggaagaaggggagagagauguugguaggacauauuaguaucugauauacugauuuuuaauuuuuauuuaauuuuuauuuuuuuugagacagagucuugcucuguggcccagucuggagggcaguggcaccaucuuggcucacuguaaccucugccuucuggguucaagcaguucuccugcuucaaccuccugaguaguugggauuacaagcaccugucaccacgccuggcuaauuuuuguauuuuuguuuuagagacaggguuucaccauguuggccaggcuggucucaugaaccccugaccucaagugauccacucaccuuggcuuccuaaagggcugguugguauacugauuuuuugacuaugauguuauacuugguguaggguaugggaaaacauuugcaaaagacacaucugagaaaagacugcuaucugaaauauacaaagaggccgggcaugguggcucauuccuauaaucuucggcacuuugggaggccgaggcaggagaaucacuugagcccaggaguuugaaacuaaccugggcaagauggucagacccugucucuacaaaauuaaaaauaaauaaauaaauaaaaauuuccauauguauaaagaacuguuaaaauucaacaauaagaaaaugaacaaccuaauuuaaaaacagacaaaagagcagaacagauaccuccaaagauauacagauagcagagaagcauaugaaaagaugcucagcgucauaugucauuaggaaauugcaaauuaacaaugaagcugguuguagggguacaugccuguagucccaguugcuugggaggcugaggugggaggauugcucgagcccaggaguuugagacccauccugggcaacauuagugagauccuauuucuauaaaaaacuuuaagaaacccaacaacaaugugcuauuacuaguagcuuauuagaauggcuaaaaucccaaacacuggcaacacaauuccaacaaggcuauggagcaacaggaacucucauuaauugcuagugggaaugcaaaaauggaacagccacuuuggaaggcaguuggcaguuucuuuucuuuuucuuuuuucuuuuuuuuuuuuuuuuggagacggaguuucacucuugucacccaggcuggagugcaauggcgccaucucggcucacugcaaccucugccucccagguuuaagcaauucugccucagucuccugaguagcugggauuacaggugcccgcugccacucccagcuaauuuuuguauuuuuaguagagaugggguuucaccauguuguccaggcuggucucgaacuccugaccucaggugauccgccugcuucagccucccaaagugcugggauuacgggugugagccacuacgcccagccauaagaauguuuauggcagcuuaauucauaauugauaaaacuuggaagcaaccaagauauccuuuaguugguaaauggauaaacuggcacauccauaaaaugagaaaaaaauaaaaagcuauuaagccaugaaaagacauagaggaaccuuaaaagcauacuacuaaguaaaauaagccagucugaaaggcuacauacuauaugauuccaaauauaugacauucuagaaaagacaaaaccaugcagacuauaaaaugaucagugauugcuagaugcugggggagggagggaugaauagguggagagcaggguaauuacucuguaugauacuucaacagucaguauaagacauuaugcauuuguugaaacacauagaauauacagcacaaagaguggacccuaacauaaacuguggacuuugggugauuuaaaaacaggugguggcaggagccuauagucccagcuacgcgggaggaucacuugaggccaagaguuagaggcuguagugugauaaaugcaacugugaauacccgcuacauuccagccugagcaacuuagcgagauccuccuuuucuuuuuugagauggagucucgcugugucucccaugcuggagugcaauggcaugaucuuggcucacugcaagcucugucuccuggguucaugccauucucuugccucagccucccaaguagcugggacuacaggcacccccaccaccacgcccggcuaauuuuuuguauuuuuaguagagacgggguuucacuguguuagccaggauggucucaaucuccugaccuugugaucugcccgccuuggccucccaaaguguuggaauuacaggcgugagccaccgugccuggccugagacccugucucuuuuuauuuauauauauauauauauauauauauauauauauauauauauauauauauauuuauauuuuaaauuuaaguucuaggauacaugugcacaacgugcagguuuguuacauauguauacaugugccauguuggugugcugcacccauuaacucgucauuuacauuagguauaucuccuaaugcuaucccuucccccuucccccuccccccaccccacgacaggcaccggugugugauguuccccuuccuguguccaaguguucucauuguucaauucccaccuuugagugagaacaugcgguguuuggcuuuuguccuugcgauaguuugcugagaaugaugguuuccagcuucauccaugucccuacgaaggacaugaacucauccuuuuuuauggcugcauaguauuccaugguguauaugugccacauuuucuuaauccagucuaucauuguuggacaauguugaacaauaauguagagugguaugagaaaagaaaaagacacuaauuagcuuuugggaaucuuuuaauuucuuuuuuucuuuucuuuuuuuuuuuuuugagauggaguuuucucuuguugcccaggcuggagugcaauggugugaucuuggcucacugcaaccuccgccucccggauucaagcaauucuccugccucuuucuccugagcagcugggauuacaggcaugcgccaucacgaccagcuaauuuuguauuuuuaguagagaugggguuucuucauguuggucaggcuggcucucaggugauccgucugccucggccucccaaacugcuggauuacaggcgugagccaccgugcuuggccuuaauuucuaaauuuauuuuuuucuuaugguacuuuguuuuaggggaaaaaaucucucaaacuguguuuucccucuauucucacaucacaaccaucaucaucaacacagaagacuugugugaccagaccaaacguguggggauuucccccuacauaucaagcaguagacaucagcuagguguccuccaauucaauucaaacacucuccacccggaaauaguaucagaucucacaguuugagggcccagucccacaagacugacuguucccuccuccccaccaguuacaagucugagccuccagaacuucugaccaacuggcuucaaguugggguuuccacauucuccucuuugggucugauuaauuugcuuaaguggcucacagaacucagggaaaagcuuaacuuaguuuauggguuuauuacauaggauauuuuaaaggauacaaagaagcugggugcgguggcucacgccuguaaucccagcacuuugggaggccgagguggguagauaccugaggucaggaguuugagaccagccugaccaacauggugaaaccucgucucuacuaaaaauacaaaaauuagccaggugugguggugcaugccuauaaucucagccacucgggaggcugaggcaggagaagugcuugaaccugggaggcagagauugcagugagcugagauugcgccacuguacuggucaacagagggagucuuugucucaaaaaauaaaaaaaaaagaaaggauacaaagaaauagccaaaugaagggauacauagggcgaggucuggaagggucccgaguacaggagcuucuguccccauggaguugggauguaccucccuccuggcacacgaaugaguuuugcaccuuccugucaaccuccauguauucaaaaugcucucuggaagcucucugaauccuguuuuuugagauuuuauggaggcuucauuacauaagcacgaaugacaacuguguagaaaugugauuggacaaaauggguauguucucauacuaaccgacugaguggggaagcccaccaaggccuguccagauucuccuugaccucucugugcagcauuccucccuccacaguaaagggcaggacccucucuagaaugagaaugagaaugaggaucucuggacccacaaucagauuagagucuugccuuggaucagguaaaaggaggacaggagaaggucagagagagagauucuguuuccugaggauugcuccugagcccuaaagcaccccaacauuauaacagaagaccguaaccagggcuacggaggguuguaagccaggagccauggacagaaacauacauguguguacaguagcucacgcuuuuacuuuuuuggagucacaacuucuuaauggcuugauuucaugacauauuuucuuuggucuuccagaacuuuccucuuaaaaaaacacagcaaaaaaacaaaauuugauuugaaauuuuugagauuuuuuuuuaagagucauuagcaaauccacuaaugaauuuuccccaagcaguuaggagauauuucucuucauuacaccuuugggauuugagugcuuuugcuaaaaauuuaaguuuuuuuucccacuacgguuuuaauaugaacauguggaaagacuucuuguauagaaaaaugacuugcaaaauauuauuuuuucagguucuauggagugauuucccccccuuaggaaaaaagaacucaggaauuuuaaguuuauauguauauauauuuauuuuauuuuauuuuauuuauuuauuuuaagacagacucucacucuuuugcccaggcuggggguucaguggccuaucucggcucacagcaaccuccgccuccuggguucaagcaauucuucuggcucagccucccaaauagcugcgauuacaggcgcccaccacaaugccuggcuagguuuuauauuuuuaguagagacaggguuucaccauguuggccagucuggucuggaacuccugaccucaagugauccagcugccuuggccucccaaagugcuggaauuccaggcgugagccacugugccuggccuuuaaguuugauauuuuauucagauaaauauggaaaaaaaauuuuagcuuuauuggcaaaauuuauuauucauauagaaaucaucugauaaucugauagauuaaguacagcccugcaacuggauucuaauaaaccaaguccucuaggucauuaagauuguuauuggacaugaauucagucauugagaaaauaaaacauuguuuuguuguuccucaguugugguuuuuguuuuuuuuuuaagauagaguuucacucuuguugccuaggcuggagugcaauggcaugaucucagcucacugcaaccuccgccuccuggguucaagugauuuuccugucucagccucccgaguagccgggauuacaggcgugcgccaccacacccagcuaauuuuuuguauuuuuaguagagaugggguuuuacuauguuggccaggcuggucucgaacuccugaccucaggcgaucaacccaccuuggccucccaaagugcugggauuacaggugugagccacugcgccuauccguacuguuuuuuuuaccccuugcuuuuuuuuuccuuucugcugagaugcuuuagguuuuaacagacaugugauugggccgaggggcaugugaggaggcuggacaauuaacuacaguuagcuuauugcauuuaucagcaccagauugugugugguugaaauggccaagguuugauguuuuguuaugaauguuccaguauaucuuauaaauuacauuuucuuaaauugauuuguuacuacuuacaauaauguuugauaguauuaaauaaaauccuacuuauucuguuaaauucauauaauugguagaagaaucauaguccgguuauuacucuuuuuugagacaaagucuuacucugucacccaggcuggagugcaguggugugaucauagaucacuguagccucagccuccuggguucaggugauacucucaccucagccucccaaguagcugggaccacaggugugcaccaccaugccuggcuaauuuuuuuuuuuuuuuuuuugagacgaagucucgcccugucucccaggcuggagugcaauggcgugaucucagcucacugcaaccuccgcccccuggguucaagcaguucuccugccucagccucccgaguaguugagauuacaggcgcgugccuccaugcccagcuaauuuuuguauuuuuaguagagacaggguuucaccauguuggccaggcuggucucgaacuccugaccucgugauccaccugccucagccucccaaagugcugggauuacaggcgugagccaccaugccuagcccaccugguuaauauuuuuuauuauuuuuguagagauagggucucccuguguuacccaggcuggccucaaacuccuagaguaaaguaauccucccaucucagccuccuaaagugcugguauuauaagcaugcaguucuuauucucuuguugaucugauuauaaggcucuauuuaagacagcauaggcccaacuggcagaaguaggugauggcuggauauugagaaauaauguuuucuuugcaugauccuuaaggaagcugaccugguuacaacucaugaauugggacauaauuuuggagcagaacaugauccggauggucuagcagaaugugccccgaaugaggaccagggagggaaauaugucauguaucccauagcugugaguggcgaucacgagaacaauaagguaugugugugucgagaauuuuuuaugugguuuggaaagaggcuguguauaaugaucauaaugagagcucagaaacguauuccauuccuaggcguuucccuagggauggaugugcaaauuacaaaguaccuugaaacgugguuguguguuuuggggugaagcacgguucaucuaaaucugguuaaaacuaucauuuggacuuuguugucaagcuuaaugguguagauuugagcucuaggaaaaauuacuaauaauaauggcuuuuuuuggaguucuggauuucagggucuggugggcucaggcuuuauguuaaaaauuugucauuucauuuacaaguugucauucauuuuaacucuacaauuuacauguacaguuuacacguuuuuauuaacuuuugcaguuaaacacauaguuugccugacuacaagccucaugggagaaaggcccuuccuugucugucuuauucauagcucuaucuuauucauagcucuaucuccagugccuaguaggaguaucuggcauguaacaaauauuuguugaauaauuaauggaaucauuuacuauuggggguuucugauagagaauacuaguugauuugugauacuguaaaacacuuucagagacuuuaagagugccgugacuaacucuuagagucugaacuaaaaguuguguuaauaaauaucugguucuuucauuuuauuugaaguuaaacagcauaaagcagugugaggaaaacaauaguugcacugcugaguuaaagagggucgguggggagagcuuaaaggagucugauucuaaucacaaaagauugugaaguauuuguccugacuccuauuuugagcuuggcugugggcuaaugugcaagccuucccuggacacagagggcaagauuacuucugcuuuucccuggcucugacacccugcuuucugaaauuucugccuccuguucuuuuugugaucuuugauuguugcaucucauuuuuuuuuggcuuuuuauguauauuuucugcaucucauuuucuuuggcuguuauguguaaacaguuccucuguuacuuugcauguuauguuuuauuuuuccucugcuugacaacuugugccagagaaacauuuuucuaccccuuuuugucuacucuuccaaccugucaaacuguugaauuuuccuucucuuuucauagucucugcauuucuaaucauguucacuauaguucagugcugcccaauagaacuuucugcugcggggcgggggauguuuugugucugcucugcccaguauaguagccacuagcccaguggagcaauugaaauguggcuagaaacugaggaacugaauuguaaauucuauuuuauuuaaauuuuuaauaauguuugccugugaugggagacgggaaugggcauuaacuguaaaaggacaugagugagauuacuggaaggauggaaauguccuaaaauugacuuauagcaaugguuucaacacuugguaaaguuauuagaaaucacugaguuauauacuugaaauggaucaauuuugugauaugugaaauaugucuuaauaaaguuguuaauaagccaacaaacaaaaacagcagugugggagcagaggaaaaguagcgcggauguagaggagcugugaagucauaaguugauuauuguugaagcuggugaggggcacgggggcauucaugauaccauccugucuacuucauagaugcuugaauauuucuguaauagaaacuguaaaauaugugacuaggaacaaaauuuaaguagccacauaugguugguggcuaccauauugcauacuguuucucuaaguaauaggucauaugcuucuugguuaugaggauagugucagaacuugggagcaaaauguuuuacuuugcagacugccuggguggacaugcaugcugcugacucuuccugcugccaguucuggggcucuucaaaacagcccuguaagaacuugccagugaggcaugguggcucacaccuguaaucccagcacuuugagaggccgaggugggcagaucacuugagccuaggaguucaggaucagccuggacaacaugugaaacuccaucucuacagaaaauacaaaaauuagcugggcauagaagcacaugcuuguagucccagcuacucaggaggcuaagguaggaggaacccggggaguucaaggcggcagugagccaagguugugcuacuacacuccagccuggaugacagagugagacuuuaucucaaaaaaaggaaaaagaaaaaaaagaacuugcuaaugagaauggggccugggaagaacuuuuuuuuucuggagcugccagucuguaucaaugaagaacaauuuauuuauuuuguccugagcacaucauauuuagucuguguuuuucuaguuugguugcccaaguaggaguccccuuguaagaagauaaugugcaucuucuauguuuuauuuauuuauuauuauuuauuaugauuuuuugaguggagucucacucugucgcccaggcuggagugcaguggugugaucucugcucacugcaaccuccaccucccagguucaagcgauucuccugccuuagccuccugaguagcugggguuacaggugcaugccaccacaccuggccaauuuuuguaguuuuaguaggaugggguuucaccauguuggccagguuggucaacugacuggucaacaaacuccugaccucaggugauccaccugccucgaccucucaaagugcugggauuacaggcaugagcugcugugcccagccuauguuuuaaaugaauuccuuaauaaaaauauuuuuaacugaugaaaagggcuuacaggacaaaaauaaaguaguuccuugaccuagaaagacagaacccaucacccucuacuaggcaagccuaugaagagcaguuugccacagguggacuucucuguggacagaugacauuagugaaaaggaauguaggaccuuugagauuguaacuucuuaggaagguuugcugaacggaagaggaagucuuaugacaaggaugcaaacagaagcugccagaucuucagggauguguaggcagaaagccagaguugcggguugguccuuuuaucguuagugcucuccagcugcuugggaguuguaacucugacaaaucagugaagaggucuucuuaucuguucacugugaauuuuaacuccauuuuaaccugauaaaauggaacccagagauacaugauguugaugaauaaacccaccaaaaugacaacugccugaggccccgauuagaauaaccagaccccuuagacaucuguacuguaacgacagauuugggccgggcgcgguggcucacgccuguaaucccagcacuuuggagaccgaggugggcagaucaugaggucaagagaucgagaccauccuggucaacauggugaaacccuguuucuacaaaaaauacaaaaauuagcugggcgugguggcaugcaccuguaguccuagcuacucaggaggcugaggcagaagaaucacuugaacccgggaggcggagguuacaauaagccaagauugugccucuguaguccagccuggugacagagcaagacuccaucuaaaaaaaaaaaaaaaaaaaaaaaaaaacagauuugaagauguuuuuuaaaaagccaguuaguauuucuguguaagaugaggucuuugcuaucuuucugaaaguagcuccuuuggugucugauuuggugguuacaggcaccuuuggagggucucauacacuuggcucucaggggcuucaugauuguugucuggggugaaagugaagccauuuuggcaucugcagagcacuuuggagaccccgaccuaagaaguaacuaugcucaguuuucccuaagccucuucuuuuuuugauaacuucaggaggucuggaaaaugaccgcaguuuuagagcuccugauaaaacccucagccuuaaaagggaguuauccuagugguucuguacuccagggugggaagguaguguagagacuuuuugagacacuggucuugcugguugaugaaaauguuuagguaacaauuggggauuuaauuuauauaaaauguacuauuaugccuauuacuaagcucaaauauuuaaacaacuuuaaacuuggaucauccauauaaguagccaaagaaggagaagaaaccccuucuccugcauuucugaauuguuuugucugggacaacauuaaccuacagagguucuuaauucuugucacugcaugaguggcaugccugaggugaggagauuucaagucugauggagcuacgagcucucuguugugcuauucugcuuguccuuaagugggcuuugacugggauguuuggucucaguauuuguauagcuugcuuaccuucguaagaagaauuauagauccuuaaccaaguucacaucagccauuuagcauucuauggagggagguucccaguuccauaucaguggccuuuggaggagacugugguggccuugccauaacuccaggguggcucugauggugguuuuacauuaagaguuugucucuagagaagacacaaacauugcaugggaauacauuuuuaugauauuauuuuggguccuuauugccuuuuuucucucaagauguuuucaaacugcaguaaacaaucaaucuauaagaccauugaaaguaaggcccaggaguguuuucaagaacgcagcaauaaaguuugugggaacucgaggguggaugaaggagaagagugugauccuggcaucauguaucugaacaacgacaccugcugcaacagcgacugcacguugaaggaagguguccagugcaggugaggagucucuccacagggauuuugggaaguugguauaacaagauguccaaaauaagagaagacugaacuugcaggggcuuuagaaucaacugaaaggggugugaguguguuuguuuacaucuaccucuuuugcccuucacagcaagaaauugcuuucugggccuggcacgguggcucacuccugucaucccagcacucugggaggcugaggugggagaaaugcuugagaacagccugggcaacauagugagacacuaucucuuaaaaaacaaaaaacaaauaagaaaagaagaagcuuucuggaaagcagugugacauuauguaacaaaauccuugaccuugcaugcuccuugguuuagcaguccuauaguuaaaagaaucuuuuuuuuuuuuuuuuuuccugagacagagucuugcucugucgccaggcuggagugcaguggcgcgaucuuggcuuacugcaaucuuugucucccggguucaagugauuccccugccuuagccuccugaguagugggacuacaggcacgcaccaccaugcccggcuaauuuuuuguauuaguagagacgagguuucacuacgguggccaggauggucuccaacuccugaccuugugauccauccaccuuggccucccaaagugcugggauuacaggugugaggcaccgugccuggcaaaauaaucuuuuuuauuuaauuuaauuuauuuauuuauuuugagacggcgucucgcucuguugccaggcuggagugcaguggcgcgaucucagcgcacugcaaucuccgccucccagguucaagcgauuccccugccucagccuccccaauaacugggacuacagguacgcaccaucacgccuggcugauuuuuuguauuuuaguagagacggaguuuuagcauguuggccaggauggucucgaucuccugacuucaugaucugcccaccuuggccucccaaagugcugggauuacagaggggagccaccgugccuggccuuuauuuucuuuuugagacagggucucagucuguugcccaagauggagugcaguggcaugaucauggcucacugcagccucaaccucccaggcucaaucaguccuuccaccucagccucccggauagacaggacuacaggugugugccaccuggcuaauuuuuuuuguauuuuuuauagagaugggguuuugccauguugcccaagcuuguuguaaaguccugggcucaagugauccacccuucuaagccuccuaaaguguggagauucuagguaugaggcaccaugccuggcccaaauaaucuuuuauuucuuuuuuuuuuuuuuugagacggagucuugcucugucgcccaggcuggagugcaguggcgugaucuuggcucacugcaaccuccgccuccuggguucaagccauuccccugccucagccuccccaguagcugggauuacagugugcaccaccacgcccagcuaauuuuuguguuuuuaguagagaugggguuucaccauguuggccaggcuggucucgaacuccugacuucgugaucugccugccucagccucccaaaguguugggauuacaggcgugagccacugcuccuggcugcccaaagaaucuuuugggcaacagagauaagauuuaacaaggguauaagauuuaacaagguuuuuuuauggcuacauccuaauagcaaaauuuuggaaacaaucaaaaugacagucuugggauaugaauguuaucaugauucuauauacuggaauaguguggaggaaguagguuacaaguuagaaaguuacccagguuuucauuuuuuauauacacugauagaccagugccuggcuuagaaguaaaaggguuaaacuucaguuuucuggugaauaauugagauuuaacuggauacagugcauauuaacgcuguaaauacugauggggaguagaguucuggcugccgagugucuuagcuauggauugccuuguggccccaccuugucuuuuuuuuuuuuccuugucuuuuuuuuuuuuuuugagagagucucgcccuguugaccaggcuggagugcaguggcgcgaucuuggcucaccgcaaccucugccuuccagguucaagcuauucuccugccuuagccucccgaguagcugggauuacaggcauguagcaccaugcccggcuaauuuuuuguaucuuuaguagagacggaguuucaccauguuggccaggcuggucucaaaccccuaaccucgugguccaccugccucaucuuuuuuuuuuuuuuuuuuuuuuuugagacagaauuucucucuuguugccuaggcuggagugcaguggugcgaucucggcucacugcaaccucugucuccgggguccaggcgauucuccugccucagccuucuaaguagcugggauuacaggagcgcaccaccacgcccagcuaauuuuuguauuuuuaguagagaugggguuucaccauguuggccaggcucaucucgaacucuccugaccucaggugauccacccaccucggccucccaaaguguuggguugggauuauaggugugagccaccucgcccagcccaucuugucuuuuuuaaauuaaugcguuaaaugaaugaaaaccaagggcaccaagauguuucacaggugauugcuguguucccauucuuuucuccuauaguguggcauuuaugugaccucacgcacauuaggaagggacaaagugugugcagguagcucuagcagcggagaugucugaugauguaggagugggugacggagccaggaggucuuccccggugaucuucaggucacuguaacguaacuguagcguuugauuugauauggggccauaauuugaauugcucuguuccugucugcuguucuucuccagugacaggaacaguccuugcuguaaaaacugucaguuugagacugcccagaagaagugccaggaggcgauuaaugcuacuugcaaaggcguguccuacugcacagguucguguucuuguugcuuccuuggaaugcugugggucaagugugugugugucuuugaaaaacaagauuauguuuuguucagaugagagacaccuuauuuuuaaucucauaugccggguugaguuucuggcacuccuuaguuugugacacuuggcuuugguggguuuaagaccuguuucuauuucucuuucauuuccaucacucuccucuuucuccucacagacauccacucuacugugguuaauauuugccuggauauguguauauccuugaaagaucauauaguguuauuuugugcauguauguguuuuuaaugugccaaaaugauauucuaccuuaaauuuacuuuuaaaaaauucaguaucauguuuuaaagaauuacccauauugugcuacagauaauauaacaagguuuuuaauggcuacauccuaauagcaaaauuuuggaaacaaucaaaaugacaaucuugggauaaugaauguuaucaugaaucuaugcacuggaauaguguggaggaagcaggauacaaguuagaaggguaaccaguuuuucuauauguaucuauauguauuucacuguuggggacaccuacauauuguuuaguuauaugauuggcuguguuuuacuuacaagucaccaagugguagcuacuuccauugccuucauccccuugauauuccagauaggacacagaucacauccuccuacgucccuucaggaaccuguguguuucucuggguacugaggagugucauuguguagucacagaggcaggaugugcuggucucuagagcaccacugcuagguugccugugucugaggacuccuuauccugacguucuggccaacgcuuggaauuacccugcuguccuauuagcaugaugaguauaaaguaaucucuuguucuuacuuuuuuuuuuaacagcccuuguccuaaugcacuuacuuacauuuuucuugagcaucucuuuauauuuuucagcuauucagauuucuccugugaauagccaguucauauauuugguucauuuuuuaaaaauuggguuucauguuauuucacuacugugaauuuggaggaguucuuauguaaucauccauuugggcauacgucuccuaucuguugccauucucagaacagaaaucuuuaacguaaucaaauccaucauuuuguuguguguguguauuuuuuaaacacaugguucagaaaagccauggcggaugguuaaaaagauauuuuccacagcugcuucuauuagcuucauaaguuguccuuuuacauucaggacuugaaucuuucuggagcuaaccuuuccagguguccaguaucuuuuguucggucaauuguugcuuuaaaaauuucaaagcuauguuauuacuagguauauaaacggacauaucucuacaucuuuaucugcuguuccuuaccaguauauaauguuccuuuuuuacccuugcgauguuuuuugacuuaaauugucaaaaagcaauauucaguuugcuauucuaguuuuuuuguuccucugauauaucuaucugucccauucuuauauuuuucaaaauuugucucucuugguugguugguuugauuuuguaauagcuuuauugauacauaauucacacucauguaguuugcccauuuaaaguguacaguuuaaugauuuuuaguauauucagauuuaugcagucaucacaauuaauuuuagaacauuuacauuacuccagaaagaaacccuguauccuuuagcuaugauccuccaauccccccauuccccacaacucagagcaaccacuaaccacccuauucuuuauggaguugucuguuuugaacauuucauauaaauggaauuauacaauaugguuucgugaccacauauuguaugacuggcuucuuucacugaacauagcauuuuuaagguucauguauguuguagcauguaucaguacuucauguacuuuuauugcuggguaaauuccauugcauggauaugccacauuuuguuuauucauucauugguugauagacauuuggguugcuuccacuuuuuugcuauaacaaauaaugcugcugugaacauuuaucuaugaguuuuuguguggacaguuccuuuggauauuauucaggaauagaauuucugggucaugugguaacuaugcuuaaucuuuugaggagcugucagacuguuuuccaaaauggcuacaccauuuuacagucucagcagcauuguaugagggucccagcuucuccauauccucaccaacacuuguuaucuuuuuuauuguaacuauccuagguuuugugauaaggaugcaaacagaaagcuggaggucuucagggaccuagugaaugaaguuguguccuauuuuggcuugauuuugguuuuccgugugcauaguaugacauguugcccauguuuuuaucuuuugggaucugucacuaucacauuacuuugccaaauguuaggaaccugauggcccggcacaguggcucacaccuguaauccuagcacuuugggaggccgaggugggcagaucacgagaucaggagaucgagaccauccuggcuaacacggugaaacccugugucuacuaaaagauacaaaaaauuagcugggcgugguggcgggcgccuguagucccagcuacuugggaggcugaggcaggagaauggcgugaacccgggaggcggagcuugcagugagccgagaucacgccacugcacuccagccugggcaacagagcaagacuccaucucaaaaaaaaaccaaaaaaacaaauguuaggaaccugaauaucuaaaucaagcuuuaaagaagcauuugcuagcuaugcucaauguuucaucuucacuguaauaauaaaauagauugagaaaaaugcuuucuuuuaaauaaacguaaguaaaacaauuugaaaacguuuguucuuaucaaacagccuuuuguucccuugauauuuuauacaaaauaguagauagcagaggauaaguuccugauaaggaaucaguauuuucuagcaggaaaagcuagagaacaacaaccucaaaaaaaaaaaaaaaaaagaagaagaaagaaaaaaagcaauuagcauuucacaaccagcagcagcagcaucaccugggagcuuauuagaaauggaaauugucaguccccucccuggaucuacugcaucaaaaaaugugggaagggaggccagcagucugugcuguguaaccuucugucaggugauuuccaugcaugcuaaacuuuggggaccaugcuagauagaugauaccauuuucagaauuauuuuccuaccugucuaauacucugacuuuagucuuuuaagaacagaugcucaacagauauuuauugagcauuuuuuaauguaucagggcaguaucauauaccaaaaauacaauaaugauccacaauauaaaccuucccugagcucacuggacaucauacuuucaguaauaguuuguuaaaugacuguugacaugaugaaugcccagugcucaugaaagguuuuaugagaaccagaggcaaagugccugguuaucuguuggguacuuaauaaaccaucacuuuuguuugaaacuggccagauuuucuguacauuuuguguuacugcucugaaacccucuaagucagaauucuuuugauuggcuucauucuucagcugaaaggccaguccagagcuguggauauauaguccauugcuuucauaaaguguuuuuuuucuccuccucuauuuguguugacuuuuagcuacuugugcuauucauuuuccagaaugauucacucauuccauccugucucucccaguuuaacuuucuuugguggguuuucuuuggcauuauuggccugggcacaguggcucaugccuaucauuccagcacuuggaaggccaaggugggaggaucccuugagcccagcaguuuuacaccagcauggucaacacagggagaucucgucucucaaaaaaaaagaaagaaaauuagccagguaugguggcguacgccugaaauccuagguacuugugaggcugaggcaggaggauugccggaaccuaggaguuugaggcugcaguaagcuaugaucacaccccugccuuccagccugggugacagacugagacccugucucaaaagaaaaauaaaaagaauaauugauuuauuuaagaaauauuuguaguauaccuauaauaugauagggauuggagauaacuuaauagauuugaucauugcugucauggggcuuuccagucuaguagagggaaaacagaaaauaacauuaaauauauauauauaaauugcaaaacauaugcaaugaaggagagaaggagugugauagugcauaauggaagugggaggccacaucaacuuagcauccucagggauaucucagaaaaccuuugagacaaaacuuaauccauaagaaaagccagcuaauugccccaaaagaguggaaacaccagcauuccagguagaaggaauaguaucuguuaauauugaaggaacugaauggagguugucauagccaaagcagugggcugugggagaguugugugcgaugaagucagggccagauagggaaggccguggaguucuuuuaagccuucauacaaaguuugcaauuuauucuaaguaauagcacauaggauauucuuuuauauaugacugugagaugcagaaguggagaccaugcauucuaacuggggcuugggaggccagggacucaugcagccuagccuggcacauagccaggcacucccauuuaaaugcugauugcuggugagaugcaggcucuuguccuagcucuguaggucacuuuuugcuuuugcaagguaagaugcucacuuguaugagaaacagcguauuaugcaccuguagaacugguggaccugugacucauucuuuuuguuaugacugguguuugcuuccagguaauagcagugagugcccgccuccaggaaaugcugaagaugacacuguuugcuuggaucuuggcaaguguaaggaugggaaaugcaucccuuucugcgagagggaacagcagcuggaguccugugcauguaauggugagcaguuuuauucccaguccagcagcaggagaaaacauggccuuugucugccaggcucccuuccuccauuuggagguugugcgaaugacagcaguggugagauccaagccgaggaugaggggauggggaagggcaggguggugucuggagacaggcaucucugcaugcagauccaccauaccugggagaccuauccuguugguguuucuucuugcugcaguuucaggccauauggcaggcuuugaggugggagaggagggaauuuuguugggggugaguggguggguagguagagguguguccuagccuuccucugcuccauaucauacaaaccacaaaagcagcaguagcuaucuacauuacauuggcauggaacuaggauacuccugcaacaacuccaccagagagagcugauuccaggaccuaaccccacuagaugaggauuuuugcaguuaucaagaaggcugggucugcuccccucugaucucuuagagcagccuggggcaggagccucucuccugcuggccugucaguuuuccuuagguuucugugcuauuuuggaaccccuggguuugagggcauccucauggacuggucagggacuggcuggacucugcuucccaccccacuuaaaccaugggagucgaugagggaguucucuugcuuucaaaauagacagagagccagguguggugacucacaccuguaaucccaucacuuugggaggccgaggugggcagaucacuugaggucaggaguuugagagcagcuuggucaacauggcaaaacgcugucucuacuaaaaauaaaaaaaauuagccgggugugguagcguacaccuguaaucccagcugcuagggaggcugaggcaggagaauugcuugaacccagggggcggagguugcugugagcugagauugcgccgcuacacucuagccugggcaacagagcgagacuccauuucaaauaaauaaauaaauaaguaaaaaauaaaauaaauaaaagacaaagaacccgguaguuaaauaaaaucacuggguuggaagcucaccauccauacaguggagugaggaacucuuccaaguucaauaauguguagguaaagaagauagguugagggcagugucucacaucuauaaucccagcacuuugggaggccaagguggguggaucacuugagcucaggaguuguuugagaccagccugggcaacauugugaaaccucaccucuuaaaaaaaaaaaaaaaaaagguaacacguagcagaugccaaauaaaucuguuguguugaaugccaagaggcuuggggugcucuggaaggacagagcccgacacaguaaaaguccaagaaauauuuuauaaauuagugaaugaugaaaagguuuucuuuuuuuuuuuuugagauggagucucacucucgcccaggcuggagugcaguggcgcgaucucaggucaccgcagccuccgccucccggguucaagugauucucgugccucagccuccugaguagcugggacuacaggcaagcaccaccacaucuggcuaauuuuuuuuauuuuuaguagagauggggucuugccauguuggccaggcuguucucgaacuccuggccucaagugaucuguccgccuuggccucccaaagugcugggauuacaagcgagagccacugcucccggccuuuucugaaaagguuuucuuuuugcuuguuuuuguguucuaguugauuucuuuuucuccuaaguaugguuuaauuuucuggcauuucugccauucuuauguaugcccacauggcucacagaugcccgguguuuuauccugugaccugucagagcuguucuugggaggaguuguggagcuuuggcugcagggcucaugcuccuggggucacugagcuccccacccaaggguggacaguugugucccagcugcucucgcuuucagggagccagugugggcccugaggggcacacuuuagacugaaaaaccaaggauugaagucagcagggugacaagaaaguugggacaaagggaagcauuuagaagagcauugugaggggcuugaaggggagagaauaguuagacuuugaagagaggucuugaaucuagaauggauuuuucucugcauuuuuuuuuaaaccuuguggccucugucacugaaggcugaggagugugaccucagaaacuacuccuuggugggggcuauggauaguauuagcuauuuaaauaaaaaauaaaugugauuucuuaccucuuugggagcauggucagggaggaaagaggaggcaggaggagaggcaggucucagaacaauccagcugucaaugcguguucucuguuccagaaacugacaacuccugcaaggugugcugcagggaccuuucuggccgcugugugcccuaugucgaugcugaacaaaagaacuuauuuuugaggaaaggaaagcccuguacaguaggauuuugugacaugaaugugaguauuuauguacagcuuuuucuguaacagccagauaggaaguuuuuauuuuguaaguacuugauuuugcagaugaaaacaaaucaaaacacaaguggggcuacauccuucuggcccauuguuaucuacggguauuacuuaggaggagaagacggagugcuuucaggucccugccuguaguuuccuucuguggugggaggcuuugagcccagagacugagaaggacugggguggggacuuuaugguaaaguugguugguuucaggcaguggguccuaauuauguuuuccuagauuacuuacagaacugacuaagauugcaaaauuauucagggugugauuuugaaacaggugcugaaugaguaggaaagaccuagaaggcugcuugacuuacuuaagccagacccuuuuguucucuagagaagcauaauuuuucucaugcagaaugaugggagaggguuuuaagauuuacgaggcuucacagggagucuggcuguguuguucacuguccacuguguauguguagaguccuuacuggaaugccucaucuuuagcaaacugguuuccuugauuuuugucuccugguaauucuaaaucacuuguaaaaauggaguaauuaugaaaguguuaaugacagauguucuacuuucuuggguacucauuacgcggaaguuauugccuugugucaaagaugggaaaacguuugauuuuaaugaagcccuuuacaugucaguuauuuuuauaaagcuacauugcuucugaauacauuguguuugggaaugaugcuguauguauguuuuuucuucauagggcaaaugugagaaacgaguacaggauguaauugaacgauuuugggauuucauugaccagcugagcaucaauacuuuugguaggugauuuccccagauuacuuacugagagcugagucaauuucugugaugacauuagaaaagugugcuuucagagugaugugcuuuaauucugcaguagaagguggaacuauucacagcuuuaguuaugaaacaacuuuguuggcuagaauaaaaugaacucauagauagucuguccccguggagcuuggaugcacagauuuucugacaagggaaauaaagucaaaauacuggcuuccuucuuuacccaaaaauauccaugugauuagcauaagcauaguuuaaugcuauagacugaauccugauugauguaagaguguuuauuugacugaaugcuauauacugaauccugcuugauguaaaagugagccucauauuuugcagaagcaggguauaucauguugucacgaguccauaauuuaaucacaaaaauaauauccagguaacaaaaacuuugucuucuuaagcauuuacuaguaguagcauuccauauuaaucuguugacacagcuacuccagguaacauguugaauauucugcaaucucuuccugucagccaguauaugagggcuauuucuuuaaaagcacuugguauggagagauggugugguguaauacaggcagcacagacauucugcucucgguaguaugucuagccagcagcucuggcauuugacacaaugguaauauccuaagagcauuucacuuuagauuugugaaguacuuggucaagacauuaacuguuuggaauuguucacaggaaaguuuuuagcagacaacaucguugggucuguccugguuuucuccuugauauuuuggauuccuuucagcauucuuguccauugugugguaagucaucaacuuuuaaguaauuaaauguuuuauuuaaauuuugaucaacuccaaccauguaaucucuggaaaagguaaaacuuguucuuagcaaaguuuggccugauauuuccaauagcuuuuuuuguuguuauuccuaggggaacaugucuuguagaaagcuuaacuaauggucuuuuaaaaaaaauacuauuuuuguguguugguguuuuaauauauaaauuucuuaggaauuuuauacuuuuaagcauaggagacuguuuaacuggauuuguccagguccuuugaugaguaaagcccuuauugaagagcauuuucaggcugacuucguugcaauagagcaaauaucaaacaucggcauuucagauguuccccauauaucauguagauuauuggcagcagauggcuaugucuucagccuucugcacaaauaggauguagggacuggggcccagcugucauauagaguauuuacaucuuccccaaaaaauaagaguaagcagucuuuucuguucucauucagaaucaguaacagcuacaaguugaauugggcuuugacuaaggaacuccugguccuuuauaaauuugaggcccuuuuucauaaauguucuuacgaauccauucacuugcaucuguggggaauggggauuugucugcuguagagaugagaaagucacacccaggcuuccagacuuguuuucccaaacucuuucauaguggccuuccuaugagcauuuaaaaauuccagcacaacucugaugacaaaggaguuuuuccuacugccuccuuccuuuccuuuccugcuggcuucuccugccuaggggccaucucacagagcagcucuuccucaggguggugagcaugauggguauaggaagaucucuagggagcacuugugcugaagaaagcugaaggugacgugcuugaagcuuugacagaugucucuggaugacagugccauccaucacgauugcuucuauuggaggauggaaccuauuuuguuuacagggaaguugcacauguggacaaggcacgacccuugauuucagagcaaagccuccgauaggagggagggccauggcuuguuuuuggucauagaaugcauugauggcacccagacaggaagccuaguccuggauucuugguccuugcccucugucaccuauuaugcuucagccacaggcagggauggggcagcagauggccaugugguuagccuucugcagaaguaggauguagggauugaggcccaguuccuccagcagagcaugguccacagaaacuguggagacagcuaagagagugaggccaugggccggggcagugcgaagaaugcugcaggcccagccaccugggucuuccuaccaguugcccuuccagucagugcgguccugguguacccagcaucugggacauuugucauuucaugcacaggaagaugccuuuauuauuccccugcccacagagggauaaauuucucagaaaacauagcacuuaaaccuugccucuuucuguacuuaacgccaaaauguauuuccuuugagugcaaaggaaacacuucuagacugguggcauaacuaaagcuugggugagaaauggauugucaucuguugagccugcuaucacuuucuacaacucagguucuaaguucuucaguuaguguuaggaauagccugugaugaaauaguacucacuaacugaauuguauuuguagggaaugaccuucuugcuguuucuuucuaggauaagaaauuggauaaacaguaugaaucucugucucuguuucaccccaguguaaguauaccauaugaaagaaacauaaucuucgccuggucugaggcccuguuaggcaaagaccuucaccugacccagcaagagcuuucacuggcugauggaaggucauguugcagcaggaagggucuagguuggaauguuuacccuucugacaacagugauggugaacuucgauuaguugcauggauggacauuuaaagagcugugcuguccccuucccaagccauaaggagugauuuagccauucaacacuuaguuaauauuuugaguucaauuucucucuugggaucuuaccuugagagguuugaauccucuuuugggucuucaaaugguaaguaaguuuucaggaugcuugaaagcuaguaauuacuguuuuugccauuaaaaguaauggcauuaauuacuuuugcaccaaccuaguauuuuuuagucacuuagguugagugagccucaccuagcacuuuuuucuuagcaucacagugccaacagaauaagaggcuguuugauggguaaggguggagcugugaggaccuccgauucaucuuuuauuccuaucaaucaauugaacccaugucuuugcagaacgucgaaaugcugagcagcauggauucugcaucgguucgcauuaucaaacccuuuccugcgccccagacuccaggccgccugcagccugccccugugaucccuucggcgccagcagcuccaaaacuggaccaccagagaauggacaccauccaggaagaccccagcacagacucacauauggacgaggauggguuugagaaggaccccuucccaaauagcagcacagcugccaagucauuugaggaucucacggaccauccggucaccagaagugaaaaggcugccuccuuuaaacugcagcgucagaaucguguugacagcaaagaaacagagugcuaauuuaguucucagcucuucugacuuaagugugcaaaauauuuuuauagauuugaccuacaaaucaaucacagcuuguauuuugugaagacugggaagugacuuagcagaugcuggucauguguuugaacuuccugcagguaaacaguucuugugugguuuggcccuucuccuuuugaaaagguaaggugaaggugaaucuagcuuauuuugaggcuuucagguuuuaguuuuuaaaauaucuuuugaccuguggugcaaaagcagaaaauacagcuggauuggguuaugaauauuuacguuuuuguaaauuaaucuuuuauauugauaacagcacugacuagggaaaugaucaguuuuuuuuuauacacuguaaugaaccgcugaauaugaggcauuuggcauuuauuugugaugacaacuggaauaguuuuuuuuuuuuuuuuuuuuuuuugccuucaacuaaaaacaaaggagauaaaucuaguauacauugucucuaaauugugggucuauuucuaguuauuacccagaguuuuuauguagcagggaaaauauauaucuaaauuuagaaaucauuuggguuaauauggcucuucauaauucuaagacuaaugcucucuagaaaccuaaccaccuaccuuacagugagggcuauacaugguagccaguugaauuuauggaaucuaccaacuguuuagggcccugauuugcugggcaguuuuucuguauuuuauaaguaucuucauguaucccuguuacugauagggauacaugcucuuagaaaauucacuauuggcugggagugguggcucaugccuguaaucccagcacuuggagaggcugagguugcgccacuacacuccagccugggugacagagugagacucugccucaa

SEQ ID NO: 192348 - RNA, 23613 nt, Homo sapiens
auuuguucuuuuuauuauuauuuuuaaguucaccuacagcugcaguacacacacaccgcuuuauuuggcuagcugcuauucagaagacacuuccugaauucaggaaaaauuuuuuuaaaaaccugagaacaauuccugugacuucuuagcuuugaugaagugcauuuacuuugacauugauauagcuuguaacuacuuuuggaauuuuuuuccccuaacacuuugaucucauuaaggguauuacaccuuuuccaccagaaaaugcagagguaucaucuuucuuggaaaccaauugaaagcgucccauuuuaacaaaaugacauaaaauuacaaacauuuacauguuuaaauucaaagccugauccaucuggugguaagaaauguuaacuuauuuuaaaagauguauuugcauuauuaaaauauaguaacgacuuccaucuuuacaucaaaagaaacgggcuugcauaagcaauggcucccagcucuggggaggguuugagccacgcccuugcgggggccgcuccaagcucugacuucaaaaguuggaguuucccagcugcgaacagcuggucaaaggcacucucaaaaguucaaggaaaugcccguuugcggauggccgcagcaggccuguggggcuggggacagcgccaaggagcuggccguugguuccugagaugcuccugcucugcuguguucuaaggaccugcgagcuggagcucuucucgggaaaaagaaaacgcuggggaggccuccgugugggcgggucaagccagauaaccaggcuuguacuggcuucagcagaagccgcgcuguuuccuccuucccccucuaucuccuucuuucccuucugucuccuccuucccccucuguccugaugcccugcaggcugcuggggaggagccugccgccugccuccugccucccuagaccgcuguucuccccacagcucucccccggagcugucccccagcaggccacaccugggcccaggcuccagaccugcccgcccacacaggaguccccucuagccggagcuccgcccccuguucccagggcguccugggcaggucaguuuucccaucugucaaccaggaacauuccaaggcucuuccugccucacugcugugguuucccaccuuccacccaggcaggaagagaauuuaaaagccccgcaggcacuggccaggcugccugugagagggagaacuggaaagccaguaucaggcagacccucucccgguuggaccugggcgcuggcuccccgcagggaaggcacugcugugccuggggcaggggaccagcaguggcagcaguuccagauugucagagcuggggagggccuccaagagcugccagagcugauuuuccagagagggaaacugaggcccagagaggcagugacgagcucuaccucccacugcaaggcagaucagagcugggguucucgcuccucaaagugcaguuggggcuucggagcucgggccugggcugggagcugguuagacguacagaaccucaggcccugcaagucaacagcacccccaggcugcucauuagggaguuaaaguugagaagcacuaagcugacccggccaccccuggagagaugggcccgagacugagggagcagcgcgggugcaccuuccacagcagaaccuuccggaaguguuguggcgcggaugccaggaggggcucgcuugugucaccuaguccucgugagcccuccccacuguggagagcgggcaaccaagaggggcacgcauuucaggcuccagaagaacugggcaggcuccccgcguuggggaggaggcgccggcggcccaggcccacgcaccugugggucuacacagcuaaucgcccccaccagcaaccaugaccgccaguggcuggcccaggucagcgcggucugaaaguggauuugaaagggcagcuuugaauauccgggagugacugcguuuuggaggugguucagcuccugcuagagcucugugcaagcagagggugccccagccagcaggugccuccgaggccuggcggggguggagcaugcuguccucagcggcaguacucccgcucgaugcucgccaucagccccucuuccgaguggucguaggagauggcugccggccucucgggcuucuugcgaccgcugccuggggcucugugggucagaaaugggacagggcugucaggaggcaggauggugcguucacacucauuuccccuggccaccacaauggcuccuagugggcccauccugaaacccaaaccgaagucuuugcccugggacacccuguggcgcucucgcccagcacauauccaccagcaggcuucuacugcguccgcuucaucucccacaacgcugagcccucgcagaguggaagccagcaccugcccugguugagggaggacgggcucuggggugggaagaccgagcuugaaucccagcucugcggcucacccgcgcgccucaggcaaggccagugugucuccgagccucgguguuuuuucucaagcacguaacuuuauucaugagucguucugaagcauaagauaaugcaugggcagcaugugauguggaaucgagcacaccacagccuuaaucaaugggaaucacggccaggcgcaguggcucaugccugcaauccuagcacuuugggaggcccaggugggcagaucacuugaggucaggaauucgagaccagccuggccaacguggugaaaucucaucucuacuaaaaauacaaaaauuauccggguggggugacgggugccuauaaucccagcuacucaggaggcugaggcagaauggcuugaacccaggaaguggagguugcagugagccaagaaugagccucugcacuccagccugagugacaaaguaagacucugucucaaaaaaaauaaauaaaaaauaaaagggaauuacugucauguuggcugcuugccgacaucgguccgugcuuguacccucuggggucucacaggagcugcucauuguggggaaccacacguucaggaucccgccagucccucagcccaccuggcagcccagcugagagggaccgagaccagagcuccugcuccugcugccuggguuccagaaagcggcugcgccagccuggacccugcuggcuuguccugcucucccagaccuucuggacuuuguguggacaccuggguggugcugacugcccccggaccugccacgguugugucgaaaugugcagaccuuugcaggaggcagucccgggagcccagggcagggcaugaagccucggucaggcugggugcugccuccuggagaugcugccucggaagggggugugcaggucugcagcugacaggguccaggagaggcaggccagcugcccacagccagguguuggaugcugcccucccaguggccagccagggacucugggcaaugggaacaccgccaacugcuuugccacuugccagacauuagggcuagccgccccccauuucccggccugguucccccucugcgagcuuggggggcugggcuggauggacuuaaaugucccucugacuacucccacugaugcucagagcacagccuccggguccccgucuggcucucugggaacucagggcaagagcugggcuccuggcacagccacuugacuucaucccccaggaaggaucggcaucuagcagagggccuccaggcguccaggggacacacuccuccccugucccggagacgucaugccccuauugaccagcuggcuccagggacuauacuuauuagcacugcccgcggccagugcgcagaaacagcugcguggucacuguugacgccugcagggcucuuggcacacugccugucugugaaagcacugaaggcaauauguguuccuugcagcccugagacacaguggaaaugcagacguucuggagccaggcagaucucaccuggcucugccacgcagucgcuguguggcugugggcaaggcauguaccaggccucacgccccuguggauaaaacccagcagcuacuccacgaguccagccugagggcuggaccaggcgccaucugcggugugucuaccacagagcugggcacuaaggaagcacucaacagaagucgcugcgaugcuguuaguuucgcaguggcucaugccuggcccggcgcaguggcucaugccuauaauccccagcacuuugggaggccgaggcagguggauugcuuugagcucaggaguucgagaccagccuggccaacauggugaaaccccaucucuacaaagaguacaaaaauuagccggacaugguggcaugcgccuguagucccagcuacucaggaggcugaggcuggagaaucacuugagccugggaaguggaguuugcaaugagcugaaauugcaccacugcacuccagccuggacgacagaacaagacccuaucucaaaaaagaaaaaccaaccaaccaaacaaacaaacaaaaaggcagaguaagggaccagcaaagcacccaguacagaggagagacccggccacugcccuuccuguuucccaccauccuccugggcucaccuccccugaggauuguugggaagaagagaaaugggcacgggacgcccagacacccucaagggcaacaggaucuccuggccaacaggaaucccaagcagcacuucuggaccuggggacccccacaggaauaaaagccccucugggcucaccaggcagcccccugcuugccuguggaugugaagcugagcccugggggagguggcuguccagauucacacagccauucuccucacucguccugucucacucagcacccgacaugcccuguagguggaaucuuggggagaaaggagagcagggacuggcgcaagggaagcugacgggcagcccuggggcuagggugaguaggacgguaggcaguccugggucugugagaggucaggcuccacugggcuccacagccaccccugcccugucugccuggcaacacuccaccaacaccguggggcaauuuguggggcuuagagagccagguggggccauaagcucuuucuuuccccugcuugggugggggcacacagauaaaagggaaaaauugauccuaaagggauucuugggaagucucaccacucuugagggagucaagaaaugaauuuuuguuuaaauucucauuuacugucagguuuuccaucagcagggacuccuaaagucaugcuuuuuuuuuuuuuagacaggaucuugcuuugucacccaggcugaaaugcaguggcaggaucacggcucaccauauccuccacuucucaggcucaagccauccucccaccucagucuccugagcagcugggaccccaggcaugugccaccacgccuggcuaauuuugguacuuuuguggagacgaggucucccuauguuacccaggcugaaagucacaaauuucuuaaaagaaaaagaccuuuccaaggaaaaucacuccaagaaaagaaaccaauacgcuucuccagagagaacaaauccauuguaauugggccucagaaacccacauguuaaaugaggcaagaacauuuguguuauucuacugggucuagaauuuucucuuuuuuucuuuuuuuuuugagauggaguuuugcucugucacccaggcuggagugcaguggcgcacucugcgaucucggcucauugcaaccuccccaucaugggugcaagggauucuccugucucagccucccaaguaccugggaauacaggcacgugccaccacucccgacuaauuuuuauguauuuuuaguagagaugggguuucaccauguuggccaggcugcucuugaacucuugaccucaggugaucugcccaccucagccucccaaagugcugggauuauagguaugagccacugcgccuggcugggucuagaauuuucuagaaucugccgccucuccaaccuggggaaauacugccuuggaucucaguuuacucacuaggaaaauggggaggaguaaccucucucaccaauaccguaaugugucuggcccaaggccuggcuuacaguggguacucaacaagcauuugcagaaugaacaguaagugaauuucagcagcagcugcagacagaaguuucuagaaccccuauguuccccuccaugagccccugggcuuccacuagcccuuccuuacagacuucaggucaggauggcccagccaaaagcucagggaagcagcgacuuccucccgcauggcugcuucccucugcugcuuccgcagggcccucccgggggaaggaccuggcguugucaggauggucaggacuggggucaaggcccacacgccccaggcugacauuaaacaauccugucaauaagcgucuaugaaaugcuaccaugugccuggagcuaugagggcccagaggcgaaucugauuccuucugugaugaggccuggagagaagagaggggacagggcaggaccacaucacguggaccuacuacaggagaggccacaugugggaggggcugggaaguugcaccaugcgggaggagggacacuaguuugaccaggaaggggauagaguaugagggggagauguuuaaacugugcuuugaaggguuucuucuucgauauuuuauuaugaaaaauuucaaacauacugaaaaguuaaaauuuguagauucaacaauuaaguucaacuuugcuauauuuacuuuaucacguacuuauuuacuucuucaucugauuuucugaugcaucccagagucagcugcagacauuagcaccuccacccugaaacaccauuggaaggacccugccugggagggugagggugacacuggagggaggagauugaagggcgggacacuguugcagccacagggugaggcacugguacccaagagcugcacgcuggggggcugagacuggccugcaggguccacggcugccacgggagucaggugugugccgugggcagcgagaagcacaguggguacagggcagaugcugccagcccugacccuggggcaggacugcugggaccuggggcuuccuuccugguggaagcacggugcuggaggggcugacagagcccugggcacuccuacgccuagggcagcacucagggaggcucccauuaaaguauacugaaugaaaaggcugggugcaguggcucacgcccauaaucccagcacuuugggaggccaaggugggcggaucaccugaggccaggaguuugagaccagccuggccaacuuggcgaaacccugucucuacaaaaaauacaaaaauuagccggacaggguggcucgugccuguaaucccagcuacuugggaggcugaggcaggagaauugcuugaacccgggugguggagacugcggugagccgagaucguaccagugcacuccagccuggaugacaagagcaaaacucuaccucaaaaaaauaaaaaauaaaauaaaaauaaauaaauaaauaaguauacugaaugagugaaguaccacuggugagugguaguaacggauaugucagggguguccuggaaugugcacguguagaagucagaagaaguaauagcuaauuaguucaugguaggauuuaauccuaaauuccuugggcugauggaaacucuaaagucccugcugacagugcaggggcagagcugcgugggcaucauccucacuccucacuaccucccccucugcagcagcuucuaacauugcccagagccggccacagcauucuacugggaagcaauggccagcaguuuccacucagcauucaaggcccucccaacacuuuaauccucccuccccaauucccuccuaccacccccaccuguccacacagugucccaggagccucuuuccuuccucucuccucggcgaacuccuguacguccuucaagccauauuauuuuuauauuuuuauuuauuuauuuauuuuuuucugagacagagucucccucugucacccaggcuggagugaaguggcgcgaucuuggcucacugcaaccuccaccucccggguucaagugauucuccugccuuagcccccggaguagcugggauuacaggugcgcaccacugugcccggcuaauuuuuguuuuuguuuuuuuuuuuuuugguauuuuuuuaguagagacaggguuucaccauguuggccaggcugcucuugaacuccugaccucaagugauccgccugccuaggccucccaaauugcugggauuauaggcgugagccacuggguccggccccuucaagccaucuuaaacaccaguucugaccuccccuggagcucgcugcuugcauuucccgagaccaugccccucccgggcugggccucagacccggccccugcacugcagcccucagcaccgcuguggggcucaggguaggaccucccagugucuguuaaauaagcgaguucagcaggguuccuguccugaaaucauuuguaauuaaggacaauggcuaacauuuccaaacuuuuucacucccacaaucuuaccugacaaucacccacucccagugaccccuugccacauuagcuggaggucagcaagccaagggggugaccggccugggguggaaagacaucccuggagcagacagacaaggccugggcucugggguugggggauuuuaaaggaggaaaugagcccaggcuccucgccugcuaccuucaaggguguucagcgugguucccugguaacgugcuguggagcugcaggugggcccgcugcuggcccugggcugcgaguuccuuaagggcugugucuuguuccuagaucuggccacagcgcacagcauggcaccugaauauuuuugaaugaguuacagcacaaauaggaaauggguugggcaugcccuggucugauccaggucacgaccuuuuuuaggaggaagagcaaagcugcggugagaugguuagccuucugcaaucuccuuggcaggaccuucccuugagggcuagggcuuugcauuuagagggagcugccucuggaaaccucgugaggaccuggaggaaagugggggacaggagggcucugaggcuggcuggagucaacaaaaagaacccguggcuucugggagagaugugccucccugguacuuacucagagacauugccgcuccccggguggcccucugugcucugcucugcgcacaccuugagaaagaugaaaugaagagacauucaaagauugucaacagugcagccugccuaaggcuuuggcuuuguguggacagacgauggccaccacuuucaacccaggauccauaagccucggagcggaaaggcucucgagcugucaaguuccauccacucauugcacaggcaagaaaacggaggcugcaaaaagaaagcgacuuggaaagcucacacacagagcaaguggcagagccagggccagacuugcugccucccagacggccacccaugugaggguugucucucacccccaggggucaugugacccacugccaccuagcacgagggcaccccgugugucaccuccagggaucuugggacccaccgccaccuagcacgagggcaccccgugugucaccuccagggaucuugggacccacugccaccuagcacgaggacaccccguaugucaccuccaggaaccacgcgaccccgaccccacucuaaacauugcccagaacccucucccucccccacugaagugcuuucucuucauaaggccaggacgugucuacacagcauguggcugccguggauucuaugguccgacaguccacuugucuacccgugcagugccagaaccacccugucucauuccuggcaucaggcaagccuggcuguccgcuaaagcaugucuucccagcuucuuucuuuuuccaagagagucuuggugauucuuggcuauuggcacuuccacguacaggugcugcucagcuuacaaugggguuacggcccgaagaaaacauugcaaaguggaaaaauccuauguugaaucaucaaaaucagggaccaucuauacauguauuauaaucagcuugucauauuugggggaaaaaaaccuuggggauuuuucuaggguuguauuaaacuauagaucauuuuagggggacuuauagcuuuacaauaaugagucuucaaauuuauaaauagggaauaucuauucauuuaggacuccuuuagugucuucuaagaaguuaucauuuucccuauagagauaccauggauaucucuuuuuauuuuauuuauuuauuuuugagacagaguuuugcucuuguugcccaggcuggagugcaauggugcgaucucagcucacugcaaccucugccucccggauucaagugauucuccugccucagccuccugaguagcugggauuacaggugcccgccaccacacgcagcuaauuuuuguauuuuuaguagagauggaguuuucccauguuggccaggcuggucucgaacuccucaccucucaggugaucugcccaccucagccucccaaagugcugggauuacaggcgugagccacugugcccagccagcaauguuaucuuuuuaaaauaaaauuuucuacuugcuugaugcuucagaaaugacugagauauauacauuuuaaaaaaauucuuuucuuuuuuuuuuuuuuuuuuugagacagggucuugcuguguugcccagacuggagugcaguggccugaucauaguucacugcagccuccaccucccaggcucaagcaacccucccaugucagccucucguguagcugggacuacaggcucgugccaccaugaagagcuaauuuuucauuuuuuguagagauggggucucacuguguugcccuggcuggucuuaaacuccuggacucaaacaauccucccaucucagcuucccaaaguguagggauuacaggugugagccacugggccuggucagagauauaugaauuuaucuugugcuuagcagucuuacugaauucucuuauuaauuccaguaauuuauggcuuccuuuggauuuucuuauuucccauucacaugaucugggaauaauggccauuugauuuuucccuuucugguccuuauacauuuuuccccuaaccuuucugcacuggcugggaccuccaguaguacaguaaaaggaagugaugaugacagucaucucuaucuuaauccuuuauugaaagaaaaaguuuccaucacaucaugacugaauaugauauuugcuguaguuucuucuccagcuaucuuguaucagguccuugucucucuaugcuguguucugggucauuucuaucucccucucuccaucucacugauccucucuucaucucugucuaaucuguuaaacuuauaccauugauaucuuucauuuugcuuauuauauuuuccauuuccagauguccuauuugguucuuuuucacaucuucuaggucacuuucuauaguccuuguccuuugcagguguuuucuuuaaacauaauaaacguagcugauuauagucugugucuggugauccuaguaacuaagaucuucauugguauauuuuuguuucuuguuucuucuaagucuucacuugguucuuuggggaguugauuauuuuuugucauuggcagcuugucaucauugaaaaauucccucuggguauucuuugaggccuaagaggccuuccuccagagaggggaugcauuugcuuuugucaggcacauagcaggcaucccuggucugaaaccacuucaaauuaaaucuauacuuucaaguauuuuggaccaccaggugaugagaauuuaggcugcaaacauaagaggugccuggguugagcuuacaacuuccuagagcuugcaagaucuuucuguucaaaggaaaaaacuuuuggguaaauagguguacacgauuacaaagaaacccacuccaacugcaugugcuagucaaccaguuuuugguucauaaauauaaauggucauaaaacgacucacaaacauuuaaagggggagggcacaugaaagaauaaucaagaugaaccagcuaggcgugguggcuaccaacacuuugggaggccgaggcggguggaucgccugaggucaggaguuccagaccagccuggccaauguggugaaaccccaucucuacuaaaaacacaaaaacuagcagggugugguggcgggcaccucuaaucccagcuacuggggaggcugaggcaggagaauugcuugaacccaggaagcagagguugcagugagcugagacugcaccacugcacuccagccugggugacagagcgaggcucugucucagaaaaaaaaaaaauuaaauuuuaaaaaauaaauaaaagucuccaggaagggaugagcaggcggagacaggccaccuacaaaaagccaagagucagguggccucaccugcucaucagugacacuggaauccacuguuauaauggcugcaaagguauaagggaaagcuauuuugaacucagaauuuuaauuccaaauaaacuauuaaucagguauuaagaaaaugaagauauuuucagacauacaaagacuuagaguuuaucuccuauuacccuuucuggaggaaaaaaaauuaauuauuuuuauuuuguuguuguuguuguuuuuugcgacggaaucuugcucugucaccaggcuggagugcaguggcacaaucuuggcugacugcaaccucagccuccugaguucaagcgauucuccugccucagacucccgaguagcugggaccacaggugcgugccaccacgcccagccaauuuuuguauuuuuagcagagacaggguuucaccauguuggccaggauggucucgaucucuugaccucaugauccaccugccucagccucccaagaugcugggauaacaggugugagccacugcgccuggccgaaaaaaauauuuaaaaaaaauuuuuuuuuuaaucauagaagauagagguuucaugagccuaauggaaugcaaggcagaggaaacuuuggauaauguguaauaaggccagaaagcaaccugucaguguccaaaguucccaugacauaaauugagcgaucagaguagcugcuccaaauaucugaagagcucauguggaaacaggccacacuucuucugccugucccaggggcucaguguguccccacuaaagggagguggguuguguucaacacagaggacuaagucagagcugccugugagggaaaggcugccccaggaggcagugagaugccugucacugaagccagacagaggcugggugauccaacagcucaugcccccuucuuagaauucaaaaucaaggccaaacacacacccugaagucacgcacuucuauuucuagggucacugugaacgcucagcaggugaggagggggagggcaaggguaagaagggaucgcgacaacagcgucuucaugcucccgucuccucaccuuccgggccuugguguacuugguucaaugccaaggagcuccccaggguucucccagccuggcccaguacccucugauggguguggcuuugccuugaccucuaucgcugcgguccccgugcugagauggagaaccuguuuuauuuuuauuuuucacuuuuuuugagauggagucuugcucugucauccaggcuggagugcaguggcgugaucucggcucacugcaaccucugccuccaggguucaagugauucuccugucucagccuccagaguagcugggauuacagauguaugccaccacaccuggcuaauuuuuguauuuuuaguagaggugggguuuugccauguuggccaggcuggucuugaacuccugaccucaagugauccacucgcuucagccucccaaagugcugggauuacaggugugagccacugcgccuggcauauuuauuuauuuauucgagacagggucuuguucuguugcccaggcuggagugcgguggccugaucauagcucgcugcagccucaacuccugggcucaagcaacggucccaucucagccuccugaguaacugaaacuacaggcacaugccaccacacaaggcuaauucuuguacuuuuuguagagacgaagucucccuauguugcccaggcuggucuuguacuccugagcucaagcgauccccccaccucggccuccuaaaaagugcugggauuacaggcauggugagccaccacgcccagccugagaacccuuuuuguuuguuuguuuguuuuguuuugagacggagucucgcucugucauccaggcuggagugcaguggcgugauucggcucacugcaaccucugccucccagguucaagcgauucuccugccucagccucccgaguagcugggauuacaggugcccgccaccacgcccaacuaauuuuuuguauuuuuaguagauacgggguuucacuauguuggccacgcuagucucgaacuuuugaccucaggccguccaccggccucggccucccaaagugcggggauuacaggcgugagccaccgugcccggcucugagaaccucuuaaagcuaaggcaggacauccagccaagcccagggccugucaggguggacacugagcugccugcugcugcccuucugaaagggcagcgggacccuugcggcagggggcuuggaaugccuggcguagggaccugacuuugcacugcucacuaacaugaagacacugcagcuucagggcagccuuaaggauggaaugccauccagugcgugaacggccccccagagcggacgcaggaggaagcaauuuccccaauggcucagccuugcuguuucuguuguuuucaccuguguuuuucucugugccugagauuuuauugcguggcccuuuaucuggccaauuuguuuaagccuugaacuuacuuucucagauggaaaaagcaugagacucccagaacacacaagcuugcugaagcagccaggaggagcugguaugaaaagcaaagacacagcagccccagaugguggcuccagccuccugcagacaggggcuccuccagggggcugccuccaccugcagaucacugagacaccuggacggacguggggaaccggcagcaccugggcuggggcccugggaacugagcugaguucaggaccagugugugugugcgcccuguuuguauguguauguuugugugcgugcgaggggugugugucaucccuugagauucuaggggggcuuuggaaagaccaaaccacagcuaaacaagaagcagaaaacauaugagaaugaagcgaauaagaucaucucuuaaaguuuuugacucuuaaaacuaaaguuuucgugaaaauuaaaguuucaaagguuacuuuuuuuuuuuuugagacagaguuucgcucuugucgcccaggcuggagugcaauggugggaucucagcucacugcaaccucugcuccuggguucaagugauuccccugccucagccuccugaguagcugggauuacaggcauccgccaccacaccuggcuaauuuuuguauuuuuaguagagcugggguuucaccauguuggccagguuggucucgaacuccugaccucaggugauccgccugccucggccucccaaagugcugggauuauaggcgugagccaccgugcccgugcccggcccaaagguuacuuuuuagaaaauccacugcauauuuacccaaaauaaaauauacaguggauuucuucuccugaaagaguucuuccauuaacucuuaauuuuuagcagcuuaauauguauguauguacauacaccaguuauauguguaauuggcagaacaauuccauuccuuuuauuccauaguauggauacacuucccccuuccucuuucagaauuauccuucuuugaagcccagguuugguuuguuuggcuuuucgguuuucuuaaggaaacuugaacauguacaguagagaaacuccuacaacggcucuccuggaccugacccagcuuucacaauuuugcuagucucguucuguugcucaccaccagagggcacuguucuccccacacagaggccaagaucccagugcccuggggaagcuccacuguagggcuuugcaggcagcagaagcugagcagugcagguggaggagcggugggggagcggugcaggcaggcugugagucggagaguggugcgggugggcucugcguagggggggauggcgcagguggggucugcgcgggggagcagugcagaugugugggagcagagcagaugugugggagcagugcagaugugugggagcagagcagaugugugggagcagagcagaugugugggagcagugcaggugggcucugcaugggggggcggugcaggcuggcugugugggaguggugcagaugggcucuggggggcagcggugcaggugggcucugcgaugagaccugucuugcauggcuaacaugacaaggacgugacaaggggcucugggaaccgccccccccccccccccggcugugggcugccaguccagggcccgucuccacugggaaggccuugccuugaaggagguguuuccaaagccacagggaaaaaggcaagggagacccagagaggcugucacuggacucagggucugagagacuuguccgugcuaacaggguguggauugcgguuggccugaccugcaaacaggcacccucccacuccuugcugggccccaaaguccuccgauguaaauaagaaggugggacugaaccaucugugaggucccuuaagcucaagucaucucggauuucagcaauagaaagaaaugacagcugucuggccauauacuaucaagaaacagagcuuggugggaaucggaauggguggccuugggcagggggcugcuuucccugcuggguaaugggcucacggcauuuaggggcagaagggccuguguugugcacaaaccacugcucugacccuccuucccagagucuaguuagggucugccccagcccuaugggacucaaagcuccaagguuaagagcucuuggucagcaucucucgaagagugcaugagccgacauccuccuuuccacggcauuucuacacccugccgugcccaguacucagcagcagccaccacagccucucagcagggcaggaaaugugaggcuguaccccugaccgugaugcaaccaggcuucuaaucaccuacagcagccagcagccagggaccaugaagggagagagccucugaggcugcccgcuccucccccgggucgaggcacugggcuucuaacaucuuuuaauccuacucuuuuuauagaacuccagagaggacaauucuuccuucaguuuuugauguucauguuccaggcuuggcauccuuccccacccauccacacgcucucccucagcaacuguacucugguauggcaucagccacuauccaaaugcugauguccacgaaaugacagcuccagcuccaaccacuuuucgcaguugacaggaauuucggacagcccacggaaauuauccaccuaggacucaaaacucaacuuguacaaaacuaggcccauccuguuaauagcauucugaaucuucucaacuacacaagcagggaaucuuggagucuuucuagaaacucacuuucccuugcuugucaaacucaguggcucaccucaccuccuccuccaccucucaccuggauuccucccuuaccugggcuccugcccccaugcagucucccccaguacaaccucccccgccacuguggauccuucuauuacacaggcugggaagacacacaagaaacugagaagcugcuugucucuggagaggggagcuggggaaagaguugggaggaagggaaauuuucuuugcaaugcauguuuucaauguccccucaugugccuguguauuaccucuucuaauuuuuaaaauaaacauuuaaaaauaaugaaacacagaaaacuucgccuagcuccccacugccuacaggacaguucaaccucuuagcuuggaauccugugaaaaugugacccaaacccgucucauugguuucugcucuccgacaucaccuggcugaauggcacauaaacuccaggcuguucaaaagcacuucugggccaggugcggucgcucaugccuauaaucccagcacuuugggaggcugaggcggauggaucacuugaggucagaaguuugagaccagccuggccaacauggcgaaaccccgucucuacuaaaaauacaaaaauuaccugggcaugguggcacaugccuguagucccagcuacucaggaggcugagacaggagaauugcuggaacccgggaggcggaggcugcagugagccgagaaugcgccacugcacuccagccugggcaagauagagugagacuccaucucaaaaaaaaaaaaaaaucgcuucuggaccucuggaguuuucuacacauuguuuccucuuuauggaaagcuccacccuuugucaaccgcuggaacacauuagugauccuuuagaaccaacucagacaccagauccacuggaagacuucugccucgggugggauucccacgccuccacgugugcagacgcacuggagcaugccuuuacaacaugcuuccacgggaacuugcaaacgugcauuuacgcaccccuucccaacacgguuaugagcuuuuuggggguccgcaccauccuuucuucuuguccccuggaucaauugaaauaucacucauugccauuuaaauuuguguucuuugcuacagacuugaacgcaggcagauagucaccgucuucaggacagugacuuuguuuugcugcaaguccauuaaguuacccaucaccuugacguccuucuguggaggugcugucccgccaggcacucacugugacugcucucuuuacaccgugaguuccauagcagcugcaugccaagauuacuguaaaguccuggcugggguaacaggcaagaaagaauuauccggaugcuccauggcuacagcaaauggaaccuuuccaaaaaugguggaugacagagucccucagccuaaggagaggacacuauugcccgagacucucuugcaaaacagaaaaauucucagauaacguacuucccuugaccuugagugacccagguuuauaggcagagggaggaaaacaaucugaauuaccaccugcuaauaaaaauacugaaucuggcuaggcacagugacuuacaccuguaaucccagcacuuugggaggccaaggcagggggaccaccugaggucaggaguucaagaacagccugacuaauauagugaaaccccaucucuacuaaaaauacaaaaaaauuagccaggcgugguggcaugcuccuauagucccagcuacucgggaugcugagacaggagaauugcuugaauccuggaggcagagguugcagugagccgaugcacuccagccugggcgacagaccaagauuccaucucaaaaauaaaauaaaaauuaaaauuaaaauacugaaucuaugucuacuugauuaaaccaaaauuucuucuccaaggguuccuucaaauuucacgagggcaucuaaugcucaaaaccuccucuuauccagcccauucugggacuaagauuuucuggugaauuccagguccagcagcaccaucccuaccgccauccacuacugcugcgcuguaaaaagagccuuccuacaagagcugacugcaccgcccuccuuguguccuauucuccaugaacuccagcccaaggcgccucccaccacucucugacccaucucucaccaaggaccuugagaccucccgaguggcucaauucaaccaccagcucucaggcuucccgcauauaucccaccaagcagcacuuccagcagcugagcacgcccuccguccuaagcaccuuccucccuuggcuuccggauguucucuugguuuucuccccuuuacuggcuguucuuuaggaugccucuaucuccucaaccuuugaacagcgugcucaaccccuggccucgucccacguuaguucacauacacgaagcucccaggacagagcccggugcccauccaugcuuccuaagcacacgcuggcagcaucgucacuggugaucccaucuaaucucauggguuuaaauccucccauguucuaauggcuucuaaacgaacuccaaaccugaccucuccccugaaugccaaacucuuacaaagaucuacucacuugacauuucuguuuggaugucugacaggcaucucaaauuuaacauacugaaaaccaacuuccugguuaaugacaccccaaaccugccccuuccacauuuucugugucuguucacggcagcuacaucccuccagcugcucuggccaagaacuccugguucaccuuugauuccuuucuuucucacacaucccagucaccccacuagugaguccauaagccaaccgccccucaccaccgcccgccaaccugguccaaaugaccccacaucucacuuggaugacugcagaagcuccccucccccagcacaaccccagcuucugugccugccaccucacucccccuuucuucacuccagcgagacucugucucaaaaaacaaaaacaaaaacaaaacauaauauucagaaugaugauucagggauaaacagaccaucucuaagacauucccagucaacaguggucaaaauuuuuaaaugugagugcuuaaaagaauaacuuucacuugaguuugauguucuuuuaugaagaauaugucucuccuccaaaaugcuagacaguuaugaagcuauuaaagguuucuuuuccuccuuucuuccuaaagaaacuaaaaguaguguuauuggccgggugcaguggcucacaccuguaaucccagcacuuugggaagucaaggcgggugaaucaccugaggucaggaguucaagaccagccuggccaacauggugaaacccuguuucugcuaaaaauacaaaaauuagcuggccgugguggcgcacaucuguaguaugcaggcguuaucugaaaauaaugaauuggacccaagggcucccuuccgccucgaauaaucugugauucuaggauucauuuauucaagaaauauuuauggugcagaaaauacauacagucggcugggugagguggcucaugccuauaaucccagcacuuucggagaccaaggugggcgggucaccugaggucaggaguuugaaaccagccuggccaucauggcaaaaccccgucucuucuaaaaauacaaaaauugggcgugguggcaggcaccuguaaucccagauacucagaaggcugaggcaagagaaucgcuugaaccugggaggcacagguugcagugagccgggaucacaccacuggacucuagccugggcaacagagugaaacuccguuucaaaaaaaaaaaaaagaaagaaagaaaaaagauacacacaguucacacccagaagggcaacugcagcuggcugaccuccucaacaauuccugaaaccaucuccucugcaagccucucaccgccacugccuugguucaggacucggccaccuggaucauugcagacucccccacccacucacacagguggucauguuaucccuagucugacucuguccaguucauccucccuacaguugucggugugacguuccuaaaacacaaacugucacaauccuuaccuuucagauacccagaacuuucauaguaacccaaacucgcuaacauggaauacccuuggcauggcgcacugcagccuggcauacucuccuaagaccucucugacccaugcccugggcaccagcugccccagccaccagugacauuaggcaugagguucucucugcacagaacuugcugccuggaucacguccacagacccuuccagauucaggacaacuuccaaauucaucccuucgggaaugccuaccugccucccuugggauuagccgcuuucuccuguggccuuuugauacggaucucucaucgcccugcuuucuacuuucccccaucgagcugcagacuucuuuaaggcaagggcuaugcuguguggccucaucccuagcacccacagcgggaccggugcucaaaggauagcuggaaaaugacuuaaagagcgagcagucaccaugaugaauaauaucagcaaaucagagggcacaacauucacucuugcuauuugccucucauuuucaccuccgaguuuccaaagcacuugaaaaugaacacuaaaauuaacugccuccuugcuaugugugaauuccucccaaauuucucagcuauuuguccaggcaguguuauauaacugcaggcugaugugguauuaaaggaaucuuguuauauaauucagcccuacucacugcagcucgcuuuuccucuuuaaagaccguaagggagaggagcagggaaccagggccagagggagagagcucugugcacugucgccuggggcugucccucucccccacccucccuggggccuuuucaggauuccuuggugcgguagccacccaggaaggcaucuuccucggcucccagcggcugcuaagcaaagccucccgggccucagggaggaggacgaggcccuuggcauccuccccgagcccgggagcggauguuaaagaucuuguucauucagcucugcuggagcgaagacgguugccaaaccagagugcuuguuuuauuguuuuuuuagaacagcaggacuguuauuacgaguauucagggagagagaauaggaagcgcaaaagagauuccgcagcauccuaaaaauaucaguaacaugagaauugccugcccagcaaggcaaggaucuggaccggugggcgcggcagggcgcuucugagccaccgucuggcugccgugccaccaccgccggcgccccgcuccagggcggcccgggaaggccaggcggggccgcgggcccgaggggagccgggagcccggcgcgcuccgccuagggguguccuuccucggccgcucccagcgcgaucgcccccacgccuggacacagacccggagacggggcagagagggaggaaaccugggggcccaggggcggggaggccggggcagcggggagcacgcaagucggaggcuggaagggggcgcagcgcgaccggcgcccagggcuggggcggggacgcgcggccggugagugggguccccgccgucccccgaggcccugcggcucccacacucaccgcgcuccccgcgaccgcggugggucggagccgggcugggcggcgcggggcgggcuccggggggccccaggccgccgacucggccagcagcucguccagcaggcgcagcgucucgucccugccgucggggggcgccacggggcuggggucgcggccgggcgccuccuccgcggcugcccccgggaccucggccgccgccaccggcacccgccggcgggucccgcccuccagggcugccgcuccgggccccgcggggaggcucucggggcugcgccgccgccucagaguccggcugcuccggcugcugccgcugcccauggcgcgcccgccgccucccggaccgccgagggggcccccaugagggggcgcggccgggggcggggacgcuagggggugcggccggggcgggcugcagggggaggcgcggggcgagguccgggaagcgaccgcggccaggggcuaggguucccgggcgggggucgcggccggaggacgggggugcgagc

SEQ ID NO: 192349 - RNA, 5657 nt, Homo sapiens
uacugugaauauauacuuuuuauuuagucauuuuuguuuacaauugaaacucugggaauucaaaauuaacauccuugcccgugagcuucuuauagacaccagaaaaaguuucaaccuacaagaaaagaaagaauucaucacagaacuuugaaauacacacucagcuuaaaaccuaauaguuucgugaaauugugcccuguauuguuuuucuccucagcaacuaaguacacacaacaugucugcagcagucuucacgaccggggacaagcucuucuccaaugcugugggacagaacuguacaccacugcaccggggaagccaucaggggaccccagcagucacccacaugguuauguccccccaagacacugaucccaucaccacccaccccuaacucaccaagaauauacagccuaacuaaaagaccacagaaagagucuacuuccaaaagguacagagaauuucaaguguucaauucuugaaacaucuccauuuaacaccugacacauaauccaaaggagagcaggcugaagugcggguaaaagaacuaguccugaguuuacuacagucauugcuaugguggcgcauggagacugguuacacuaaaauccacucucacuguggcugaaccuuuccaugauaaaauguugaccuauuaccuuguguuccacauuguucugcugugcuuuguccaaaugaaccuuuaugagccggcugccaucuaguuugacgcggauucucuugcccacaauuucgcuugggaagaccaaguccucaaggauggcaucgugcacagcugucagaguacggcuaaaagaauaguuuaaaagguaagcaaccuagcaacgccugcccucugggcaacuccagagggcaccucuuuaagucaaaaugaaaaugcaaaucccagguuccugaagucaaauuaacacucauuuucaaauaagcuuguuauauuucacguaccaaacuaaagccuuugccuaccuagaauaggguaauagcuuacugauuuauuucaaaagcucagucaauuuuaaauguuacucugggauaaacuacaaacucaccaaggcaaugagugaccaucucuagggaaugugagauuagaggacuuuuauacaucuuuauuuucacuuguauuauuucucaacuaaaucacuacaauaaccuuuaacacucuugcucaucuccaaaaccacccccuuccaaugucaagauaaucuuucuaaagcacggauaugaucacaucauuuacuuagcaucacagaacugccaguggaaucuugcuccucgucugaauaucacuaccaaguucaaaaccuaccuaccugccaccuaacaaaugagaaguuucaauuaauugcaagcuuuuggggcagcuaccauguaccaugagacaucaggaguaagucaagagacgguucuuuguuucagcauuuagggagcugccuuacauaugguuaucugucuacgucucaccccauaguagcuaacaauaacacuauagucuacucauuuggauuuccuaucuggcagcgcccauauacacaguuaacaucuucugguggcucucaauuuuacugccaacaucuuaauaugucacagccacaaagggcaaaagccugaacaaaguccauuucccaaaacccucaucaccuuucagaaagcaaaucaagacaaacggauuauucauugcgacucauuaauuaagcauauucuuacaauacuaggaaagcacccaaauacggaaauuagauuccaaugucaucuacaaucuuuuaaaauggggagcaauggcaccauaacucaaucaucacaaaccacagggacuggagcgcuuuagaggaaaaacccugcuauacccaaaaacuaucaauuucagcauuuaaccugaguuagauaaagauagcucuacugaauagggaaaauaaaucugaaagcaggaagccggauuggaaaagugguagaaucacuaugaccuaccagcuaggcuuagugugaaggcuuucaauguacagacuaggucccacuagaaacacugaagccauugucugagaaaauuuggaaaacagagguuuguacugagggaaacuaaagcuauggauuugagggacaguccucugggacuguucuuauacucauuuccuaacugagguucucagaacugaguuuccaaaacccucuuuaagugucaugauuuaggggaaaaaaauccuaaauucuuaugccacucugccuuuaaaaguuuuucaaaguacuaagccauagaauucaaguucuagaaaagcuggcaccuaccuuuccacauaccacagcucgacacaauaacacauuaccagacucccaacacuguguucuagugguuuucagaacaagaccgaguuaaaaaaaaaacauucuuagcacuacuaguacuagcugcaaucagcaaauuaucccagccuuggaucaguuuccucauccacugagaguaacaauacaaauuaaacauguuagagggcacaggcaacacuaggauuuuuuuuuucuucaacucauccuuagggaagaguccacagggauuuaauaguucacauuuguaaaacaacauacuaaucagagacuaacaaaauaccaaaagaucuaguucaagaagacaacuaccaauauuugaguuuaugccagauaaccuguaagucaaucaaguucauaaaucauuuuccaucagcaucuucaacugcagugauauuuuaaccugugauguuaucaccaaaauccaccuacauuuuuuuaccuccaauccacagcaaaaauaaaaaucaaagauaaauccaagcccaugucaacugugucuagcaugcuauaucacagaauuaaaguaaugauuuccuucucaucauuccuauccugugcacaaauaaucggaggaaaucaucucaucuugugacagcacugaccuaguaggcaaacaauggcuacaugaauacauguauguuuuacaucuagaauucuaaaacguaucaugugcaacuauacaggaaaccaaaugcugcuacucaaaaauucccacuugaacaucuguuuucauaaacuacaacuuaaacaaauuaagaguuguuaauaagagggguacacacauuucugaaacuacuaaaauacucaccuccugggacgcuuuugcuuauuuuuuguacggcuuuuucgaguuggcuuaggcagaauucuccucuguaagguaaaaauuaucauguaacaaaaugaaaaaagacuuuaaauugacaaaaagcuguaacugccauacugcuuuaaaagcaagaagaauggcaggguaaguucaaaguucgagaaggcuaaacaacuuagacgaacaauugacugagcaaacccuucuauggaguuacuuccugauucuugaauaaaucauucagaauccacagccucuacuaauacgccaguggacaaaaucucccagauacgccuuuccccaugccuaugacccagaauacuacuuuuauuccagaucaauccuggcacuucauuccccauagacuucaguuugcaccaaucccccauccgaacuguaacagguuucuucuuuuuuugagauggagucucgcucugucgcccaggcugaaguucaguggcgggaucucggcucacugcaagcuccaccucccggguucacgcgauucuccugccucagccucccgaguagcugggacuacaggcgcccaccaccacgcccagcuaauuuuuuguauuuuuuaguacagacgggguuucaccgugucagccaggauggucucgaucuccugaccucgugauccgccugccucagccucccaaagugcugggauuacaggagugagccacagggcccggccuguaacagguuucuuaguuugaucaucuauguaagcaacccacuagacuuguggaaauuuaaauaugggaaaucauuuucauaacucaaaacacagcagucugucacuuuacagacuucuuguuucgacucuuaauuaaagaacguacuuuaucuuucuuuuuaaaacuuauuuuuucuauuuuuuguagacagggucuuaccauguugcccaggcuggucucuacagugauccacccgccuccaccuccccgugcugggauuacaggccuaagccacggcgcucugccuguacuuuaucuuucuacccaauuggauucauaaaaggauuguuuucaugacuccaacuaccaaugcagucuaaauacaagcaauuuuagcaaaauucacaaacagaaacgugcugcaacaguagaacagauaccugagcgauaaagacgacaugcuucccacugaacuuuuucuccaauucgcguacuagccggacuuggauuuucuggaaagauuucaguugaggaacgggaacaaagauuaugauagcuuuccgaccaccaccaacuucaauuuccuaaagaaaaaaacaaaaauccacuguguuaacugcuucagaaaguaaacguuguggucaaauuagaggauaagaagaccuuaucacuaacaccguagcugcacuacaaacuaauacuaguuuugaguuaaucauaaaugcauccuucggaaauguucucaucucucuccaaccuucacauuuccuuauuccaggaagggagacuguucaggccaggaggccaaucacuaccacuucugcacccccacuugcggcaacuccgggcuaaggguagagagaaucucauccugagcuccccacagcucuuugccguaucuauaacuaaguaagggcaaauaagguccgaaaugggcccaggcccucccuacuccacguuucuccaccgcccgcauguggacagcuuaagccgcaggguaccugcaaccccacuccccgcaccugggcgguaucacucccaaacaacacggccgaaccugaguucagguuaggcggccaggcggcaagucaucaucaaccguaacccagguccaacccucucaggcacugcgcggggagacgcgccgcaaccucccucccagccgagggagcgccagcuuaccuuagcugccguaauauucagcucccugagcugagccuugagguccgaguucaucuccagcuccagaagagccuaagaagcaacgaacagcaggaccgacccugagcgcgcguccgagcaccccgggcccaacacacgcgcggccgccuccccucccgggcggggcgccuccccccaccccagaccccagggaaacccucucaccugggagaugccggacucgaacucguccggcuucucgccauugggcuucacgaucuuggcgcucgaacugaacauggcuuucuccugggagaacugaaggcacagcggucagcguuacgcggcccgggcugcaggcgccgcuggcucgcccucccgcccgcaccccccggccaggccccgcucgccccgcagaagccaucggaaagcacagggcggguaaucggcuguauccccacccugugagcaaggcucgccccuccagggccugacuccaaaaggcguuuuccucaacccaagaagaaaaguucugucggagagcaggccgccaaccuaccuugccgagcgccggcuuaggaagagacccaaaucucgcgagagcacgucaaaauccggcguccgaaggcaagaggcggaaacagcgc

SEQ ID NO: 192350 - RNA, 112633 nt, Homo sapiens
gggcgcagucgggagccggccgugguggcuccgugcguccgagcguccguccgcgccgucggccauggccaagcgcuccaggggccccgggcgccgcugccuguuggcgcucgugcuguucugcgccugggggacgcuggccgugguggcccagaagccgggcgcaggguguccgagccgcugccugugcuuccgcaccaccgugcgcugcaugcaucugcugcuggaggccgugcccgccguggcgccgcagaccuccauccugugagugccgcgggggacgccgggggcgcgggguccggggcuucguggagauccgggagcgcaggggugaucggagguggggggcgcggaggguggagggggcaucgggcgcgcggggggccuggggacuugggacgcagaagggaaccuccgaagggggacguggggggaccugggcgcggggacccgcugggccuuuguucgcccugcgggagacgccgaggggcggaacagagcgcugugcgcgcggccuucguagccgccuuuguucggaacucggaauccccgcaggacugggaaguuguuggagccuccggggcuccccccgcucgccucccgccgcccccucucaugcuccgccggccucccgcuucccccugguucgcggccccuccuccgcucaccuuucccccgcucaggaccccucggucccccuccgcuccccgagcgcggcgcagcccccuccguccucccagcccccuccgccccguuccucguccuguucgcuccccuccuccgcuccucuuccuccuccccuuccuccuccuccuccccuuccuccuccuccuccccuuccuccuccuccucccuuccccuccuccucccccccuuccuucuccucccccagccuccgcccucucccccucccccgccccuuggagcgcagugcccaccccauccccccgcgccggggaagccuccccagaggagccucaguucccgcagccgcggcgcccccgcucccagugcccccgcaucugcccggagcguccucuccugggguguccugggggccccgcgcuucucaggggcuuuuccugcgcccggagcgagccgggcggccgggguucccgagaggggccgcgcgguagucucggggcagcccgggucuagauggagccgggacucagagcggguuucugccucgggcauuucucuucuuucgcuucuaauccacgcgagcguguucgcaguugcgcuauacguuuaaccggaugcguugcguugggguugacacccuguccugcgggccgucccgcgucacggucuccacagcaggaauccccaucccuccgccccgcggcuccagguaccgagaugccgccagaguucgcugcaggccuccuguguucugaagcgagucggauucaacauuuucgggaucugugaacgcgggcugcguuucaggcgccgacucuaauuuaguccuguagcgacuuuucugcaugccaaaaauaguuuucacguuucuuagcugagccagaggacuuuuuggcaccagcaaagagucugcaaaaguuguaaaaaaauugagugaacaauucaggaagugggcggccagugcgccuaccuccgaaacaaagugcugggacagaccacggcucccaggggucgccgaguuugcaggcugcuuccuggaggcccuggggcggggcgggggcccgaguuccucuccuccuccgcagagagaccaaggcuuucuuuccagagcccgugaauggucagcccaggccggacgacucgggggcaucucacucaacagcaguggacuuuuagaauggagccgggugagguuucccugggucuggauaauguaauucuugcugagccaguggaaaaauggcaccucaaagauuuuucccaucuggucaguuucauaaagcuugcgguauguuuugccccggaauauuaauugcuuguugaaaauaacauguuaaaauaagugucguaggacacacaugggguccucugcuccgcuuugcauggugugcucguccacaaacgccucaccgaauuugaaaaaggagcugagaguagacgggugacaucaucguccacucgcacaacacuuccucauaggguacauuugcauccauuucuaucuuaaacuuucagggguuuuugcagucuucagugauacuucgaaaugucgcuguugagucacguugauucugugaggcagguagacugguagcuguuaaguugaucgaaucccuuauagaacuaaacacuuuacuggagaaaugaacauacccauuuucuggcgguggaaacagaagcucugggagagaagcgcagcuccugacgcuauuccuguggccaagaggaggagcguagcgcugguggccagaauggaguccuggcuggaugcauugcagccgcgugauuuuuagcaagucccgugucuccugggagaacgugaggguguagcugugcggaccuaggcacaguggacaggugucaugagcgagcgcuagugagugcagccuggggaggcagggacugagggaagagggagaccuauucugcggggauauccuguugaggggucucugggggcauggucugguaggcuguugcuugagaugacacaguucuacaugauacaugcuacacgugaagcaacauuucauguccacuuucggcuuucucccaggacugugcucucauguauaugugauuauuuucuauuacaauuuuuugguagaaauugggaauauacuauauaugaaaauuuaaaaaaaaaccugccccaaaguuaguuggcucauccaaccaucacaccgucccuuugcuuuuagagacucaccuccaucccagucccccaaaagauuaaaucagagccauuggaaaacaucuuauugcuccuuccccucaaaugcuccaggaguguguuuaagcgggucugauacuggguuguuugauuuguggcuugggggcuuuggaaaacaguggaauaagcccauccaugacucaguuuggaucgaccuuugagcucccucagcugcaagugugaagggagcucuggaauggcaggagcccgcgcccugugcugcucggucggcgguuuggccuugcuguugggucuccugcagagcgccuccccucuggaggccuuacuuaguucagcuguguagaaaugguugguuuuugaauacagaaucauucuguacccaacacaauagaaguucaucacaaugguaguucaaagcuaguauuaaagauaaaguaugccguuguacgccccuuccuuuccuccucucaaccccaggcuuuuuggggaggucacauuugaaacauucuucuucacggucacgccgcuagggugcuggcuggacacacuggagcuaggcccuccacgcccuccuccuguccugccuuccucucuucccuggagccgccacgguugaggcuauggucauggauucaucaaaacuaacauccucaccacaguccaggccgcugcaaagccaugaguugucccaaacugcaguucugugacagaaacccugacauuggaggggucugggcauguggagcuuggggugggcucagggaggucgcauugcagagaaaccacaggcaggcgcauggcagccagggcggggccuccucuccugcagaaucuccagacagcugcuccucauucucaguuuuucucaccaucugcuggguguuaggcccacgccgugugcuggguguugggccacccacagaaaacgagaccggaaucuugcccucauggaauccccaguccaguggggcccccagagagucagggggcuuccugggagugguaagaugaccccaggugugugcaguccuggugggacgggguauggggaaagggcgcacagugcuugggacccugcacucuugguggucuggacugaguggaccagcccaccucccggccuguguucacaugagcagaagguuccaguguugcugcucugugggucuccucccgccugcaggccccccaggcccucugggggcucugggagucuaugggcucauaguccauaggugggaguggguguuugggccuuuuaacugacuuccugugucuaggagacugcgucgccugagugagucacaugggucccgagguucauccuuggagcuucccugaccucccuuggagaacuggcugccuuucggagaggaccucuccuccucacacgcagauagaggucacaggguguuuguugccuggcacucagggagccggcuggcuggugcugcagaggggcccgccugccggggacucccuggcuguccacccucagcacuucccaugcccuccuccuccucugcacccuccugcucccgggaaguucccucacaucugacugcgucuucugggaguacccgcggucccgggacgccaggccucuccuccuuugggcaggagacugcaguggucccgggugugagugggagccuggggccucuccgcccuaugcgggaugugcagaugcgucugcugggacaguccugcaggugcuagugucaguguuugccuuccauagaacagaugaugcucauguuuguuggcacaacagagucaaagacuuuauuauugccacgcaaauacauuugaaaaguaccauagagauacuuaaaacauuuagauguugauaauuuaucuuugcaagguggugggcggaccaaacauuuucucagcgugggagccugggaggcggcugaucuucagagcucucuguguucuguggccagaagaggaaaaucuucaguguucaaaauaagcuuagagagggcccauccccaagacaguguguguugggaccuuuccugggauguccaguuugccauccagggaguaugugagacccuuaggcucucaccaugacuuuaaccuuugaaaacuaguaugugacuacaugagugccacgugucuggaaagugcuuucucuuguuaggaagucagaguaauugagcucuucuauuguuagaucuugccuuccuccucuguguuuuuucauaugucaaggaaauaguuguaaaaagaaagcauauccuucucuaugacucugaauccaggggcagcuccagguucaagcguggcuugauccagggucgacaugcugugauauucuaucguuuucuccccagcgugggugacuuggcuugcuucucuguuguucugacucaguuucccuaguugcugaugauuggcagcuguauaguucccuuccgacagagcuaaguccggugaaaagagaaugcgugacucagugcacaagcagaaguuuggggaauugucuuaacggaccagauggucuguguggcacgccaguuuucaagacguccaugaguggacaggaggccuugccacugggucuggagcgcaugacuaccuuccggggccauggaaggcaucugaucuucccggaacacacuggccagaagcugaugagggccccuuaccugggguaaaacuugggccuuuuuaagcgaaguggguguugcauuguccgggcagcagccuccguggcacagauccaggguucaaaauuaagucuguaaacagaacaaagacagaauuccagucugcagggcagacgucaugaaucucaaagcuggguaagaguuggaagaucaggcugggugugguggcugauggcuguaaucccagcacuuugggaggccaaggcgggcagauugccugagcucgggaguucgaaggccagccugagcuacauggcgaaaccccuucucuaccagaaauacaauuagcugggccugguggugcacaccuguggucacagcuacucgggaggcugaggcaugagaaucgcuugagccugggaggcggagguuguagugagaugggaucaugccacugcacugcagccugggugacagagcgagaccuagucucaaaaaaaaaaaaaaguuugaagaucaacuugcauuaugcugauucccauuggcuuauuaugagauaaauaccuuucugauuggagaauccagguguuuuuccuuugcgcuugacaguaagaagcuaaaauagaugcaaaugcaugcaguccugcccggcccacaucagugcucugggaggggaacucagggcugggaaucgagugaucucucaggaguacagagaucuuccccgcuccuacucagggccuggagcugagaagcuaaugcuggccucuggucuuuagugaccaacacgugagcucucucguacuucccaacgcccagguuuacuaauuauuuuaauagugauaguuccauaugcuuuugggguucagaagaaaaugugauuuauuuaaaaguaccuuuuuugagggaauucaauuuaagagaagaccaacuuuaccauguuugaugcuuaaauagccgaucaggacauuuuauauguuagugguaucucucuaugugggccaguagcuccucaggaucaaggcuggaugguugaauuguuaaacucugccugcugccagaccaccugcaugugacuuagcacacauauguuaguggguggcugcaugcuucuuuugaugcuaaaguaauauaacugguugauagauauuuuucuaaauucauaacacuaguaauuuuuguuuucuuuguuuuaaaguuuauuuugaaaaauaggcauuaaggggggcauggaggcucacaccuguaaucccagcacuuugggaggcugaggugggcagaucaccugaggucaggaguucaagaccagccugcccaacauggcaaaaccccaucucuacuaaaaauacaaaaauuagccgggcgugguggcucacgccuguaguuccagcuaucgggaggcugagguaggagaaucgcuugaaccugggaggcagagguugcagugaguugagaucgugccacugaacuccagcuugggggacagagcaagacuccaucucaaaaaaaaaaagaaaagaauaggcauuauguuuuuccccaucuaauuucucuucagauccaaaaggccacagcaaaauaguaaaucuaaaagaugucucaguggaaugauuacucaugcaauguaaacugaagcugacaaaaacgaacaaaaaccaugaguagacuguccgcuguuucguggguuagauuauccuggcguagauacgagaucagucaucacugcuguguucauugguuucuuuauucuggaggauguugcuuucccuccuguuucaagcuaagaggaugggagacacagaacuccaaggagacuagcccggaggcccgaggugaagaauggcagccguccuccgggcgucugagggccuuggguguucuggugucuuguuuauuccagaucugacugccuccugcgucaucugcccguggaaagcaggguucaugcccugcuccuguccagaugcccugcacgucugagcagcccggagcaccagggcaggguguuuacgggaaagcaggcugcggucagccccacacacucuguccuaccgggcuguuguaugcugagcccugcagagcuuuggaggcuuuaggaggagccuucgggagcaucugucuuuuguucuacaguuaaaucagaaggagaggcuugaccagugacuguuaccugauuugaccuuuguccacaugagauaacaaaacucuuaucagacauaauugacauuuuaaaagggcacauacuuaaaguaggcuugcugaguuuugacauccgccuccaaggugcaaguaauccuccugccuuagccuccuacuuuuagcuacuccugaguagcugggacuauaggcacgugcccccaugccuggauuuuuuuuuuuaaauuucuuuuuaauuuuuuauuuuguggagauggagucuugcuauuugcccaggcuggucuucaacuccuggcuucaagcaguccucccaccuuggccucuugaagcccugggauuacagcugugagccauguggcuggcuuguaaucagugaucuuuuauguuacuauuguaauuguuuugggguauuauaaaccacacccauguaagacuacaaacuuaaucuaaauguuguguguguucugacuguccacugacuggccgucccuccaucucuccucccuuuccaggccuuauucccugagacacagcaguauugaaaucaggccaguugauaacccuacaguggccuuucaguguacuagugaaaggaagaguugcaugucccuuacuuuaaaucaaaagcuauaaaugauuaagcuuagugaggaaggcaugucaaaagcugagauaagucaaaagcuaggucucuugcaucaguuaguuuauggaggaaguuuuagugguuugggaagaagagcaaaccagccacaacauuccacucagccaaaguuugauccagagcaaggcccuaacucucuucauuucuguaaaggcagagaguuaaggaagcugcagaaggaacguuuggagcuagcagagauugguucaugagguuuaaggaaagaagccaacugcauaagauaaaagugcaaggugaagcaucaaaugcugauggagaagcugcagcaaguucuccagaaguucuagcuaguaucagugauuaagguggccacauucaacaacagauuuuuaauguggacaaagcagccuucuaugggaagaagaugccaucuaggacuuccauagcuacagaggagaagucauugccuggcuucaaagcuucaaaggacagggugaacucuugguaggagcuaaugcagcuggugacuuuaaacugaagccagugcucauuuaccauuccccaacccuagggucuuaaggacccugccaaaucuacuguguuucugcucuaccaauggaaaaacaaggccuggaugacagcauauuuguuugccgcaugguucucugaauauuuuaagcucacuguugagaccuacugcucggaaaaaaagauuauuuucaaaauacugcugcucguuuacaaugcaucucgucacccaagagcucugauggagaaugcaaggggauuaauguuguuuucauggcugcuaacacaaaacaucuauucugcagcccaugaauuagggacuaauuuugacuuucaagucuuauuauuuaauaaauucauuccauaauacuguaacugcuauagauagcgauuucucugauuaaacugggcaaagucaacugaaaaccuucuggaaaggagucaucauuuuagacaccauuaagaacauuuuugauucaugggggggucaaaacaucaacauguacaggaguuuagaagaaguugauuccaacccucauggauggcuuugagggguucagagacuucguggagaaagucacagcagaugugguggaaauagcaagagagcuagaauuagaaauggagucugaagauaugagagaauugcugcaacuucaugauaaacuagaacagagggggaguugugucuauggaugagcauaaaaaguggcuucuugagaugaauucuacuccuggugaagaugcugugaacauuguugaaaugacaacacaggaucuagaauauucccuaaaccuaguggauaaagcaguagcaggguuugacucccauuuuuauaggauaggcaaaugugagccuuuauuuuuauuuauuuauuuauugagagauggagucucacucuguugccaggcuggagugcaguggcacaaucuugccucacugcaaccuccgccucccagguucaagugauuuuccugcuucagccucccgaguagcugagauuacagccaugcgccaccaugcccagcuaauuuuuguauuuuuaggagagacgggguuucaccauguuggccagaacagucucagucucuugaccucgugauccgcccgccuuggccucccaaagugcugggauuagaggugugagccaccaugccuggccgauugacuucaauuuugaaagaaguucuacuguggauaaaaagcuaugaaacagcaucgcauacuacagagaaaccuuuugggaaaggaagagccaauagauauggcaaacaucauuguugucuuauuuucagaaauugccgcagcuaccccagccuucagcagccaccacccugauccgucagcagccagcaacauaaaagcaagguucucuaccagccaaaagaagaaaacucucugaaggcucagguguuuuauaaaauuuuuuuagcaauaaaauauuuuuuaaaguauguauauuuuuuagauguaaugcuacugcauaguuaaucagcuauauuauagugaaaauagaacuuuuguauguacugggagaccaaaacauucaugugaauaacuuuuuugcaauuuuuaacuuauuucagugaucugggcccaaaccugaaauauccgagcgguauauuucucucuggccccaaguuuugugauauuguuguccuacauuuuauuuguacauauguuauaaacuccacacuguacuucuguuauuucauuuaagcugucaguuaucuuuuuagagauuuagauaaacagagacauguuuuuauucuuuccagugcugcuuauuccucugcguagguucauauuucaguccuuuuacuucaagagcucuaaaaaaaaugucuuauagugcagcucuauugguaaucgauuccuuuagcuuuuggauguuuaaacagugcuuucuuuaccuugccuuaauuuuugaaugauauuuuccugaguaauauucugaguuggugauuuucucugacacugcuuuuuuuuuuuuuuuuuuugucauuugacacagaaucuugcucuguugcccaggguggaguacaguggcaccaucucggcucacugcagccuccgccucccggguucaagcgauucuccugccucagccuccucaguagcugggauuacaggcgcgcaccgccacaccuggcuaauuuuuguauuuuuaguagaaacgggauuucaccauguuggccaugcuggucucgaacuccugacuacaggugauucacccgccucggccucccaaagugcugggauuauaugcgugagccgcacugcgcccagccgacaccgcuuuaaaaauguccucucacauuguuucccaugaggaaucuacugacacccauaucgugucaguacaacgucuguguguuucuggccgcuuuuaagauuuucuccuuaucccugguguggagcaauuggauuaugauaugccuuggugugguuuucucuguguuuuuugugcuuggguuuuuaaauuuugauuuuaauuuuuuauuuaauuuuauuuuuaaauuuuuggaccuguggguuuacagauuucuucaaauuuggaaaaucuggggguguuucaucuucagauauguuuucuguccccaucuuugucuccucuuuuugaagauuccaguuauacguguauuaggccacagcucucucauccauugcuuaauuuuuuguuacugugccuuuuucucuauguguuucauuuuggguaguuucuauuuuuugucuugaaaguaacaagucuuucuuucucaaugucugauuugcuguuaauucuacauguuuuucaaaucagacauugugauuuucaccucuagaaaaugcggguauuaaaaacaaaccuuccaugacuacuugguguuuugaacuuguggaauaaauacaauuuuaauaaucugcuaacucuaacaucuguggcagcucuggguugguuuuaauugaauaauuuaaucuucucaauagggauuguaauauccuuccuuucaugccauaucauuuuuuaagcagauuccagacaauggaauuucacuuuggugagcacuggauauuuuuguuuucuuauaauuauccuugagcuuuguacuugguacaguuauauggaaacaguuugguucuuuaaggucuugcuuuuaagauguguugggcaggauuggagcagugcuuuacuaaggcucaucguuuucaacaacugaggcaaggcccuuccaugucccauaccaacugccugugaaucaugagguuuucagucuggcugaugagaacggcacugcucacuucuggcccagugugugugugacccugugauccuucuggccccgugugugugugacccugugaucccuacuccauuuggguggcucuuuucuggcugugggcaguuugugcagcucagggcucagcucagugcuggacgcucugcaggccccugggccuuuucucucccuaucccgggagggcucaggcgucccaucucuguccugccaggucugcugccuggccuccccggguucucagcguugucuucucucuuaggcaaugagcuggggccguuuucugcuggcuacaucuguuuuccaucacacggaucagugcuuuguuggcugaugcccaguaacuugaaaacaguugcuucauauauuuugucaguuuuuuugguuuuugguuguuucagacagaagagaaagucuugccccuauaaucccaucuuguucuaaagcagacaucucugaauucuucugcaagcaggugugguaaaauaaauaacaucauaaaauaaugaccacauucacauucccaagcucauauuuaagaaaagaugaaaaugacucaauccugguguucuccaucugucuuuggaaugcuguugccuuagucagggccauucggcuuuaguugguguccugaacaauggcagaaccucagugccuuaaaacagugugaguuccugccccacucacacaaaaccccgugcaaauguucuuggcugggcagcucuucacuggaggcucagcucuaagccuugggauagcugcguguuuugugccugagcucugugggaugugucaggccgaucugucuccauuucgucuguggcugcccacuucuggcagaggcagaggugaguaguugucacaagccaagcuguuuagucuggcuugguaagaacauguuugcucugacauugacccaaggaucccagcugugccccgccugaagcuccaccaucauccaucccuggccucgaagcugucacggaaggggagagaggagguuaugugaaggcucucugcucccaccugcucggagcugaugcgcuguuucugcucccagcgcacuggagagacagcacacgucucaacccagaugcaagggugcugggaugcggaggucagcugccuguccaggaagcccagaugcaagggugcugggaugcggaggucagcugcauguccaggaaguggaaguggaccgugagcuucucaguuuuugccauagcugucccaaaguuuaauagcacacaauuauugcucgcucucuuaaaacuuccucucacuaguucaugugugugugugugugugugugugugugcgcgcgcgcucucaacaguguucuguuggcaaggauggagcagcucugccugcuuaucacuuuucagagaggucugugauguugauauucccuuugcuugcuucuguguucugggacuuacagugauuuuaccaccucccaacccagcuucuaaugugggcuguagcaaguacuaccacagauaguuuuaaaacucucucccuccucuucucacaggaagcauuuuguuaucauuuggggauuaaaggcaguuuguuuaugcaucauggcccagugugauuauugcgcuaaggguagaaugguuucagcgacuggaaccauaggucacagccggauugcuuguaaucuaguugcuuaacugaagacuuuucucuaagggaugggacagauuuggguuugaccucacaugugcccuggguaauuagagaaguaaugggucaccaguggaggcuuagaaggaagccagcaggaaucccuaauucucagccuggaucauuggcuucuggggaccaggagcuggauguuuaagugguuuuacucagauguaaaccaugccuccuccccugccuguggcugggccguccgccauacccugagccugacugcggugcugcccuuuagccaaggagccccggcucuuccuguuuacuuagcgcaauucuaaaguuguguaugaauuuguaagagcuuuggaaaguugccccacugccuucucucccaggaccccucaacugcccaucccuguucaccucuuguagguguggaguuugguugggcacacagagggguauaaucugccaggccuguuugccacaagggcucagcagcuuuuucuccacaagcuguaagcuaagaauuaugaugccugcucuuuuacccacuaauugcaucauccagcuuucuuuuacaacauauuuuuaaaauauuuuuaugcaaguuacacauguucauguuagaaaaauuuaaaaauaaacaggaacaaagugaaacaaauuacucacauugcugucauucaggagaaacauuagcugggcuuuguucucagaugcacacacacagaagcauucaggcguguguaguacguagcaguauuugucuaccuguuaauauuuaucugucauguaucuauuuucaaaaauugggucaugauacauguucugcucuauaaugcacuuuguaugguuuuaaaaucugggaauauauuaugauugugugucuguucaauaauuagaggccuccaucaucauuguuaaugaccacacaguauuuguuugaaaugaccaaaucugccuaacagaauuuuuauuaugggucauuucuuuguuucuacuuuucugcuccugcaaacaauauuuccaaaaugugauugcaugcauuuuugugugugucugucuagauuguuuuuacggcacauuucuagagaaaucuuuuuuuaaaaaaaauuucaguagauuuuuggggaacaggugguguuugguuacaugaauaaguucuucaguggugaauccugagauuugggugcacccaucacccgagugguguacacuguauccaacguguagacuuuuaucccucaccccccucccccacccugcuguaggaacauucugggagguuuugaucugcaccagggauggugguuggccuacggugggcuuucccuguuguguuuucuuccuggccccuguucauauuauccugcggauggauguucucuguagcugagcaguggugacugacuuacuacaggacuaauauagaaugcaccuucguuggggagccuguaaugggucaggagggagggcugaagggagggucaggggcugaaggcaccgucucugaccccgggaugguggaaauacagccuguguaagugcucauguuucuuugcugagugacugcauuuugauucuuacaauuuguuuuuucugcaaaugguuugauuuucgguaugcccugagagccaaaccaucuagcguuugugccugucauguauguuuauuugccagcucugucuuuaucccagguucugacaguucgcaccguguggcuugucugugucuuguuugaucucugccucacagucagcuguucuuaccagacccauagucacaccgggccccgcacugggaggagcucacagagcagccagcccagcgcccugccugcuguuccccggggcggagccugguuagccauggugguccuguucugcagagccccagaaugcugaauaaaagagggcucggccugucucgcuucuagaggacucgcagggcuauaucuguggccacaaaaguuuuuucaaauccuccuguuucgcgugcauuccuguugaaggacacuuuguuucuguacauuguugauucacugacauuguuaacgagcuguggccgggaacacugucccccauuccugaguggagcuucuccaccacaccuguuccucgugagggcagcacagccagaacggcaacacugugcuuuggggccguuuuaaauagcaaaaucaccaacaaaagcacaaaaagugugaaaugcguggcccuaaauagaccuugaaaaagacccuguuuacggcaggagaguggaaacaagagggccguugucagcuuuaccagcucagcuguggaccuggguaucaggugacuccgauuuuuccccauucugcgccuguccgcagauaauggcggaggugcuccaaguacugauuuucgaggugaagucacaaauuuggaaucugcaaauaaugcggagggacuguauucuccggcugguagcuccuagagagaggcucugugcugagggcccagggacccugccagcaggugcccuugccgugugaccgccucaagcgaaaccggccucggaaucugugcugcaggguuuacauuaguuguugagaacaggacaguuggcugggugcaguggcucacgcuuguaaucccagcacuuugggaggcugaggcggauggaucucuugagcucgggauuuagagaccagccugggcaaaauggcgagacccgucucuacaaaaaauacaaaaauuagcugcacauggugguauacgccuguaguccuggcuacucacuuggaggcugaggcaggaggauugcuugagccucggagguuaaggcugcagugagcugugauugcaucacugcacucaagccugggcaauagagccagacccugucucaaagaagagagaacaaaagaaggaacaggacagucuugugcagaauagcacaagacagugaacaguuuagcaguccuuaaccaaucuucuuuaggggagaaaauaucuugccuuucagacuagaucaacucuaaaguuguuauauuuaauuauacuauuaggaagucagaaagaacacgccacguggaggcccugcuggcaggugcuggggauggagaugaacucagcuggcucucggcgauugacucacagggggucuggugggcaggggguuggacuccacugaccuguggugugacacgguggagacuguucuugagagggaugggaaggcugccuaacugagggcugaggaaaaaugcaccugcgugguggagcuggcagcaggugcagggcaugugccagccuugagcugggguccuggucugugcuuuccggaugugcucccuugaggacgugaccgcaccccuugaagccucggcuuccccaucuguagggguccugaggagugaggaaggcugugcgugcaaaccuccuagcgcacagccaagcacaguagcugcucuugcaauggaugcuacuuauuacguuacggcuugcauggaauccugcacauuuaagugcgauaaacugaaauaugaggccaaagaacuuugucugaaggaggggcagccgcugguccaaggcucaggaggagggagcaggagggacuugggauggcugugacggggcgguggcgguucuccggguggagggugggcugugugugcucgcagggcuuggucagcgucagcgguuacuugauaugcugacuuuaguugaagcagauacuuggaugcaaacaggaaauuacaaggaagcagaguguucacugcauuugagaauggcaauuuugucuaaccgaccagaccuauguguuuaagaaacaucugauuuucccuuuugagacaacacuuucugccuuccggggguccaggacaugauccgugagugugcccuucccuucccaaagcccugucuuuauuuuuuaaaaagcaauucucgauuucuaaagugucauacucacauagaucuauguuaagucuuugcuaagaauuacggacaauaaaaacggaaauucaaaagcaaaaauaaauaaacaaguaggacuacauuaaaguaaaagcucuguacagccaaggaaauaaucaacaagaugaaaaggcacccuauagguugggagauaaauauuugcaaacuauuuaucugauaagggguuagcaucuaaaacauguaaggaacucauacagcucaguaaaacaaacaaaaaacaaacaagcuugcuaaaaugggcaaaggacuugaauagacauuuuucuuuuuuauuuuauuauuauuauacuuuaaguuuuaggguacaugugcacaaugugcagguuaguuacauauguauacaugugccaugcuggugugcugcacccauuaacucgucauuuagcauuagguauaucuccuaaagcuaucccucccccccucccccgaccccacaacaguccccagagugugauguuccccuuccuguguccauguguucucauuguuaaauucccaccuaugagugagaauaugcgguguuugguuuuuuguucuugcgauaguuuacugagaaugaugauuuccaauuucauccaugucccuauaaaggacaugaacucaucauuuuuuauggcugcauaguauuccaugguguauaugugccacauuuucuuaauccagucuaucauuguuggacauuuggguugguuccaagacuuugcuauugugaauagugccgcaauaaacauacguguguaugugucuuuauagcagcaugauuuauaguccuuuggguauauacccaguaaugggauggcugggucaaaugguauuucuaguucuagaucccugaggaauggccacacugacuuccacaaggguugaacuaguuuacagucccaccaacgguguaaaaguguuccuauuucuccacauccucuccagcaccuguugcuuccugacuuuuuaaugauugccauucuaacuggugggagaugguaucucauugugguuuugauuugcauuucucugauggccagugaugaugaacauuuuuucauguguuuuuuggcuacauaaaugucuucuuuugagaagugucuguucauuuccuuugcccacuuuuugaugggguuguuuguuuuuuucuuguaaauuuguuugaguucauuguagauucuggauauuagcccuuugucagaagaguaggucgcgaaaauuuucucccauucuguagguugccuguucacucugaugguaguuuguuuugcuaugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaagucuuuaauccaucuugaauuaauuuuuguauaagguguaaggaagggauccaguuucagcuuucuacauauggcuagccaguuuucccagcaccauuuauuaaauagggaauccuuuccccauugcuuguuuuugcuuuugcugccugccucuguucauuccuauauauagaaaauccuaaagauuccauuaaaaacuauuagaacuaauaaauuuaguaaaguugcaggauacaaaaucaacauacaaaagucaguagcauuucuuuaaaccaacagcaaauuauccaaaaagggaaucaagaaaacaaucuguuaugauagcaucaaaaagaauaaaauaauuaggaauaaauuaaccaaggagaugcaauaacugaaugcuaaaaacuauaaaacauugaugggaaaagacugaagaaacaaauggauggagcauuaucuugugcucauggauuagaagacuuaauauuguuuaacuaucuacacaacccaaagugaucuuuacauucaaugcaauucuuguuacaauuccaguagcauucuucacagaaacagaauuaaagcaauccuauaaaauuugcauggaaccacaaaugaccccaaacagccaaagcaaucuuaagaaaggagaacaaaauaugaggcauuacacuuccugauuucaaauuauauuacaaaguuauaauaauuaaaacauuauaguacuggaauaaaaacagacaaauuggccaaacaaacagaauacagagcccagaaaugaacucaggcauagaugaucaacuaacuuucaacaagggugccaagaauacacaaugaggaaagggucgucucuuuguaggagagcagucuguugaauggcagaguggugccgucuugaagcaaaaccaccaugaugaucaauguuugacuccuccauaccaagguguucugcagcaagaucuuuaaacugcagcauagauaaacacucauaaagaugcuuaucuaaccuccucaguggucacaaguuucacaagaaagucugagaugugaccaacucuacauguuuugucaaaagaaccuacuauaaaaaggauauuuucuguguaagucucuauuaaauauugcuuucugaccaaaaaaaaaaaaaaacggaaauucagacuuacuuuaaauaaaauauaaggcugauguugguagagauggaaaaauuuugacuuagcacggauugaaacucuuagauuaauauuuuucuguggggacaaaaauaagacuauaacaacuuucaggcaggaagauuucuucacugagaauuguugugggaaagaaacauggcuuuggagacaaaaugcgacagugucuguguuucagcaguggaaaacaaaggcugcaguuuaucugaaguccuugucauuaaauuuaugcuccuuuuccuagucauagccaagcuuccuuuugggaauaagaugaaacuuguugcauccuggcaugaagcaaauauuucuaaaaaucuauaaccagcagagcaacacuuuuaacuuuuaaaauaucaauuaaagcagauacaguuacucaugauuguaacuuacucaaacgugggauguuuguauuggcauggcaacaggcggcugauguuagucuugaacauuuguuuucuugugcauguuuuuuucauuguauaauuuuccuggaucagugcccaugucacccuauccauucacguuuacccauccauccauaaccccccuuucauccauccauucauccauccauccauccauccauccauuaauccauucauucauccaucuauucauuuauuaguccaucugucuguccauccauaaccaccuauccauuuauccauccauuaauccauccauccauccguucauuaguccauccaucuguccauucauccauaacaacucaaccaucuauucuucuaucuauccauuaauuuacucauucauccaucugcccauuuauuaguucauccaucuguccauucauccauaaccacucauccaucuauuuauccagucauccacccacccauuaauacauucauucaucuauucauucauuaguuuauccaucuuuccauucauccauaaccacacauccauuuauucaucauccaucccuccagcuauccauccauuaaugcauucauucauucaccuuuccauucauuaguccaucuaucuguucauugauucauaaccacucauccaucuauucuuucuuccauucauuaauucauucauccaucuguccauucauccauaacuacucauccauuuuccagucagccauccaucaauguauccauucauuaguccaucuguccauucauccauaaccacucauccaucuauucauccauccauccauuaauccauucauucaucuguccauucauuaguccauccaucuguccauucauccauaaucacccaccuaucuauccauccaugaugcgugcauccauccauccacacauacaucucuccaucuagcuacccacccauucacccauccauccaucccucacuacuggaaucacugugaagugucccacaguggugacagcagcaggcugucaggugcuugugguccagaaggggucaggcugugaggcacaccgugcccugcaacacugugccccuggagccacagcccugucccugcuuccucguaccccccucccauauuuuaagaauaguguuggaagccuagcuagaggguuauagagaaggagauagcuguggaaggagccccaccuguagacgcacaccucuuuucuccuaaguucagaaugcacugauuuuaaaauacaacuuucuuauauuuuuugaggggagguuagagaagccuccuuugcugggaaguuccucagaguucugugucuagcagucuuuuucaacugguuauugagaaaauaaagcuccaaagaaaaugauuugggugaauauguucccaguucuucugaggaucacagccagcuagaaucuggaugcugggauaacccaugcauugcacgcaauggauucugcguugagauucuccuguucucaauuucucaugggagagggacugccaagccaccaggacucugaggacucagugccgagagaggagacugcgucagcaucacaguccuggggugagggaacggccaugcuggcugcugaccggaauaaccugagguaaagugaagacguccacguggagagcuuucaagagggacugcuuuggcuuaauuuuauucuucuuacauguucuauuuuguguccgcucgcucagaaacuuccugauaguucaucuucagcccauccauugucaacaccucucggguucauuauuucucgcuuaacucugucuugugguauuuucucauuuauaaaacugucuuauuuagcacuuuaaaaagcguuuccucauucacucaucagcuuggcuugccuuucucgccuuccuaacaagugauguguaugugggaauuccccuagguuagauccccuuugagucucuuaguaacuauuugguauaaauauuucuugauuccauuuuaugauucauuuccucaguggaggucauuaaagcacagccugauuugaggcuuuuauuuauuuauuuauuuauuuugagacggagucucucucugucucccaggcuggagugcaguggcacugcaagcuccaccuccuggguucacgccauucuccugccucagucucccaaguagcugggacuacaggcgcucgccaccaagcccggcuaauuuuuaguagagacgggguuucacuguguuagccaguauggucuugaucuccugaccucgugauccgcccgccucggccucccaaagugcugggauuacaggcgugagccaccgcacccggccaauuugaggcuuuuagaaaagcaacaagcaaaacucaaucuguuucacuagagccuggagucaguuacuuccugggcuugguuugugaagaggggcuuccugccugcugguuggcugaauccuggaugaaugcccagugggauuaacaugauucauccauuuguuuugcucaacucaaagagcacacugggucuuucugaacaggaaccaccucaauuaacccguaccguuguugaaacuauucccguucaguuguuugaauucugacacuucuaaguuggcuucaucucagcugccugccacauuugcaccuucuaagugaaggagccccauccucagccacgcugccugccugccugugaugcugaauuuuaugucgacuuggcugggccacugcacccagauaugugcugagacauuauucuggauguuucugugaagggguuuuuagaggacaguaacauuuaaaucuggagacuuugaguagagccgacuguccucugugguguggguggaccucguccaguuaguugaaggccuuaacggaauaaaggcugaccuccccggagcaggagggaauuccaccagcagaggcggcuuuuggacuggagcugcagcuaccaugcuuccccggggcuguagcaucaguaagcggccagcaugaggacugcuguccugggucaggcgcccacccagguccaaccagcugcgguccgggaggaccaggucaugugacacacauugcgaacacuggguuggucaggguucuccagagaaauggaaaccacaggauauguguacgugugugugugugugugugugugugugugagagagagagagagagaaagagaugcagagagagagagaaagagaugcagagagaaagagaugcagagagagagaaagagaugcagagagagagaaagagaugcagagagagcuguaucugagaggcaaagguggucggcugccuccccaggcucuggucuggagcagguggugugagaaagcguggagcgaggcacucccugcagacucuggacuugccaagccaccaccaucucagccagcuccuuaaaauacaccucccuucugccucucuucucaccuucaaccccaccucucucucugcaucccucccucucucugugcaucucucucucugcaucccuccccucccucucucucugcaucccucccucucucugcaucccucccucucucugugcaucucucucucucugcaucccucccucccucucucucucucugcaucccucccucucucucucucucucugcaucccucccucccucucucucucucugcaucccucccucucucugcaucccucccucucucugugcaucucucucucucugcaucccucccucccucucucucucucugcauucuucccucccucucucucugcaucccucccucccucucucucugcaucccucccucccucucucucugcaucccucccucccucucucucucucugcaucccucccucucucucucucucucucuacaucccuccccucccucucucucugcaucccucccucucucugugcaucucccucucucugcaucccucccucucucucucucccucucugcaucccucccucccucucucucugaaucucccucccucucucucuuucacacacacacacacacacacacacacacacacacacacaaugcacgcauguacacacauccuguggucuccauuucucuggagaacccugaccaauccaguguucacgaugugugucacaugaccugguccuccuggaccgcagcugguuggaaccgggugggcgccugacccaggacagugguccaugugcuagucacugauggucaggcuuagcccagccagugcugucuccugagaacuugaacuugaaaauguucagggauuaacagcuggccgugggggcugaaacuggaggacuguggugagaauccagagaggcccuggaggccgcuguuagaggcacaggggugcuagggagccaagcaggcaggucggcggggaccggcgaggaguucgaugccuccugcaaggccaguguccccucuuagguuccauguacccucaaggcacacaggcuuugugugguuuauguaaggauucgugcuggggagaggacccugagcaggggcacagacccaggagggccugggacagagccuggcuggguugggugcugccggcugcugccuggggagggccuuucuccaugggguguccucuuaggggauugccaggcuguggcugaggggugaagguggguggcugccuccccuggcucuguucccacacggggagcagguggugugagaagguguggagcaagcccccuuccgaguaacucaggugggaggcauggccgcagggccccaggcuggcucgcucgucuaaggagccaugacugcgccagugcagccagccccuggccccuggcgucucagcucggcugcugugcccgguguuugccuuugcagggaccuugcguggcugucagcguguccugggugugccccucacaugccaucugcgagguauggucuucggggcugggcuuccuccacggccauaagaaccccucuuugggcuggaguuguggcaaguugcugguggcaggugcugggagcugcccgcucugccuugcccugcccuggccauuucuuccucagccuguuuggcuguggcaggccagagcuggagaccaggcucaaccagaggacuggacaucaccagagaaaggaugccuagaaaggccuggagauccagcagccguaaagggaccacacacgcccugcccgcgucaccccguguuugcugcucugugucaccccgugugugcugcccuguggcagguuugggugguagguuaguggaguagguuaaaagaguagguuagggugguaaguuaguggcauagguuaauaaaguagguuugggugguaggucaguggaguaaguuaguagaguagcuucggguaguagguuaauggaguagguuugagugguagguuaguggaguagguuaaaagaguagguuugggugguaaguuagaguagguuaguagaguaaguuuaggugguagguuagugacauacguuaauagaguagguuugggugguaaguuaguagaguagguuaauagaguagcuuugggugguagauuaguggaguagguuugaguuuuagguuaguggaguagguuaguagaguugggugguagguuaguggaauaggugaguagaguagguuugcguaguagguuaguagaguaguuuugggugguagguuaguggaauaggugaguagaguagguuugcguaguagguuaguagaguagcuuuggguggucgguuagcagaguagguuaguagagugguuggguaguugguuaguagaguagcuuuggguggucgguuaguggaguagguuaguagagcagguuuggguaguugguuaguagaauagcuuuggguggucgguuaguggguagggcagguuuggguaguugguuagucgaauagcuuuggguggucgguuaguggguagagcagguuuggguaguugguuaguagaauagcuuuggguggucgguuaguggguagggcagguuuggguaggugguuaguagaauagccuuggguggucgguuaguggguagagcagguuuggguaguugguuagcagaauagcuuuggguggucgcuuagcagaguagguuaguagagcagguuuggguaguugguuaguagaguagcuuuggguggucgguuaguggaguagguuaguaggguagguuaguagaggaugucugugcugcaggucaguagaguaguccaugugguuccaggcucaggaucagcuauuuugugauucugucugcauuauuagaagaccuucuauaaauaaguuucccgcaucaacaauuuggugaccugauucuuuucaucuauuagguaaauuaggugagucuauuguugcaaguuuuucuuuugucaauaggaguuuacaaagauucaggggugugugaagucuuuuccguuuguguguggacccauuguuuccugguugugugguuaccagucaggaaaagcugcugagcccaguugaaucagauagccccgggcgagaggcauuuggacugauccgcagaaccgagaacaaagaggccuugaauaguggacagacagcagcggaaucucuguucccgucagacuuuccaccagccaguuuaggcauuaaucuauuguuaggggaaggccaagaauucaccagccaagcaggcuuuuuuucucaggaguggccucagccaagaggauagugagggagcuuucucauggccagcguuucuagacgucagauuuggggaggccuuagcauuuuaagaucgauggcuguguuacaucagauuugucuucccaucaguauacagaccuuagccaaguuaaaaauggggaguguugagcgcagcagagaucgugcuuaccaaggggcuguugagagugggucagagagcaggguuuuggggacauggggcuggaugggggcaaggcuagugacgccuucuuuuucugccccuguugggcugugugacuuuaggcacagggacccacuuaucugaaccuguccauguggugugaaaugaaggaguggaacugggcuuccuuucaucauuuuccagccccucauguuuguccuuggggucaaacaggugugucuggagcgguuaccccuguacugauggagaaggggcugggagggcgugagagguaccaccagggcauaaggccccagacaggaccucacugugggccccaccacgugauugcaggugcccgucucuuuccgaggaggaugcugcacacugggccuccaugccaaccccuugccccagguagagggugucccugugcccagccugcccgccaccucccacgcuaguccuccuuaaccaccagcuucccacuguacaccucuuauauccaguccuugccgcaguccugggaggcaggcgauguugccacccugguuuuuuuuuuuuuuuuuuuuuuuuuuuuuuccugagauggagucucacucuguugcccaggcuggagugcaguggcauggucucggcucaccgcaaccuccaccucccggguucaagugauucuucugccucagccucccaaguagcugggauuacagguauguaccaccaugcccagcuaauuuuuguauuuuuauaagagaugggguuucaccauauuggucaggcugguuucaaacuccugaccucaggugauccacccuccucagccugccaaagugcugggauuacaggcaucagccacugugcccggcccaccacccugguuuuauagauacguacacugaggcucagagaggcccaggcaucuguccaggaagccacagccagucagguggcacagguggacucuaccccaggccugccuguugccuugucuuuggccaacacuccaccaccugccgucaaauuagaaaagaccaacacuugcuuggagcagcugggugagggcuauauuguuugccuggaaaaaacuaugucugugucauacgcacacauugggcagcugggugagggcuguauuguuugcuggaaaaaacuaugucugugucauacgcacacauuuugguuuucccgggcaaguaccuuaacccugaguauggaagauauucauccugcagagguugggcugggcagggaggugaggccuuuccaugaguuaccugccgcucuggucucugugcucagagccuggaaagugguccacucugcauuucccuggcuguuuccaucugcagcuuguucggcugcugcaagccagggcuggagaccaggcuccaccagagagccagccaaccuguggcugacuugcuguggugcuucugggaugcuggggacgacacccgcccggcaccguggcguguuccuugaguuagaagauacagccccuuauuugcaccuguguccuguuuucauaacaggaaggcguuuacaguuucucagcagaagcugaguugaguucccccuucucuucaucugggauuucauuugcaugauucugcugggaauuggcucccgcuccgucgcuguuuuuguggcuguuucuaauuagacagaugacggccugcaguauuuucccggacauacuuagcgggaaauguggaguuccugcaguuguuucacgugccugguucuuuagcagaugaccgucggcucuuuccccucucaugaccccacuguccuugcccuuaaccccggagcagggucuuucuggggcagaaugaaauggccuuggaagaaguuuucaggaacgcaaaacuggccaaguuuuucugacuggaaggcaggaaaaauacugauuuuauuuuuuaacacccauggaagaaguuuuggauuauuuuucccaaagaguaaacuguauaugcaugaacaaacagauuuguauuguuuauuuguaagccggggauggggggagggggcuuuguauuaauggguggcguguucauaugucgccuaaaaccugaugcucccaaaagauaaaugcuagacauagguuaaucugggacagggugagcaagacagggcgccaggccaggcucccagagccuggagagggacccccuacuuccugugcccuuggccaggggccccaucugacccaggccugguuuguccggcccaagagcuaugcacuuugcauuucuaaaugucugaaaaaaaucaaaagaagaguaaauauuucaugcuguggacauuuuaugaaauuggaauuucagcaccauaaauaaaagcuuaucggagcuuggccacagccaccgggucgccucuucuguggccgcauuccugcugcagagacagaauucaggagcugcaaggccaggaucugcaccucaagcaaagauguccccaccuggccuuucagggaaugcacgcacugggccugcugugggaggggcauuucccugagcguggacccgcggucauugcugggcgaggauugguggugaugaggaagggguuggaaguucuaggaaguguaacuggcagggucccugcucccacaguagccccaucuucuuggcagaggcaagaccugaucuccucucaaaggcaugggagcgagugggccagggugccggaccaucgggggacaggggaaccuucccaagaguggcuccugggguuuuggagggcuugaccugggcugggguugaccccucaacuaccuacgcaagggugcugcgggugugacguguaaauccauaguaaucaagugcagauguaagagcaauaaaugagguaguugaaaaaaacaguauccuggauguggauggguguuguggcggggaagucaccaaaggugacggaugcgcuuucuugaagcuguuuauccgaaggccauuuccaaagccgccagugccaauauuaucguagguugcccaggcugggccauguuucagggugacaugaaacuucacugucccuugagacccacgugccuggcccgcacaggagagccugggagccugugccuuccuggcucugggagcuccuuccugccugcugaggcacucuuaaguucucuucucaugucucuuuuuaagcaauaccaaaaaaauggggucagugaacaccccaggacacuuacggggagaugcagugcucugcagcaggcugcauuggguugccuggcugcccaccucuuaccucucaggggcccggggccucaggugcgccccucagucugugcccccaugcuccggaggcacugcaguggcugcaaggaccaggagcacacgagcauucggggggaccgaggcucccgcccacccgggguccauuuggagguacagccccuaugcggccacccugggcuaugagggagacagccucuggugcuggagcggccaguggggagaggcggcccccagggcucuccugucagaggcaggugccccuucuacuccuccccagccugcagucacccgcaggagucuggaauggguuuuccagguggggauuuugcuuuggacuggaggcaggaagaccucugagccgcagauuuccugggugccuccugucagauccaccugcuucuuuucgcagggauggaagcccggaggccaggcugaguuaccacagcacaaaacuguagcagggagaggcucagccuucuuucuucugugguaauugaucguuggugcagaaaauuagaguugcuuuagaucucgcucugcaaggcucuggggagcgugucugaauccugagggcccugcuugugacgcgagagaggugggaggguggcaggggccuugugcagcggcuuggggacucgggccccaagaucaccaggucuaggaaccaggggccaccugugugacucauucauuuacuuuuaauuaaaggaguauucuuuuuaagaaaaaauauacaacauacuccaaaacggccggacacaguggcucacgccuguagucccagcacuuugggaggccaaggcggguggaucacccgagaucaggaguucgagaccagccuggccaccauggugaaccucaucucuacuaaaaauacaaaaaaucagccaggccugguggcggaugccuguaaucccagcuacuugggaggcugaggcaggagaauugcuugaaccuuggaggcggagguugcagggagccgagauugcaccacugcacuccagccugggcaacaagagcaaaacuccgucuccaaaaaaaaagaaaucuaaaacuaagaauaacgguuucccugcccaagucucauccgaccguuuucauuuuaguucugcugcuggccgcuuuuccaccacaaggccgccaugugugaccuccucuacuucaggccgucccuggggauucgcugcugggaagaagaggaauuuagcaaauuuagauuuccacucuucuccccuuucugccuguuuggaauuuuguugguuaugugaucugacaugaaccaggcuccugacauuucaacuugacccuccaaacaguugucuuccacagucucucuauaggcugauuauaaaaaguugaacccaguaaaacaagguuuacuguuaugauuauuuuaagacaugaugcauuacaaaaaagugaaacaucaccuuaagaagaaaaugauauugucauuaaaucccagagaagccuaauauuuaaauauuaugacugcauuuuuacauuugcugauuaaacucagaaaccuaaaaucguaauaaaaauuauaauguaguucuuccuuucaauuugucaguacuuugauuuacuucccagucuucuuuguaaauagcuuucuguccuaugcuuuuaguauuaucucaguuccuucuuuucugagucuauauuaauuggagagaaaaaauggcuuuuuuuuacccucguugaucuugaucaauauauauuccucaacauuuucauugacaagaauuuuaaaauaauuuacuggaugauuacuugagaguuguguuaaccugacaucuugucuugggaagcugagaugggagccgcugguugagugaagcagagcuuuggaugaggaggaccuccugggucagccuccugccuccugagagagcaguuacaaguccaggccccuauuuauagggagcugagaucuccacagaccugagugaggauuugguucguggcucccaaaugcagugggagcuggcuguuuaggggcgucaucaccaccagagagccuccaccagcacuugccuucccccaguggauccugcagguggcccuccuuuuauucagccuagugguucggcaggugcugguggagagugggugcugguggagugggugcugguggagcgggugcugguggagagugggugcugguggagagugggugcugguggagugggugcugguggagaguggaugcugguggagagugggugcugguggaguggaugcugguggagugggugcugguggagagugggugcugguggagcgggugcugguggagcgggugcugguggagagugggugcugguggagugggugcuaguggagagugggugcugguggagagugggugcuuguggagcgggugcugguagaguggaugcugguggagcgggugcugguggagagugggugcugguggagcgggugcugguggagcgggugcugguggagagugggugcugguggagagugggugcugguggagcgggugcugguagaguggaugcugguggagugggugcugguggagagugggugcugguggagcgggugcugguggagcgggugcugguggagagugggugcugguggagcgggugcugguggagagugggugcugguggagagugggugcugguggagugggugcuaguggagagugggugcugguggagagugggugcuuguggagcgggugcugguagaguggaugcugguggagugggugcugguggagagugggugcugguggagugggugcugguggagcgggugcugguggagaguggguacugguggagcggguguucauagagugggugcugguggagugggugcugguggagagugggugcugguggagcaggugcugguggagagugggugcugguggagugggugcugguggagugggugcugguggagagugggugcugguggagugggugcugguggagugggugcugguggagagugggugcugguggagugggugcugguggagugggugcugguggagagggugcugguggagugggugcugguggagaguggguguucauagagugggugcugguagagcgggugcugguggagaguggguguucauagagugggugcugguggagagugggugcugguggagagugggugcugguggagagggugcuaguggagagggugcugguggagagugggugcugguggaguggguguucguagaguggguccugguggagagugggugcuaguggagagugggugcugguggaaaguggaugcugguggaacgggugcucaucuaacaugugucaccuccaaaggcuucacaccuccuaauaccaccaccgugugcugcugucuccagcugucccccagaaacgcugagcccccagcggccugggucuggguguuuguagauccaugugcuacggucagacuugagcaaguuccugaccuucaggcuugggcaacaccuguauuuauagacguggcccacaccuaccaagugagcagcagacggcagcuguucuucggcgugugucuccuuugacacagcagugccauuucuaggaaccuguuucauaaguauauuaacacgcaucacagaugggauguaccgaaagcuugucauugcagggcuauuuauaauagugcaaaacuggaggaacccagauguucuccucuccgcagcugcgugugcuccucuggugggcuggguggcgggaagggcuuggagacagugugugcuguuugcauugggcagccugggcagccccacaaacaccauggauggggcagcuugaaucacagauuuauuuucucacagugguggaggcuggaagucugagaucaaagaugccagcagaguuggguucuggugagggccucuugcaggucugcagaugauggcaucucucuguguccucacaugguggagaaagagaaacacgcucucuggguugcuuccucuuccuagaaggacacgaaucucaugauggggcuuguucucaggaccucaucuaaagugcguggccuccaaagccuccccuccugauaacaccaccgcgugggggugacagcgggaggaccgaugggagccgccuugccggccuccuggggccgggcaggugcggagugggagcgcagucaggagcgcaucuuguucaauggcccugacuuuggaaccuucagaguguuugagauaaagaaagggaagcuccaagcuggcuccggcugucccuuaggcaugcugcaccccagcccugcugcaccccagccccgcugcaccccagccccgcuguggcuuccguuagagguccuuuccucacccugucuucuguggggccgugcacaguguccauucagcaaacaccacacacccugcccucgucagaucaagcacccgcacucuggggcccucucugacccugcagccauagcuacucccgggccuccuccugagccuuucacugcagcgagcgccguggucaccugcuggugccuggccuccuccucaccgaacagcagugcucgugguccccgcaccuguggucagcauugcccaugaacugcagaugugucgcuaguaccaaugagugagcggcgagcacaggggcugggauauucuuugcaguuccacgggugggaucagagccagggcgcagggaccagacggagccuggcucccguggggaagaccggccaccagcucccucccgcggugaacuggcagccucagcagaucaugccugucaccgugcugucugugaaaucagacaacaccauggucaagggcgcugcaggacuguguuuuggagccagcauucugcaucaucagugacuccuuaaaaaaacuguacuugauaaaaccuguacacguagagagguucuuaacaaacccagccgggcacaccagacuccacgugcucuuggugauuugugucucauacaggaagugaggugauccaaaucgauaccauaaaagauguccccguuucuaugaacugggcgugcccagugcccgugcaacucagaugccugggagaggagguuccgucacaccauggccuggaggugagggcagcucagggagcucucacuguuucuuccuugcggggcgagucggggguucugggugcgugacugcaucagggaccccucuccccuuccucugccaucgugggucagggcggaaccuccccggccucuguuucugccucuguaaaggaggauugagaaucacuugggcuucuuaugacuuuugucauucuagucaggaagaggcuuccugcgaagggcggaggcugacuggguucuugguguuugggugggauugagcaaagcccuucaguccauccacagggggccucaggggcaaacuccaggcccagaccaaagaggagcugcuggaacaugaaagggcgaaccucuuuuaaauccaggagcuuugucggcuaaagcguccugcuggguuguaagaagcauguuucccccucuuaacuaauugcagaacaauggcagggacagagggugcgugaugagaccugggccugcgccagggcacaugccgacagccagcccagccccacgaucucagcuccagcaaggccagcuccaaaacaaacaccagcucccggguuuacuuggcggggaggugggaggauaacuugagaagucccauucauccugcagcuuccaggccugggcgugccccccuuguucucgggacaaagcucauuguuccagcuggagaagagcuccgcugaggauugccugcguuugguuuccguucucucgcuuuguguaacuuuccagugccuuaagaguuccucuuuagcccuuagggugcugacguaagugugguaaaacguagauccuaaaugggcuccucuuaaauggugauucuucuucccuuuagacagucaccggcaugcugcuaggggaaggauaucugcagaucgucgcuuucggcaccuugguacgaaucccuccucugcaccaaguuuuaaugaagaacccagaguguguucauucccugccuugugcagggaaaugucuuccccuuuuuuguccucuucuguguaguuauugcgucuuugacagcugauagccccuccgcagggauuucuuuuguuccauuuuuggaagacuuuuggcaaccucgugcuuccaaaaauuugggugaaaaguguggguugauuauuuacacaaaagucagacauaucacaauuaaaucauaauuucuuucugauuacuucgauuugacaguuugauguucagaaggcguggaugaggcaucugggauugaugagcaaugcagcaugcucucaguuuguauuauuaguggggcaggugaugcuuagagcugauuggugagcacugcagcgugcucucaguuuguauuauuaguggggcaggugauguuuagagcugaucgcugaacacugaagcgugcucucagauuguauuauuaguggggcaggugaugcuuagagcugauuggugagcacugcagcgugcucuuagauuguauaauuaguggggcaggugauguuuagagcugaucgcugaacacugaagcgugcucucagauuguauuauuaguggggcaggugaugcuuagagcugauuggugagcacugcagcgugcucuuagauuguauaauuaguggggcaggugauguuuagagcugaucgcugaacacugaagcaugcucucagauuguauuauuaguggggcaggugaugcuuagagcugauuggugaacagugaagcgugcucucggauuguauuauuaguggggcaggugaugcuuagagcugauuggugaacagugaagcgugcucucggauuguauuauuaguggggcaggugaugcuuagagcugauuggugaacagugaagcgugcucucggauuguauuauuaguggggcaggcgaugcuuagagcugauuggugaucacugaagugugcucucggauuguauuauuaguggggcaggugaugcuuagagcugauuggugaacacugcagcgugcucucagguuguauuauuaguggggcaggcgaugcuuagagcugauuggugaacacugaagcaugcucucagauuguauuauuaguggggcaggcgaugcuuagagcugauuggugaacacugaagcgugcucucagauuguauuauuaguggggcaggugauguuuagagcugauuggugaacacugaagcgugcucucagauuguauuauuaguggggcaggugaugcuuagagcugauuggugaacacugcagcgugcucucagguuguauuauuaguggggcaggugacuggcuucuggcaaugccagcaggauguaagauucuguggcuugcagugagaccguguccgauuugugacuuaaacaguuguuacugcacuugcucccuggaggacuugauaucacauggaggcaggacugugacccagugaauaccaggcugccagugggacagggaagccccacccucccagauagaucuuuaggugcuggacagaccagcucccaauuucauagaauaacccgggagcuccuaacucucacugaaggucagagacgcugggacggucucuggguuugagagcccaggaaucggagggcaggguagaacuugaaucuggcauccagucggauccaaguucucgcucugacugaggucuggagacccugaagaagcuggaucagagaagccaguagccuugacgguguccaagccacauggaugccugagcggcagggccuggagugccugggggaggccguaauggacggagaacugcuccuuguagccccacacuccacgcgggaaacucuccaaaagggcuggugacacuccacgcgucccaggucgugggcagccgugcccugcacccugcgucccaggucauaggcagccgcaccugcaucccaggucguggggagcugcacccugcauccugugucccaggucaugggcagccgcaccugcaucccagguuguggggagcugcacccugcacccugcaucccaggucacggggagcugcacccugcacucugcacccugcgucccaggucacagggagcugcacccugcacccugcgucccaggucguggggagccgcacccugcacccugcguuccaggucauggggagcugcauccugcacucugcgucccaggucgugggcagcugcacucuguacccugcaucccaggucguggggagccgcacccugcacccugugucccaggucgugggcagcugcacccugcaucccaggucauggggagcugcauccugcacccugugucccaggucauggggagcugcacccugcacccugcaucccaggucguggggagccgcacccugcaucugggcucauggggaguggcacauggcugccuccuacauucaccccucccaaccccagccuucauggagggagugucuucagugggucauguggguuugggagugaacugagccggucugccucucccucaggggaggcccagggccccugggaugugugcagacaugcucugcucucacggcuccggggaggcccagggcacugggaugugugcagacgugcccucugcucucacggcucucacgugaugggcagugccgggcgacaucaggguugagcucuuaguacuguugucuuuuuuucuguaacuucaguuaauuuuuaguugguuacuaacuagcucgugugugcauccucucauuacauccucagaauacacugacggaugaugcaucaucugcucuuauuaaugucaugugauaaugguugcuccccaagacuuguaugaaaagaaaguaagucuugggacccccaaaucacuaaguuaaagggaagagucaagcugggaacugcucaaggcaaagcugccucccauuguauucaaagccacccucugcucaccgagacaugcauaucugacugcaucccuuggaaaagaucaucagaaacucaagacagugcagccauuugucucuuaucuaccugugaccuggaagcucccuccccucuuggaguugcccccccuucaccuggagcugcccccccuucaccuggaguugucccccccuuuaccuggagcugccccccuucaccuggagcuguccccccuucaccuggaguugcccucccuucaccuggaguugccccccuucaccuggaguugucccccaccuucaccuggaguugcccuccuucaccuggaguugccccccccuucaccuggaguugccccccuucaccuggaguuguccccuaccuucaccuggaguugcccuccuucaccuggaguugccccccccuucaccuggaguugcccccccuucaccuggaguugucccucuuucaccuggaguugucccccgcuucaccuggaguuguccuuccuucaccuggagcugucccccgcuucaccuggagcugucccccccuucaccuggaguugccccccuucaccuggaguugcccucccuucaccuggaguugucccccaccuucaccuggaguugcccuccuucaccuggaguugcccccccuucaccuggaguugccccccuucaccuggagcuguccccccuucaccuggaguugcccucccuucaccuggaguugccccccuucaccuggaguugcccucccuucaccuggaguugccccccuucaccuggaguuguccccuaccuucaccuggaguugcccccccuucaccuggaguuguccccuaccuucaccuggaguugcccucccuucaccuggaguugucccccaccuucaccuggaguugcccuccuucaccuggaguugcccccccuucaccuggaguugccccccuucaccuggagcuguccccccuucaccuggaguugcccucccuucaccuggaguugccccccuucaccuggaguugcccucccuucaccuggaguugccccccuucaccuggaguugccccccccuucaccuggaguugcccccccuucaccuggagcugucccccgcuucaccuggagcugucccccccuucaccuggaguugccccccuucaccuggaguugcccucccuucaccuggaguugcccucccuucaccuggaguugcccccccuucaccuggaguugucccccaccuucaccuggagcugcccccccuucaccuggagcuguccccccuucaccuggaguuguccccccuucaccuggaguugcccccccuucaccuggaguugucucuccuucaccgggaguugucccccgcuucaccuggaguugucccuccuucaccuggaguugucccuccuucaccuggagcugucccccacuucaccuggagcugucccccccuucaccuggaguugcccucccuucaccuggaguugccccccuucaccuggaguuguccccuaccuucaccuggaguugcccccuaccuucaccuggaguugcccccccuucaccaggaguugccccccccuucaccuggaguugucccucuuucaccuggaguugucccccgcuucaccuggaguugucccuccuucaccuggagcuguccccccuucaccuggagcuguccccccuucaccuggaguuguccccccuucaccuggaguugccccccuucaccuggagcugcccucccuucaccuggagcugcccccccuucaccuggagcuguccccccuucaccuggaguugucccccccuucaccuggaguugucccgccuuucuagacugaacuaaauucaucuuacauauauugauugaugucucgugccucccuaaaauguauaaaaccaagcacuuugagaggccgaggugcguggaucaccugaggucaggaguucgagaccagcuuggccaacucggugaaaccucaucucuaaaaauacaaaaaauuagcugggcguaguggcgggugccuguagucccagcuacucgggaggcugaggcaggagaauugcuugaaccugggagacggagguugcagugaaccgagaucacgccagugcacuccagccugggcgacagagcgagacucugucucaaaacaaaacaaaaccaaaagaaaacaaaaaaaacaagcugugcccugaagacuuuggacauuugucgucgggaccuccugaggcugugucaugggcauguccucgaccuuggcaaaacaaacuuucuaaauuggccgagaccugucugagauauuugggguucacacaugucacugggguggcaucugugacaugugggagagucagccucugucuccucuucucucuuagagcagcuccuugccccguccaugcagcccugguggggccugccccaggcugaggcuauucccugcguccuggaggaagccucggugacaggggacacugugccgggguuggggggguggcaccuggcagggggagaggaugggcaggaccccaauucccguugccuggaagccaagauagaucuucacuccacucaagccuccucugcuccuucugccuucagguauuugcgauacuccaggaucccacaagaaaugacccucacagccaaaggauugaggccagguuucuuuagcugagggccaggcagguccugacuaacguaauuugaucucauuaaugguauuagugggcguguuaugucuuacuccguucaggcgucucugaggagccauaggcggggcagccuguaaacacagcagcaguuaccaauucaccccugcagcucuggaggcuggaaguccaagaucaagcaccagccaauugggugucugcugagggccacccggguucagagaagggaccuucuccucguguccucucacauuguggacaggacaagaccgcugucgggguucuuucauaagggcagucaucccacccugggggcaccaccgccauagccuccucaccucccagaggccccaccucccaacaccaucccuuggggauuaggucuuagcacaaauuugacggggugcgaacgcucagucugcagccgugggggcucagggagccaugagcacuaccacuggacccaggcagcuggacaccccugaccccauccugcgucccccaccccauuccgcaccucccaccuugagcccgcuucucugcggcuccccuucacccgcaggggaaguaaggggcauccugagguuucccaccucagugguccuacccacucuuccuccaaaauacacccuugcccuccacucugggcacccauuucuccugcgacugccggugugcaggcuugaaacucguccgugcccuucaugucacuguggccgccugcacgaguggcucaggucacauauguuaaguacagaagcgaguacauuaugaaguccuaauccuucacagacuucagugggccacgugagacuuccugacauucaccccaagugcauggauguacucaccccugugguaaagcacugccaucugugacucucggaacacaagcucugaguguugcuucagugaugaaaggcaguccuuaguaggaagcacugaagcgauuuuaggucaggcaaauguuaauggaaaaccacauggccuggcuuugggaugcagcuuuucaaacucccccagccucccacuuucagcaagacugggacggggagauaggacucagccucccgccuuucccagcggggccaggugguggcuucuguccuguauucauccugggagagggcguguggcaucgguuauaauuccaaccuuuaaaaucaguaaagcacuuugcauauuugccucucugaagcagcacagucuaagagccuuuggguuauauugauuuuuuguuguuguugagacagagucucgcugugucgcccagacuggaguguaguggcuccaucucagcucacugcaaccucugccuuccggguucaagugauucucccaccucagccuccugaguaacugggauuacaggugugcgccaccacgccuggcuaauuuuuuguauuuuuaguagagacaggguuucaccauguuggccaagcuggucucgaacuccugaccucaagugauccacccaccuccgccucccacugugccuggccuugguuguguugcuguauccuguguguucucacugcugagcaacacgaaugacaaagaaccacaacaucaucgccgugauuuacuucaggaaggcacauucgaguugaaauccuguaccuuaaugaggagcuuaaaaugauauuucugccauuagcuucaagauaauuuuuaacaucgugacccaaaugugaucaaaaaucuuagguaacauguuaagaugcgcaaaauacucaaagaaaaaaaaaauccagacaauggcuggaugugguggcucaugccaguaauccuagcacuuugggagccugaggcggguagaucaccugaggucaggaguuggagaccagccuggccaacaaggcgaaaccccgucucuacuaaaaauacaaaaauuagcugggcgcaguggcaugcgccuguaaucccagcuacuugggaggcugaggcaggagaauugcuugaacccgggaggcggugguugcagugaccugagaucgcgccacuccacuccagccugggugauagagugagacucugugucaaaaaaaaauaaauaaaaauacaaaucuagacaacaaagauaaagucauaauaaaaauauauugagaaaaagacaauucaccucugcaaugcauagcuuguggggaauauuugcagguaaccccuggcucuuauuaguuagaaacauaggccuaucuuacaugacuagugcaagaagaaacaaaaggcaagaguucccaucacaucaugagaguaacuucuuacauuucaaugcucucaccugaaauuuucauuccauaauugagauaauuuucguucucgaaccgaacgauauaguguauaacuuugaauuuguuggcaaauuggcaaacucuuauuuauuuuuguuuguuuguuuguuuguuuuggugagacagaguuucgcucuuguugcccaggcuggagugcaauggugcuaccuuggcucacugcaaccuccaccuccuggguucaagggauucuccugccucaaccucccgaguagcugggauuacaggcacccaccaccacgcccagcuaauuuuuuguauuuuuaauagaaacgggguuucaccauguuggcuagucuggucuugaauuccugaccucaggugauccgccggccucggccucccaaagugcugggauuacaggcaugagccacugugccuggccaaauucuuaauuuucuauauuuaaaaaugaauucaaacacaucugagacuugcguaugggaaaagucaagauuguuuuauuuuaaaaaucaguauuauggaagguauuagaauaaacuuuauaacauaaucuuuagugaccgcuuuuuagaauucauaacuuuggcaugauuaaauuaagcauuaccaaguggucugugcauuuuaguuuacugugaaagggaaucuaauggcaaaagucccuggagggaauuagauuaaaacuuggaucuccaagcuuccuuuuaguucuaaccuucaacuauucugugguucugcagugacuugugauuuugauauugaguguaaaccuguacuuugauguuucguuccaaacacuacaauucuugacauuuuuuuuuucugguaggauuuuuaguacauuaagauuugagaauaauggaaacauuacagcaaaacaaaaggaaacacaaaaacuacccuaaaacuccuugacuugaaguucacuugcuuuuuaaauguaaaauguaaaugaaucuguguucuguuuuugagacuguaaauugaaaaauucauaguucaugcuuaauaguuauugcagucuucucuuugaacuugagagggcuuguguuggcgucgacguucccuaaguaggucagaggcagcggcucugcucuaacacuugggagaacucuugaauguaaguggaagagucuggugaauucuaccagggaggauuaaccucuugaaaugccuucaaugagagcaauuuuaaugcugagaaaagagcccugggccgacucuaauugcauuucuaguucugccacuuacagacugacugacuuuagacaaauuaccugaucuuucuuaguuucuaaauuccgauuuguccaggaaagggauuucuucuaaccuggaucucauucucuccucccuucccucagucagccaccuucaugugcugugccuuagugugcucgaccauuuccccaggacgugccuuuguuacucugaaguagggggugaccuugcccuacaguuaucauuucugggagcucucgaggguucccuguaugcaccgaucuucuccaagugcaggugcugcugccuagcucagagguugccucagauccaugcuuugugugcucagugaaugagcugauaagacccacuggaauugcaggggauguucacaauggauauuuacagaguuuugcuguuuaugaaggacuuuucacacacaaacuugucguccuucugugaccuuguucaccgcugcuuacugucauuggugcuuuaugguuuagggccccaggcuuuagaagggaugcaccccucacgcuuacccaggcagggguguggcguuuuuaucgcagucuccuggggcuuuggccuuggcuucagcaagaguucauggaugcccugccugauguuagcccucaguguucaucuguguuccacuugcuuuaguaaucacgccacuuauagguuucccagaacuuucuacaaucugucuccaugcucaucaugccaacuuacuucauagagggcgugccagagccccuugcuuguugggagaaggguccugcagcugcggagggcaggugacccagugguccacucauuggcauguggcacacagcuaggaccacgccgccacaucugccagggucccucuccaguacccucagcccccuggggagacgucacugcaggaggacggggugggagcacggagccccagggaagagccaaggaaggcuuguugaagugcucuuucaaucuuuaaaauuugggggaaguuuuuccccccccguuaggauuauuuguggaacuauuuauuaugauuguuaaaauaauaauucuguuugucaagcuguugagucauauguaggugcauaaugcagggaucaaaugccuccccacagucuuauucugcccagacaugugcaaagcuuauuuuaaaaauuguaaaguggggagcacuuacauguggcacuuaaauuuaaguacuuuuuaauuggagaguuuagcuuuacauuuauuguaagcuuuaugucaaugaugaccaguaagcuaaggaucagacguggaaaugcagaggaaacaagcaaaugccugcuacuaguguuuaugaguucgccugugugugcaaaugcuuuuccuauaucuccucacacgcacacuuaaaaauauacauaguguguauuugcguuauaucuucagcauucccgaagaacaaugacuuccaaacuuuaccuugcuuagaaucaccuggaaaucuuauuugaacccacguuacugggaaccacucccagaguuucugauucuggagauuugggguggggcccagaauuugcuuuucuaacaggcucccaagcacuggugcuguggaacagaccccuccugagcucucuagaaucucgcaagugagaaaugauucaggcaaaaaucagcccuuguauuugucuucgugaccuugaaguugggguucauauuugaaacgaacguuggcuucuugugucuguggugucuucuugcccugagcuugucucucagggauggagccacaagaaccuggacccucugcccuuucuguugcucuggagcaggaggguuucugaggcagcugcaaguccccuccaguaacacgugugcagauguagcuguguuguaagucagcccaucccaaacacacgguccgguuuggugacaaucuuucuagcuccuuucaugugcugugguaucagacagaaaauguaaacacacacacaugcagaugaauaugugugguauaacuauugguguaugaguguuucuucaucucuguuccucagauuagaucauuucuaauguugaguagcucccaaguccucuccccucugcaguauucaauauguuaaguccaugcaaugagcuuuucauuucagcuauuauauuuuucaguucuagaauuucaguuugguucuuuuuuuaugguuucacuuugucuucuaagauaacccccuuugcaguaaaggggaccguuuguuuuacccucuucauaguagaagucuuuuuuggugcucugccuuagagcauggugggaggucuaacugcugugagcagcuugugaaaugauccccuuaaccuagaccagugccauccacagaaaugugaugagaacuacuuaugucauuuaacauuuucuggucacuuugugaaaaaacuagaaauaaacaguuaauuuuaaaaauguuuuauugaacucugcaugccaaacuuguacauguuucagcaugcacucaauauaaaauuuuaucgaagauauauuuauguucuauuuguuuguaggaaguccuugagguccagugugaguuuugcacuuuuacucaacacuggcuaccucucagguguucagacacagggcacaggggccuguggaugggacagcaccucucuguccaucacucuaggccaccucucaggugcucagacccagggcauaggggcuuguggaugggacagcaccucucuguccagcagggcacaggggccuguggaugggacagcaccucucuguccagcagggcacaggggccugugaaugggacagcaccucucuguccagcagggcacaggggccuguggaugggacagcaccucucuguccagcagggcacaggggccuguggaugggacagcaccucucuguccagcagggcacaggggccuguggaugggacagcaccucucuguccaucacucuaggccaccucucaggugcucagacccagggcauaggggcuuguggaugggacagcaccucucuguccagcagggcacaggggccuguggaugggacagcaccucucuguccagcagggcacaggggccugugaaugggacagcaccucucuguccagcagggcacaggggccugugaaugggacagcaccucucuguccagcagggcacaggggccuguggaugggacagcaccucucuguccagcagggcacaggggccuguggaugggacagcaccucucuguccaucacucuaggccaccucucaggugcucagacccagggcacagggacuuguggaugggacagcaccucucuguccagcagggcacaggggccuguggaugggacagcaccucucuguccuucacucuagagguuuugguggcaccgacuucagaucuggggaaaggccugcaugucaggaaggugguuuuguggcucuuccugcugucuucccaggcuccaggagccaaguccacaucuugcuuuccagcuuccacgcuguugccgcugccuccucuguggcuugcguguggguucccacggggaaugaggagccagaauaaguggggcucacuccauccucugcucuggaggagcagcuugguuucuggaucagauguggucagaguugauuuuugcucuaagcugugaugcguggcucggccuuccgggacagccuuucuuaccuguucaaaugcugggaagccccucagcuugcugugucucagguacgggagcuucuuugcaauuguuuguuuauccugaaauugcagcuggucagaauucucuccuuaucuguacuugaucugugucuuccguauggagugagugggcauccuggauggcugcuuuccccucccgugucuuccuccagcaccgccucccaguuucgaugcuucugacuuucagcagcuccuacguggagaguccguggagccacuagugauauucugaauaugaauguaaauuaaaaucucaucuguuuagaggggagcauggcggugcagggggagggugcgugugaggagacuguugguggacaguggguaucacugaggaaagcgaacccgggugcgagggcacggcguggaaugauggccaggagggccaggugggcagaggggggccgccuuccccuucuccuccaggagaacuugacccacagcacaggggcggcgcugggagggacacauuucauucacugacaucuaggcuggaugcuguugcugucagugacacagauacuuuuuuugaaguaucuuauugaaccaugaacuagaaccaauucuacaaacuacugacagugauuacauuggcauaggauaaucagauuccuuagaagguuauaaacauuuuauguuaucauacccuaauguccugaccuuaccuaugauacccuaaugaccaaacaccugaggcacuggggcugagcauuucaacauguggauuucggggagacacaguucaacccguaccgaucccuacuggacgauauuaaaagagauuggaccuaugauuaaggaauuuaauuuuucuaagaguauuugauaaagaaauuggucuuucuguuuauuuuucagugguuucuauaccuguucaauuuauaguuuuaauucaagcugggaugggcugucugcaaggguagagccgacgccucugcaugucugcacuucccaucgcugccuucaggccucugaccuggcugccugugcugcccccaggcccguggccuccgugguuggggccucccagcuugcucugccugagcaucagauuagcaggaauugaaguguuucucuuuccagcaccagauucagucucugugucgauucuggcguacucucuggucucucaugggcuauucggauccucucuccacccccgaaauaugaauaaauaacugccuuaacaguggacguuuaacuuuacugaaaaugccuguuuggaaccauuaggguaaaacccauaugugagaaagccuauuuucccaguuagcgugcugaauucacuuuugugguuuugaaacauucaguuuaaaucucaugaagguagcaguuuaggucguugacuaaggaagagccuaauuccagcucaggaaaucacuggaguaaacucuaagguguuuacucaguugcacagguggcgugacucucuucuugaaugucaucaaaccuaaccuguguuuauuauccuaagacuuaucgacacgacauuuuccaguggguugccagagauagggugcuuagguaguuuauguaauuuuucuccccauaauuacuguuuuuagaaauucuguaauggguuacugguguuccaccauucagacacauauucauacacuuacuagccucagugaaaaagaagauucauugaaggagugaacugggugguuuaauauuuuaaaugcauugucaccauuuugaaacuaagagcagcaaauguguagcgauguuuguagauuuuuuuucacguaauaauaccuuucuuguuucuucacagagaucuucgcuuuaacagaaucagagagauccaaccuggggcauucaggcggcugaggaacuugaacacauugugaguggaaauauucuauuggaaacuaauagaaaaauagaaaucauuacauuguuuaucuguagguagaacucaucauccacaaucagugggcuuggguggggaaaaguggagcaggaaagugaggcuggaaaaugccccugaaugccaggacugugaaugccaggacuguggccacuguguuucucgucucauggcugugugccugucuguggcauguugauugggacccaugcugaccgcuaagcuugucccuggccuucaugugggucacuugcucuagaaucacucaguccuugcugggucaggcugaccucuguguguuccugcaccuccuccguggcaagauugagcaggacagugcuucuucugaguguggaguggacuuaagugaggguucaaggcagucccaugaugccuggagggagcaggcagggccaaguccagcguugcugugcagaccucaggcucugcaggacacgcccagugcaguggaagcugguucccuucugcaccaggacugagcacaacgguguaagagcagggucauggggacugugggacugucugggccgccuauccacuguugacccuggagggcaaguggcccggggucucucaccccaggcccuugucugugcgcucgaauggagcacgggccacagggcccaccuuuccuggcacgucuguccacccggaccacccucccaccaugacugccuuagcacuggccacaguccuggcuaaaauagaaaaucuaagagacagcaggauaaagauacaaacucccuucuauaggagagaaggaauuuuuucuccgcuguaucaaaagguaguaacuguggagugguacggacaccauugcucagcaacguuuucuucaugaugguuaaacgcgaaagcuguguuuuguccugcggguucagcguucguugaauguugauggcgaggcuguaacugaauugucaaugugaccuuuuccaaggcugucggaauguuuuaacacaacuucgaaguuuguuuucuguuguuuuuuaaaauucuuaucgacucucuuucauaggcuucucaauaauaaucagaucaagaggauaccuaguggagcauuugaagacuuggaaaauuuaaaauaucuguaaguuaaugaucaguucuuuaaccuaaaagcuuaugguaucuagauuacuuaaaaauagagcuaaauuucgugcugcuuaugaauuauuguaaauauauucauuuaaaugagguuuuauuuugagaaggugaguaaacauuuagcugggauuauuaaaauagcuugucagugauauaaagugcuacauuaugugauuuuuaguguuucaucacuaagccuuaguaaaguggauugcauaaaaugaaaaugcacagccucugaaaaucgcucuggaaaugauggugaugcuuccagaggggaaagugaugacccagugaguugccgauaugaacagcugacggguguguugcagaaaucagcuaucaaaauaguuuccggucgccuugccagcugcaggugacauguaaacucgaaauaacuaaccccgguggagugucacuaauuccugcagauuuuccugucucccgcuaagugauuucaccucuuacuuuugugcaguuaaauuuuauuucacuuuuaaaaacugauuuuaaucgauuuauuuucauuuaacauaucuucugcucguugagaucaguuuugcaguuuagaaaaugagcuuccugggaaguacugguuuagucucagucacacacauacuugcuauaaaauuggaaaggugacgaagugugugucgugugcuuuuagaagaguauucuuuuaagacuuagucacuuuccaaagagagcuauuuuuaauaaaaauuauuucagccauuuuuguuggaaauuuuuaucauaugugaaccuaaacauguuuaaguuauuuugauuuuuuuuuauuuuacuuuaaguucugggauaccugugcagaacgugcagguuuguuacauagggguacacgugccauggugcuuugcugcacccaucaacccgucaucuagguuuuacacuccacaugcauuagguauuugugcuaaugcuguaguuauuuugauuuuuaaaacaaagucgucuuguuauuguugauguauacucugaaaucuguuuugauucuagcugugucugugacuguuaauuacagagcuaccuuuaacucuguuuauuaaaauauauucccucugugcgauauuugucaguguuacauacauccuuuuucccuccaucauuguggcauaggauguuaauuuuuaauuucauauaaacaugaugaagccuggucccacauuucuauuucuaaaaugagaggcaggccuuuuauuuguuuauuuacccuuuuuuuuuuuuuuuuuuuuuuugguauuuugaauguugugcaaguuccagaagagggcuuuuguuuccuggaaaguagauccagucagcugauagccagcauuccuuguguguguauauguguguuuaauagguuuaacagguuuuuuaauauuuuauuucauuuuuugucacugguuuugaauuauuaagagcaacuuaguaugcacucagcaaacacguucaaaguggaguuguuggggaugcucuguuuucacugaucucuuuucaauaacccucuuccgaccucaucugcugcacagccggcucugagcgcccacacuccaaacucuucccucucucccucgguaacaaacugcggugucccuggugguggaggacacagaucacugggguggaagaagcacaggccaguggugaaggggccgugggucaugacucagaaacggacuaaagaccagggcaguggagggaagcuguccagagaggcccggggacccuuucacccagcagcugcagccuccgcuucucagcucucauugguggaguacauuugauaagugcugauuuaggaaacugugugagaguuaaaugcugugauuucaccuguguacaaccuauaugcuuaagagcucuccugaaauuuauucauuauuucagccuucuauauugagucaguaccaaacuauacuuguagagguugaguaguucuuauuucuuggaacuccaauuacuucuaguaaggcauaagccuucccuuuaguucacauugcuuaaugaaauuauuucuugagacaguuaggacucauucaagggucaacucuaugaugaaguagaaaaucacaauuuauuauuauggucaauacucacccuuuuuuuuuuuuuuugagguggaguuucccucuuguugcccaggcuagagugcgguggugugaucucggcuuacugcaacauccaccucccagguucaaaggauucuccugccuuagccuccugaauagcugggauuacaggcgugcaccacgaugccuggcuaauuuuuuguauuuuuaauagagacggaguuucaccauuuuggucaggcugaucucaaacuccugaccucaagugauccacccaccuuggccucccaaagugcugagauuacaggcaugagccaccacggccagccaauacucaccuauucucaugaaaacaaauuacguuccaaugucuuuauaaacacacauucacacauguuaguuugauucaguuguccuguguauucuuuaaaaagauucccuuucauuuuuuaaaaugggucuaaagcgauguucucauugauacuuuguuuuuguuuuucuuuuuaaauaaaugggcacagaaaauuacauuuaaacuugccuucuguagaaguauaguaacaacucccaugugaacaaugguuaaugugugcaggggccauauuguaagagcuuuauauauauacacacacauuaauuucaacaacuucuguccauuuuagagaagaggaaacugaggcccagucauuacguggaaguucaaggauucccacguaugcggccuagagaaguaacagccuugccaggccucugcugcgggcacugggcucucggucgcuggggaguucugggugguucguguuaaggcuuguaacucuuuaugaggucagcucugcaaauucgcagggagggaggacgugagagccacuuagauggguuguaagaaauaagguuagcagggcugguccuguuaaacuggauccugcaccagacauuauuaauuaaguuacaaucaaacacucggcccuucuggauaugaauuauauaauauuauaagcauuaagacaaaaaauguugguuauuuaguggaacgaguaggugaaacccaggcauaaguaaucaauuuugaagagacgugucugccugaauuugaaaaguaggaaaagcguggauuuugacuugcccaucugccuaugucagagauggagcccagggauucuaagaaacgguaguggcagggcuccccaugucugggcacagacacagauucacagccuucuuggggucccccaagcugcuggccuagagcuguguugugaggcaagcuggcugaaggcgagucauguccgagaugggugggcacaaugcgcaugguuuuguggcucuuuuuggaauugugauacuuugguguggaaauuuucauccuccaucaggcuuggcaaguguuuucugugcaggaccaguccucugugagcugcgcagucucuacugggaccacucagcucggccacacagcgccagcgcagccccagauggugcggagugagcgagugugggcguguuccagcagagcuucauuuauggacgcuggcauuccaaguucacauguuaggaaauaggauucuccuauugagauuuuccaccauuuuacacaaagacaagagccaggccaauuguguggcucuuccaguaugccucuguugcuucuguuuucuaagaaugggauucuaggggugaguuauucaaggugcauucggucuucauauuguccacuccccaaauuauuucuagguauuuuggagauguaucaguaucaguuauagaaucuuacagccaaugcauuauacaugccuguggaaaaugguuuuuaucuucuucaggcuuugaagcaaauguauugucagcaauucauuagccauagucuaaggucugugaguugccugaaaaacccgucgcagugguuugaucaccuucaguuggcaccgguugcuuuuagcccccuugagaucugagggaagggaagcccuugggagaggcacuguacucaccgugcagaugguuuguuugcauucuaauacagucauuaauuguaaaacugucuccaugugucaauuuaauucuucuuuuccgucugaaguuugaccuccugucugugugcuaaugcuccccaauguuucuuguuucagcuaucuguacaagaaugagauccagucaauugacaggcaagcauuuaagggacuugccucucuagagcaacuguaagugccccuucucuucgugcuuuaguucuuggaugccgucuggcuguuuuccucuuguagggaccaguggagugagcuagcuguuugcaugaugcaugacuaugcuaccugaggugcggggaguacgugcaugaugacggaaaaacagggaugggcgagucauuugcccuccgccccgccuuccacccagccagcccuccacccaccccucaggacguaucccugguuuccuuacggcggcaccaggcccugggccaugcuuuccugacaccaaggacaguaauaucgauggaaucccugucacaacuuagaggagagacaggcaggcgcccaaguccgaucaaggcauccuucacaggggaaauauccagggugcccggggaggagagggcucuuugccucguucacuguuccuccuuaugacugugaacacaugaagcugaauuucuucaauuguggugacauuauuuuggagaaaaccuuucuuucccuuguaguucuaguuaguguaugcagugugucaugaaacgcucuuaguuucuuuggccaacgugaagucguacuuugcugugaagucagcguguugauuuuucauuacaauguccugguaaaaaggaggauuuguccugguuuguuugcucggccagucaccuuucacucggcaaacugagcccauuccugaggagcugcaauuugucacgguuuuaggaauguggaugaaagcagcuguuugcugugacgcagcgugacguccuccugccacagcugcugauccguggucacgggucacuggcucacuggacacagcgauguugucagagaguuugaggccaagcggugcaggggggagaccacucugggauugugcauccugaggacccacggugcucauguuuccgaaaguguguguugauucaagugagcguggacagggcguggguagauuugggaggaggucugucucuacagagaaggacagugcagcucauugcagaaacacauggacguauccagggaacacccagauguagggagagcuugcaaaggagcaaguucucauauccaacaagcguuucacucagugggggcgagcaaaucuucauagcaaacaguucuuccauccugaguggaucggaaaauccucaucuggcuuugugcugggugaguccaguguuauuuuuaaggaaggaaagggcaagucaggggagaaacgaggcugaaugaggaagggcaucugugaaucaccaaguagauguuugcugaaauuuuggaugauggggagggcuucuugagcuggccaggcugccuuuagcacccaggguuaggugagcuggggucucuggugcugcagcuuggguuccauucguuaaacgcuguacagugagccugagggcagcccgagccccgcccucgggcagggagcuguuggggaggggauaagcgaguccaccagaccucagugagagacuugggcaaagggcuguauguccagggaggguggcuugugccugacccuggcgaacugcaccccuuccccggaucggcucuacagcccagagcuauugaaaacaugcauuccuggugacacugggagaccggaaugcaggaaugcccgggagcccggaugcaguccagggggaucugagugucccugauccagaaagaaggcucuuugggaagcuguggacacaggucagaaaacacaccuggccagucaggaaacaugcguuugaauucaaugaugaccucaguauacuuggggagccauuuccugucuuugguccuguuuccucaauuguucagggagggguggaggacaccccaggcugccuggggccccagccucucuaagauccugugcacccugggccgucauuucccguagcaccugugcagcaggugccaagucccacccacucagccgucccccuggccaaccugcauugcagucuggguggagggauuuuuacacccaucgcucuccguggggcuugaaauacccccuuuccuucccucggucaguaccuccucauccuucugggcuuugcuugggggacuccaccccugccugccugcacugaagccucgcugagcagcucacagccacugugccgugguggugccugggucuuacaucgguccccagcugccaugggcugugaaaggccaaggaccccagaaaaccacaggcgcccugucagcacacugccuggcagagacgaggcuccagggauucugucggguucggccuuccucgggacccgcgcgucaggugcccgcccgucaugcucgcccacggcgguuuuccuugucuuccugcuccaguuuuuccuucccucacguuucccauucgugcgcggagugcugagcacagaccugucccggggcaaggggcagggauggucugcguuugggggcccuccggcugcagguguccgcagagacucaguguggccugugugggugcugccuggggagcuggccccgggacggggcgggcccuggcagccgcacucuggugcccugguggugacggugaucucaggauguccacagaccugauucucaggcgugcguucugaggaguccuccuuucuguggaguuaugaagaccugugaacgcuggcaugcugcuucuuugcucauuuuggccuccugaagaaguagucacugaaaaugugugcugguugcaggggacaccugagugggcaggaggggucucccagcagagcaccccagggagaagacugacuuuguguuugacuuaagaggaaaaaacccacuuuucaaaaugagaaauuucguauucaggaaaaauuagaaagaaugaguuauaucaaaagguauaaauuguugaaguaugguaaauggaaagaaauagaaacacuggguauucuguacaaucaacgacacccgaggaaagauggucucuuauuuaaugcuucaggacugauggagaaaguugugugacauucuuuuuguguuuccuuuguggucuugaaggauaucuuuguaucugauaauauacucugugucaaaguauaugaugaugccccugccaaauuuauacacgaguuaaaagauuugagggaagguauucaccuauuuauguaugugcuaucauuaaaguuauccuuuugauuuuugcuuuuuuccauauauuuuggaagugaaaauggccgagucaggccaggccagcacugcccuucucacgcggugucaaggaccucagugagcaccucuaggccucccucgcccuuauccagucacuaggguggacaucugugccuaguguucaguuguauuuauugaaucauuugauaauuuuauguauuguucauacaauguaggaagucuagugagugagcuaucuauugauaucugaauuugaaaugacuaggaaaaaaauuugggcaaaaaucuggaucuaagaaaauaaauuguaaguuauacuuuuuuuucuuuuaacuccucuagauaccugcacuuuaaucagauagaaacuuuggacccagauucguuccagcaucucccgaagcucgagaggcugugaguuguguguuguuccuugccuuuccauucacagagcccaagccucagucacuggcuugguuagauuaaggucaauaucuaccaaacaccugaaaacuguuucaauauaaaauccauauuucuagucuaacaauuuggaaauaggacuuauaauuuucucuuuaauugagaguguugauaaaacaggaaaaaaaaaccauuucuuuuguuuucagauucauuuguauuaaauaaauguaaucacugagauuuuuuuaaagcugauauauauuugacugcuuauauucuuuucuacacauuuuaagaaauauuuuucaaaauugguuuguuauaaaaucucuuucaacagauuuuugcauaacaaccggauuacacauuuaguuccagggacauuuaaucacuuggaaucuaugaagagauugugaguauaaaaccuuuuguguuuucuuugcugcaaagccuucuuucucucuguuaucuauucaccugguucuuuuucaaguauugugaaauguugauaacaaucugauucugaaagaaugagaauauauggaggguggauugaauccauuagagagcaaaaugaaaaacauguggcucagacaauguggcaaguaguuaauccuuugauaggcaauuaagacuuaaaaaaauuuuuuuucagauagggucuugcucuguugcccaggcuggagugcaguggcaugaucacagcucacugcagccucaaccucccgggcucaagcaauucucccaaagagcugaguagcugggacuauaggcacaugccaccaugcccagcuaaguuuuguaauuuuguggguuuuuuuuuuugguuuuucuuucuuuuuuucuuuuuuugugacaggguuuugccauguugcccagguuggucuugauuuccuaagcucaagcgaucuguccaccucagccucccaaagugcugggauuacaggcauaagccaccaugcccagccauuaaagacgauuuaaaucgucuuuaaauucaucaaauuaauuuuuaauuccagcgcauauuuuacugguagaaauaaaaccaguguggaaagaaccucugugcuauauucugugucuuucuacagcauacuaaggaggcugaucuuuacccuuuuuuuugagacagaguuuuguucuuguugccagucuagagugcaauggcucgauuucagcucacugcaaccucugccucccagguucaagcaauucucgugccucagccucccuaguagcugggauuacaggcgcgugcgaccacgccuggcuaauuuugguauuuuugguagagacaggguuucaccauguuggccaggcuggucuugaacuccugaccucaggugauccgcccuucuugggcucccaaacugcugggauuacaggcgugagccaccgcacccggccuccacccauuuuuuaaggcuuccaaauauacuuuuugcuuauacugagcuauuucuuauaauuaaggcauuuuaggacugguggagaaaguugugacauucauuuuguguuuuccuucauggucuugaaaccguuaguuucgguuagauauuacugaguguauucaguaaacuagaccuagaaagaaacagaaaaugccaagagacaagccuaacuccagaguggucuuaugugauuuguuuuaucucuucagugaaauaaaguggaguaaaacauagaccuucagaacuauaugugauuuuuuuuuuccuuuaggauaaaaauaccacaagccaaacuaaaaacuacauccuggguaggaagaugggaugaauacuuccauauuugauagauaacagagaggagaaagaaaucaccagauaaaugcucuagaaaguagccaagacaaguuuagggcagacugguaacagccuggauuaugcugacagcugccuucucucuguucucagccucucucugggugucuggcaaggucccccucuccuguuugcucacuuuacuaaaguugcucaaacacuacaaccccagauugagauucugugauagauuuacagagcugcaucaagagaacacgcuguguccuggcugcugucugcucggagcagucucuaaccucacaucccugaggggccccaggcggaggaggccacgccagcugccccaccucucuagaccuccugaauagcccucucugcuucagagcagaugaagguuggggguccuaugcuuccuugggugcccugagcagcucgcuccaccaggaccgacuggccagaugccacauaccugacuaugaccaucugggucuugcaugugccugugguccuguacugaccuucagcugugggcacagguugggugcccugggcacguggcugacacugucccccucacagccuccucaccugagagcugugcaccugcucacgggggaaagggugauucuggucgugaggccaguucuguguuccugucgccucugggcucaugucugggagaaccucggaugggagguguagccuccccuuccccuccuggagccagcgucggccccuagagaugcccucacgcugccgcccuggugagcaccucucgggaucccauccccaucucgggggugcccuggggccaccucauugaggguuaauagugagcacgucuguugcaggacuuuucccuaguucagcgaaagaugggguccuuguuacauggccacaaaaauuuaggcucgcagacuauuugaagagugagaaaaaugggauuuauugggcaaaaaggaaaaaaaaaagggaaauagagacccucagcaaagcaagauaguguguuuccugccaugggcuuccugccucacagauugaauuccacccaggaagaggagggccaggcuucuccccgccgcaaauggcacaaaccucugugggcuccaccccagugugcaccccucccagugcacaggccggcuggaggggccuggggaccccuucccaccuggcugucucacauccagcugccagccucuuccaacccuugcccuguagccuguguuugcuaccuggaacuccucugucccccagacaacuucuuccccgugugcggagacaacacuuuucccagggugcaggcacauccugcccguguuccccuuguugggacaggaugugccacucacuagaaacuuuccaggucagcuuggaccucaggaaacuuaggugugaaccccagccaggagaugcagccccccuucccacacugccugggaagccucaggccggagggagaugauguagaacuguccugcccgugaugaugggcguugagugacaguggugguuuuguggcugugguuuucauguuacugauuucugugaguggcucccaccuggucuccuucacaaacuucccugaccugugccgcuggcacacucccucgccuugagcucgacacccgaugccugggugugcacaagcccuaugcuacucacgccucuacgguuagugccuugaggggcacugugcaccccugggcucuuccuggugaugugugugucucgacaucacucccugagucgggcaccggggcucagauuccaccacgagacgugucccauccccaugucgcaagccuggcaggccuggcacauguuucccgacgcgggaccuggaagcccugucugauggauggauggacaagcccagccaccccaugucucaccggcugcaucuuccuucccacaggcgacuggacucaaacacacuucacugcgacugugaaauccugugguuggcggauuugcugaaaaccuacgcggagucggggaacgcgcaggcagcggccaucugugaauaucccagacgcauccagggacgcucaguggcaaccaucaccccggaagagcugaacuguggugaguggcccgacacgcacacaccauccacacacucacaccaucuacacacacaccauccacacacacaccaucuacacacacaacauccacacaccacacacacacauuuacacacacaccauuuauagacacacgcgcagacacaaaccacacacacgcacauacacgcauacaccauccacacacacacauaccauuuacacacacaccauuuacagacacacacguagacacaaaccacacacacgcacauacacacacacaccauccacacacacaccauuuacacacacaccauuuauagacacacacaugcagacacaaaccacacacacgcacauacacacacacaccauccacacacacaccauuuacacacacaccauuuacacacaccauuuauagacacacacaugcagauacaaaccacacacacgcacauacacgcacacaccauccacacacacacagcauuuauagacacacaugcagacacagaccacacacaugugccauccacacacaccauuuacacacacaccauuuauagacacacacacgugcagacacaaaccacacacacacacacgcacauacacgcacacaccauccacacacaccauuuacacacacaccauuuauagacacacacacaugcagacacaaaccacacacacgcacauacacacacacaccauuuacacacaaaccauuuauagacacacagacauaaaccauccacacacacacgcacauacacacacacaccacacacgcacauaccaucuccacccaccauuuauagacacacaugcagacacaaaccacacacacgcacauacacacacacaccauuuacacacaaaccauuuauagacacacagacauaaaccauccacacacacaugcacauacaauccacacacacaccacacacgcacaugccaucuacacacaccauuuauagacacacacaugcagacacaaaccacacacacgcacauacacgcacacaccacacacucaccacacacacaugcacacaccauccacaaacacaccauuuauagacacacacacacacacacacacacacacacaugcaugcacauacacggcuguuuauuuugguaaggugaaaggaucucccugugugaugguuuuguaauacgacaaaaauacacaguuuuuuuuuuuaaguuucuucuagcucaguucuugcuggagcuaugucaggggcaguuagaacugagcgccggccugguggcuggggguacugcaccacucagguuucuagccuggggagcaagagaggcccagaccccugugcagccgccugccugcgcugcuuccccaccccggacccagacuccgcccucagcuccgcagggcacuggcugucaacagcucccagaaacggcccucaguggaaggagcugccccaccugcgucccugaagggagggcccucggugcucaggggggcccagggaccuguguugcccagcuuggcagcucugcugagcugugcgagaaccugugaaucagccgaggcccugucguuuucgcugaugcuccuauggguguucauuccagaugguuuuccaagaaaccgacucauggccuuccguaaucacagugcugagguugugcccuuggagacuuugucauacuuuuacuccuuacuccaauuuggcugucagugauuauucuuguuuuuuauaauagcuuuaucgaggcauuguucccgugccagacaauucaccccguucagguguacaguuagguggguuuuagggugucugcaggguugugcagccuaaauaaugaagaaagcagcgaaagcuuauuuugauuuuguggugauggggagccaugggaggguuuacggaacguugggaugauguuuauauucuagaaggagcuuucuggcagcccucgggagagggaaucggggagugugugagggaggcagggaggccggguaaggccugaguggugagaaccucugugaagccaagggcucuagugcugcagaggagagagaagaggaggcacgguucccagagugacgggagcacagggagggcugggcagagccgccccagccuccugacccgggcugugcaaugcuggggagacggaaggaggcaauccuggaggagcccuugcugacagccccaaguugggucgagggccuugguuuugguugccgggcagaauggcagcacugagcagagccaucuccgcugcacacacacacacacucguacccgugcuuguguccgccccacugcaggcacucacuuguacacaccugugugugguuguguuuuucuucucgugaugcucacagaauguacauggagacagauucgcacacugaggugacgaggcagagauggaagccuaggccugcccuuggugugguucccucauggcugcugaggggagccuuagagaaggccgcucccugugcgggccuggagcuccggagcagccaccagggacgggagccugggagccgucagcccucgaggaaggccugggagccgucagcccucggguggcccucggauggcccucggaagccauguggagucacgggcacgcaggaggcaggagaggccauucuccccuugcccaggguggagggugaagggcggggcagcuguggaggagggaggcugggaguugcuccagcuguggugucugccaccugccugugcuuuuagaggcuuauucuuucagggacgcuuuagcuacagaguacuauuuuuugucuuuucuucagugaaaauagcgacccguggcguauccacuccgcacagguguuuggcuuucccagagggccucgaggggacgccgaaggcugucauuuggggcugucugcccaacucugagccagccugucucuagggugcucagaacauggcacccugaggcauagacaucauguagauccgcaccauagacggggcuguagagaagccagucuggcacuuuugugggggauguuuguggcugaauuacaccuuugggcaucugugguuuccuuuuggacacagagaacucagcguguguugucauuuauuuucaugucaugguuuagacuaaaaagguuuccauuuucugguugggcacagaaaggccccggaucaccuccgagccccaggacgcagaugugaccucggggaacaccguguacuucaccugcagagccgaaggcaaccccaagccugagaucaucuggcugcgaaacaagugaguuggggccaaacagaaaugccccugugcaucucucggaguuacacucagacacccaaaccacaccucacuccccaccaaggcccacguccacuuuuccuccuccacguagggaaaaguacaaaggagaaacuauuucugcuccuuuuccggucuuacauggcagggggugugacgacguuucugccaggcuggggccccuuccccacucucuccugggcagcacaggggugcccuggcugggcaacgcgucacugcggcccuucccggugggagggagggagagcaugcugguuguucucucccugccugcugacgucuggcagcagccuguuugcucuggucacuguuguuggcagccuugaccuggggcauugugaccaaccugagugggugcgggaggggcccugaccucugcugggacggcguccucaggagccuggagcgccaugcagcugcugacacagguucgcucagcucccguguggaucuaacuugucucccaaacaaaggaagucuucucuuguguccacaaacaugcuguggaccuguuaaggcuaagacggcccuggcugcggcugucagggugacggagggaaguccuaccgcugaccauuacaugcguccuggcagcgagccccaccugugagccagguguggggagcaccccugcgcugcugggguuugugagcuggggcuguguugguuaaggagugauggagucuagggggaagagaugggaggaggugaaaggcgugcaagggggguggguggggcaggaccugggugcaggggcagagaggccuaggugggaaugaggucagauugccggaaggcaccuggggccaaaucacugaggguccuaaguuggaguggagcacuuucaaagugaccuuuugaaaggaauccuuaaaagaaaauccugaaguaaagccaccauguccuaccuucucccaucugccugcgugaggacagcuucugaaggagcuccuccugccggcccagccccagcacuccugcgcugcuccucucuggccauguuuagucaugaggcagcaagagggaugcgucugagaugugagcccugugauacucgggcucaaacugagucauuguuugauacucgggcucaaacugugaugaggcacaaacugagucauuguuccagacuccagaggcaaaccgggcugggcuuggcucucgggcaaggugguguuuauagaagagauggacaggagcagggagcuggccauccccaguggucaggaacagaaugggaagauguguucaugcugaagaggacaugggagguuuguuccagcucuagauuuuguuauccucaugacugaaaagucauauugaccuuggcugcagugccggacaaggagccuguaaggugcagucacucucuucacagcuuuugucuuggauggcucccaaguugaugagauuuaaaauccagagaacacuggaggaauucugcaguauuauguugugugcauuuaaaagucagggaagcauaaauuuggccccaguccaucacaccuacauuuuauauacgaaaaaauugaugcccgcaguugaaaucucacagcuaaauauggcagagcuagagccaaagcccugaggccuggugaccugugcugggcucugcccuccaccagcucgagucucaccugccggcuggccuuaccuaacauccagagucaccugcaggccacccucaccugcuggcucgccguguuucuggugggggggauugggccacaucagagagagucuuguuuauggggccuaagcugacauugcuuccauccagcaaucccuguggguaaggacagauugcaaguugggggauuggugccaggcgaggagagcaugaggaagauuugggagaaggugggcguuggucuuucgaguguucccgacgguuuggcugcgcgcuggcagguuucugagggcggucauggggaagugcuuuugcacagugcuggugcugcuccuccugcaugagcgacccagcuugguccaggcugcacaggcuccuuaggaaacucgcguggaaggugaugaaucucgugcacugaggaaguggguuucuguuucacagaggucuugucugucuuggugaucugcaaguaggaguucucuguaggcccgucugcauucucagagggcuccgugccuggcuguucuuacucuguccucacacuugccauagacugggaucucaguggcauccaaugucaccucucuccucuucaccugcuucugcauaaagggaacuaaagugaaguuacagguggggugagggugagaggcggcaggacugagcguugggguaaagguugcagcuuuucuuggcugcccgaagugugugugaugcagcauggccccaggggagguccuugcugcccgaggacuggccaagccaugcaaagguggggucaccuguguccuggccucuucguggugcagugccacagguuccucccagaucccagagggaggccaaccagcagcuugcaggcacuguuuguuaaaauacagauagagaggucuggcgcacaccugcaaucccagcacuuucggagcccgaggcaggaggagcgcuuaagcccaggaagcugaggcugcagugagcaaugguuauaccgcugcgcuccagccugggcugcagagugagacucugucucuaaaauaaaaaaauaaaauacacauagauacagcucuggcuuuuaguaauguaaaaauguuucuacccuuuuuaguuaauucaccagaaacgaaagaaaauguuuccuuggaauuuuuuccguuuuguucauugcuuucuccuuuggaauuagaaacacuuuaaaacauguagauagauugaacacgugaauacuaaggauaaguaccugagugaaugagaugugcaaauacacgguccccuuuucagaauugccuguuaggucagggcugccaggaaggaggagacccuggaaggugagcuguuccucgcacaaguugugccugcugcagggcuggaaaccccugugcuggggaugggugagguacgucuuugugcuuucaacacuugaccagaccauauuucugucuuuguaguaaugagcugagcaugaagacagauucccgccuaaacuugcuggacgaugggacccugaugauccagaacacacaggagacagaccaggguaucuaccagugcauggcaaagaacguggccggagaggugaagacgcaagaggugacccucagguacuucgggucuccagguauguggcgggcauuucacaccgggguuccauccagaauugucgucccucacuaucugccuucuccuuuccuugcaccccaaaauaagaaugaacauugaagucugaaguugaagcuccaguaccaggguuggcucagaaagcuuucuaagcgcagggucguagaugauccaugagcggugcugugguccccaguuagccccucaucuggggacacacucauaguccacacagccggggcaguccaugcugugagcccagcccauugagagagggccuugccacacccugacccaccgaccccaccccccaggcgccaucugaagggacagcuacucagccacagccagcuguugccaugugguaacgaggucucuauuuugcuaagggcuuggauuauguaaaagaaaccacaaaucuagauuuuuauccaauauuuucauguuuaagauaauggcaccuaaauuuaaaacauuuaaaaacugucucagccgcaucaaguccagcuguggccucucauccaucugggccccaucagguugcaaacucugcucugauccaccuguguuauccauggccauugcucagaagaggagcugggcccuugaagaacagcggauugaggcauuggguguacccaccauggcucugggaaaugauacagaucaguucaugccucuggacgggucugccugucguccugugcagaagccgguagagucggagcccuuacccagggaggcugcagguguaacuuccucucugaaaccuucuggcugccuuuagcuucagccacaaaucaugccaggguugcugcuucccugguauuuuguauuucaggccauuaugguuauaaaaccuuuuguuuggcaauguaagugguuuugguguuucuuguuuaaaucccagcuccuuaauuggccuggucucugcagcaccuaguacaucccagcauagacacaaucaacaguuaucagugacugagaauuccuggcuaucacauuuccauucaaaggaaagcccaaggauauaguacugcugaaucaaagcccuuaaucaaacaacguuccacauguuuagcacaagacauuuagcaucuuuccaaauucagaaugcugugggccugugcagagaaguuaagacacagccgcugcucauagaaggagcaugggcuguauuuuuaaggaauuaaaaaauccacaaaauagggagaaaaaguuauguaguacuguuaaguauauguuauagacaaaggagaauaacuauggauuaugaguaaugaacuacuuaggagaguuacuauguucauagguugauugauuccuagacaggaauauuuagccagcucuuuauggcuugagaguuccaaauuucacuccuuuugaucugaauuguugugucuuucucaggaacagcagcccuauuuaguauacuagucugagcauguggguguagcucccucagauacacaugaagagucucccgccauccggugcacagggagucacugcagcaugggggaaccagcccugagaagcccagaagccuaggcugacacacugcagccugcaguccacaccugccuacugccuguuuuuccuaaggucuaugaacugagaauacuuuucuacaauuuuaaaugaucaaaacuuuuaaaagaagaacaauaucuuaugaccacaugacagcuagaggaaauucaggcgucauugucuaugauuaaguuuucuuggagcaugaccacacccauucuucugcacaaugucuauggcugcuuguaugcuaccauggcagaguugaguaguagcaacaaaaccuguguggccuucaaaacuuaaaacaggaccaaucuggcccuuuacagaaaaaaauggccaacugcugucacggacuaugguaauaauauauaguaauaggaauagagugacguguaggucucugugagacacaaaggggcauaucgcacccaguauccugaagcucugugauuaggagcauauaaaaaguuugcaauuuuuaucuuucugaugaauuacauuuuugaucaguaacacuucuaucucuaucagugcuuuuugcuucaagguaaauuuguuguaagauaaauacagcagcuucuacuugauucguauuggcaggugugucuuuucccaccauuuuucuccgagccuuuccaugugcauauauuugagauguuuaauauaaauaacauagagcuagaaauuuaaaaaaaaaauccuaaguuuuucuuaaaguuaauccauuuaaauauguuuauuguaguuaacaauaugagauuuauaaauucuagcucuuauucugaacuguuuguccaaacuuuucuauguuucuugcuuuaguuggaaauaauuauuuuucauauuugcuccccacuacuuguuuggacacuaugugcccauuucuguucuuuuaaugguuagccuagaaaauuuuaaaugcauucuuaaauugccaaagccuaaaguuaguauaaccuuccccucuaacgugcguucaucccucugaguugaugugcuugguucuguuuuuuuuuuaaaccuauaaacauuauuauuuuguucucccaguguuugucuggaugcauccaugugguucccacuuccuuuguccuuccuuuguuuaucucagcucuucugucggggaucaccuuccuucugccugauguggggggaguugggcagcaaguucacgugaggaccggauuuuggugaacaacacuuaaaugagauuuauuucucucuucuacugggcacuguucccuggguggggcaggcagguuuugaaguuaguucuuucucaugccgagggcacagcacuguggggaugcagcugcuguucaguuuucugguggacuucucuucaugggccuguguugaucugugucuugucuucuguaucacaugaggcucuuaaggcuaaauuuaaguuauaagggucugcagaugcccucaaggccgacuuugacuuugguguucguacuucugugaguagcuucaugguuuccaguuuguuauucugauagaaauacuaauauuaaaugucauuucuguauuuuuuauaauuuauacuuaaauauuugauuaacacagcuuacauauuaacauauauaaaaaagguagaaagucuuccuccuggcucuuuucgucauccgcucaacuccuauucccuuccccucuucccaaaaugcuuaguaguuucuuuccuaucuauauacaaaaaaauguaagcauauuugaggcaagugauuuuucuuagaugauaucuuagaaaucuuucuagucuuucacuuuuaauacaugagguuucuuacucucuuucuuuguauagcugcauagaauuccaugaucuaaaugcaccauaauuuauuuaacaaguucucuuuuggagugaguuuagauuuuuuuccaaaucuuuagcuaucacaguuguguguuauuuauucaaaagccuuugggccagaugucuuuugauauccagaaacuuggggaaauuuucagaaggguagcauaguguaaaauccacauaccaguuuagacugucagcagagcccuguaaucaauguauuaauauccuauagcaaacuguauggauauucacagaaaguagcauaaagacuauagguagucuuaugcuagcuagauccaguuuugcaaacaaauaaguuaugaaaaaauaaugauuuuuggagcuuucugaauuuuagcauggcagauaaggaugguugaccugaagaaacaacagggcaaaaggaaaacaaacaaaaauuauuuauuuauuuauuuauuuagacagagucucgcuguugcccaggcuggagugcagugguaagaucucagcucacugcaaccucugacucccugguucaagugauucuccugccucaaccugccgaguagcugggacuacaggugugcaccaccauacuggcuaauuuuuguauuuuuaguagaggcaggguuucgccauguuggccaggcuggucucgaauuccugacaucaggcgauugcccaccucagccucucaaagugcugggauuacaggcaugagccaccacgucugacccaaacaaaaauuuauuuggacauaugacauuuuaugugcuuguaaaaauaucuauggauuaaguuucuagcagaauauauauauuuuuaaauuuuacuuuaaguucugggauauaugugcugaaugugcacguauguuacauagguauacaugugccaugguaguuugcugccaccuaucaaccugucaucuagguuuuaagcccgacaggcauuggauauuuguccuaaugcucucuguccccuuucccccaaccccccgacaggcccugguguuugauguuccacucccuguguccauggguucucacuguucaacucccacuuaugaaugagaacaugcgguguuugguuuucugucccuguguuaguuugcugaggaugaugguuuccagcuuuuuccauguuccugcaaaggacaugaacucauucuuuuuuauggcugcauaguauuccaugguguguaugugcuacguuuucuuuauccagucuaucauugaugggcauuuggguugguuccaagucuuugcuauugugaguagugcugcaauaaacauaacgugugcaugugucuuuauaguaguaugacuuauaauccuuuggguauauacccaauaaugggauugcugggucaaauuauauuucugguucuagauccuugaggaaucgccacauugucuuccacaaugguugaaccaauuuacaaucccagcaacagcguaaaaauguuccuauuucucugcauccucgccagcaucuguuguuuccagacuuuuuaaugaucgccauucuaacuggcaugagaugguaucucauugugguuuugauuuccauuucucuaaugaccagugaugaugagcuuuuuuuucauauguuuguuggccacauaaauuucuuuugagaagugucuguucauauccuuaacccacuuuuagaugggguuguuuuuuuuuuuuguaaauuuguuuaaguuccuuguagauucuggauauuagaccuuugucagauggagagauugcaaaaauuuucucccauucuauagguugccuguucacucugacgauaguuucuuuucuugugcagaagcucuuuaguguaauuagauuccauuugucacuuuuggcuuuuguugcaauugcuuuugguguuuuagucacaaagucuuugcccaugccuguguccugaauguuauugccuagguuuucuucuaggguuuuuaugguuucagguuuuauguuuaagucuuuaauccaucuuugaguuaauuuuuguauaagguguaaggaagggauccaguuucagcuuucuacauauggcuagccaguuuucccagcaccauguauuaaauagggaauccuuuccccauugcuuguuuuugucagguuugucaaagaucagaugguuguagaugggugguguuauuucugagggcucuguucuguucuauugucuauaucucuguuucgguagcacuaucguguuguuuugguuccuguagccuuguaguauaguuugaaguuagguagugugaugccuccggcuuuguucuuuuugcuuaagauugucuuggcuauacgggcugcuuuuugguccauaugaaauuuaaaguaguuuuuucuagcucugugaagaaagucaaugguagcuugaugggaguagcauugaaucuauaaauuacuuugggcaguauggccauuuucacaauauugauucuuccuguccaugagcacggaauguuuuuccauuuguuuguauccucucugauuuccuugagcagugguuuguaguucuccuuaaagagguccuucaaguccuguguaaguuguauuccuagguauuuuauuuucuuuguagcaaucaugaaugggaguucacucaugauuuggcucucugcuugucuauuauugguauauaggaaugcuugugauuuuugcacauugauuuugugcccugagacucugcugaaguuguuuauaagcuuaaggaguuuuggggcugagauguuggaguuuucuaaauaugcaaucaugucgucugcaaacagagacaauuugacuuccucucuuccuauuugaauacccucuuaggaggguguauauguccaggaauuuaccgcuuucuuccagauuuucuaguucauuuguguagaaguguuuguaguauucuuugaugguaguuuguauuucuuugggaucaggggugauauccccuuuaucauuuuuuauccuauuugauucuucucucuuucuuuauuagucuggcuagcagucuaucuaauccauuugucaaaccgauuaacaaaauauguauuuuguuaaucuuuucaaauuaauccagcuccuggauucauuuuuguuugaaggguuuuucgugucucugucuccuucaguuaugcucuaaucuuaguuauuucuugucuucugcuggcuuuuguuuggcagggucauuucugggcaauagagugugcacaucuucagugucaguaugcacggccacgucccugcaggugggcugggccagggugugcucccacugccagcaugggagaguucuguuuccacacaaacucacacaugaaacacauucauaauuguauggacuuuuuucuggauuuaaauuugaaaaauauuauuucuugcuuacuuuuaauuugcauuuuuugugaguaaauuugauauuuuguauacucuaaauauacuucccuaacaauaauuugugccaauaagaacuacuagcaaggucuaacaagauugacauaauguauuuuauuuagaaauaagaaaccuccauggaguucggcacauguuuuaagaaaaagcgcuuccuaauuagcucuuccuaaccgaucaugguugcucacuuuucucacguggccugcauuuuguuugacccgaggcugugaaccauuuuuauugucugcacauuucuuuaaaaagaaaauaugcaguuacguuguguuuguuuugccuauuucggugguaaauagaauuaauagccugacauaggaaaaaucaagcaaaaaccaugucaaaccgggagaaauuaauugagaauuucuguuuaauugugacagcucgacccacuuuuguaauccagccacagaauacagaggugcugguuggggagagcgucacgcuggagugcagcgccacaggccaccccccgccgcggaucuccuggacgagaggugaccgcacacccuugccaguugacccgcgggugaacaucacgccuucuggcgggcuuuacauacagaacgucguacagggggacagcggagaguaugcgugcucugcgaccaacaacauugacagcguccaugccaccgcuuucaucaucguccaggguggguauccauccucugugccagagccagggcucagccccauccucaccccuccacuagcucgcgcugccauacccacagacgcuccauagaaucuucugcccuguccacuucacucgguugauuuuuauccauuacaccccccuuggacuaaauacagacgacugcaguuuguagauuuuuggaacagaaggcucuguaguaugggcucugugugcuggcugucgugucucuguaccuccagcaccuggccagcaggagugucuaucagauaagugagagagagagugugugugugugggugugcacacaugcaugcacaugugcaguaaggugguugauacaccuugcagacagcuuugaauccuucccuaaggucaguuuuggauguaaucugggaguauucaucguuuuacgccaucugccauggauuucuacauugcuuaauugacuguaaaaugaguuauucuugugaagugggacuuuguuggaaaacauucaaacaauacggaagugcaaaagauaaauuauuagagaugauauuagagauagagcaaucauuuccuucugcuggccucucuucagcccuuuccugucucacuggcaaucugucgagaaucugcacgcacagcagugcaacugcguuacauggauuuacuuuuuuuguggcuguuacuuuuauaaaaauggaaucauaccagacaauacuauucuguaaguuauguuuuucauccagugauaauaaccacuaucaucauacacagcuauaccagauggcauuuuuuaagcauuugcaaauauuaguuuagggugaggauugagaggaaucguuguaagucggccugguguccacgagcugcaguguguccucauccgugccccgugugcauugcagcuggcggugugguugaacggucuuugugugcuuuccagggugaugcugagaacacacccauccuucaucuucuuuccguucugcucccaucuucuccugugcccucugccucuuucugacucuucguuguagacauugcuccuaauggucagacgucugccaagacuguggucauuuucuuggucgcguuuuuaccccaggcuguuuuuuacauguccuguuuugaaugcuuucucuccggaagcucuuccucaguucacugugacgccucaggacagagucguuauugagggccagaccguggauuuccagugugaagccaagggcaacccgccgcccgucaucgccuggaccaagggagguaagacccaggccggcccuuugccugcucccuccgcggccacagacgcaggaagcacacauuuccacugugcccaggcaaccccagcguguucuggacagggcugagcugggacuggauuccacaggaccaaggcacugggaagcgcagaggugucugcacaucccccgcggcuuccuguccaugcauggccgucccucauggacaucauggcaggaaacucugagaagcucugucauugcggaagagacuugggguuccugccuuugacucccucacaccugccuuguuucagauagucucuaggaugugcuuuuaaguagccucuugaaggaaucuauuugcauggaggauagaauuuucuggaaacagucgaggaauauauugaaacagacgaauagcuuuugcucugacuuugcuucccagagcccucacugucaccuccccauucggcaucaugaccuuucaucacauucuuugccuacaguccuagcccucuuucuucaaugggaaagucgcugggcauguuacugcauaaaggcacagccuggauggggguuggggugagggcaggagcugaaacugcuggagaaggagcuacgcagaccuccugguuccuguccugggaugcaagcagugacccugagacauccuggccacuccagcuugcaccaaauggccagcccaucccuucagcccucugaggggccccacccagggcuccugaaagucuuuggggaggaggcuugugccugcaucacacgcccuggauuucccuuuucucaggcaguuaugggcaagaacaggagagguuuaucccggaaaggaacuugcuggggccucgcuuggcucuucgucaucuccagcacucaauccucucccugguucucccagcuggccauccaccccgcucugacuccccgaguccccauguccuccuggcccccuguguagugcuuuucccucuguucucugccacugucaaccccucugucugaguuacgggugcagggacguucaggugucaccauggugucugcuggggaggcaaagauuugcuuaugcagggccaggccaaauuauccggcgccccgacccagguggagacaagcuucuguggucaugcugucagucugagagcaggaguucuccaugcguccgaguguccaguguaacgggcccaugcccuugcagggagccagcucuccguggaccggcggcaccugguccugucaucgggaacacuuagaaucucugguguugcccuccacgaccagggccaguacgaaugccaggcugucaacaucaucggcucccagaaggucguggcccaccugacugugcagcccagagguaggugccaggagguuguggacugaauugauuuucucagaucgguuaucaggaaacacagaauuccgcagcugacauuaguguuacucuucguuauaaagcguuggcuguucucucugcauuuugugcaccgucauugugcuugugcccccagggugucugcauaguagcucauucaaucucugucccuuuagcgggugaaaacauuugcuuauuuuucagugaugguuguuuugaacuuggauaagagugacuuguuaaaguaaaaucuaucagguuuuuucccuugguuaauuaagauuauuuuagaaaaggguuguuucuaacugcccuuucuggggugguuauuuaaguaacacagucuaaucaagucagcucccaaggcacagaccccagaugauguaucaugaggccaaauccaguuucuuucccgucugcccgcucauccuuggacccuggucuucaucuuguucuuuuuggaugucgccuuugccuguucucuccaaugagaagaauccccacaaccucauaucccucccgauagaaucagcguagcacugauuguggccucugcaagagcgaaggccccuggcccagcccccguguugcaggcgcccugugcuaacuccaguguuagcaugaguggcccccagagcugaguaauccagguugccacagacccugagcuugucauggggaccauggggaguggggcagagaugucgugcggggaggauagggcuggauuuccuugcgucacuuuggggcuguccugagacugugcagaccucuagaaggggcuccccucugccuguugucaguaggcuguugaugaccggcccgccggguuggcucuguguuucuuggguuugcccuuggcgucccugaccuagcagaacgcugggugccuguauagagaaugcgggggugggauuccugaacggcuccccagaucccagcacucagccacgcuccugcucuuucagaggaggaagcuccccucuguuuccuucuccgagagucgggcucuccccagagcuuguuauccucugugggcccugcggcacagcauaugccugagacugccccaccaucggugagggacugggggcuggaggacauggcagccagcccauccuggacccugcggcugucugucucugagcagggaagacacuggcuaugcuuugcucuccuugcccugagaggcggggaggcgggcggaucuucccugggaucuuucaggcuccccugcccugugcagaggcugcugggaggcagagaaagggcccauucugaaacugacugugagcucccagcaucccugagugggccugauggagggcaggggauuuuguucuucugaaguuuuuugauguaauugacucguucuccuggauucucuacaucugccuuccagucaccccaguguuugccagcauucccagcgacacaacaguggaggugggcgccaaugugcagcucccgugcagcucccagggcgagcccgagccagccaucaccuggaacaagguaggcggucuggugcccgagccagccaccacccagauacaagguagacgggcuggcacccacaccacccacuaccuggagcaagguaggcggaccagugcccacgccccagccuccccucugcugugggguaugaugggcuggacagcugcugccugcccacuuccucuauagacuuucuguagcagaaagaaaaacauucagaucuuaagccuugagguaaaaauacucagggcauccuuacuaauaagaacaaaacaaacuuggagcauuccauuuuuuugaucuuuucaauaacaaaagcaaagaaaaacccucuuauagaacuauggucucaucaucaauaaggaaggguuuucaucguuauuucauuucuuugcuguuuuuauuaagcucaguaggaaaauguggguagcacucacacaccaugacccguguuucugugaauucccucccgggagcacagggcuggccacacugguccccauggaaggagagugcucagcggagauggucccauccuccaccugcaucccugcacugcccugugaaucucuguguccuuuucuuccucgccacacacaccccaggcaucugcucuuguuccugccucagcugggaggucaccugucccucugcgucugccucugaauccuucuuugcccucggcgccagugcccucucuuucugagacauuccuaggucucuuuguagggccccccaccauagcgggugucuaagggagccaucauuggugccucuucuccucauuguggaaaaucauccuugccucaagcugucaagcucuguucucccaaagaaugagaugugggaagaguuuaucucgccagcuuggcacugggagaacugaccacaucuccuucgcuuuccaggccuggauggaucugagcgcagccugggagcuucuccauuugcaaauccuaacaaauggcuccccucccccaacccuaggucagauaacuucugcuucuuagucuuauuucuaauacuguuuucauucuguuuugcuccaggaugggguucaggugacagaaaguggaaaauuucacaucagcccugaaggauucuugaccaucaaugacguuggcccugcagacgcaggucgcuaugaguguguggcccggaacaccauugggucggccucggugagcauggugcucagugugaaugguaagaugccacaugcccacaucuacccacaugguauccacaaagaaagcccgcaggucccuaguguggucccaggccaguugacuuaggcuguucagaauuauucagaagacaaagcacccuugauucccagguggggacacucuccugaugcauggccgggcugcucgacagccccuccccuccacacaggcaccuggaggcccugcugcccauccacggggcagagcuuuguccugcagccuguccacugggcaaugucuuacccugcagcccauccacugggcagagcuuugcuccggggucauccacaucuguccagaaaugaccagguguaauuuacaguuacaauuuggcaaauaugguugcuugaagagauucugauuccuuagcugcgguuucucucuccucgggcuuuggccaggaaugcucuggaagcaucuuucagugggaaccucuaggugcucguaggcagccuuacauagauccagucggugguccuagagccguccugacuccaugccugcaucugucuguuugcauccugguccgccaccacuuccaucccacucaccccgaggcccuuggcaucuuguccggguucuuguaacagaggcccgggucacucuggccccucuuucucaacccacagaccccaugaugcccaugaugugucccugacccuucuccaugucuccuguggccaccagggugacacucacacccuuuagcuuugcauggagucuucacagugugacccaaaccugcgccucaucagugguguguuccccacuccugcucugucccccuagaguuagcaacacucugagaacgcgcacaaaccccccuucacgggguaaaggacccucuggccaucaccccacuccccgcaggcgcuggccuucccccgggccuccacugugacucuauuuuugccuuuuccacucucauugugacugauccgccuucuccaugggacuuguuaacagacaggaagagugacccccacucagugccaugaacauggcagacauaaaugugaaccguaauggaauuccucaaagacuuuuaagaauuauuuaggaaaagucuuaagugaccuuauuuucccauuauauguagagugugaaauguaaaguugauguaaaauuaaguguaaaauuaaguguaaaauuaaguugaugaaacuuaaaaaccaguagauuauuuaaaauuaauauuuguuuuuugcuugaaaaaugcuaccuuaacaugaauuaauuacaucugaaauuuaaucguccacccguaauuccaucccccaaaaauaccaucauuaauauuaugguuggauuccuuuuccuuuuauaaaaagguagauaaagaaaugcuuuuggauuauuuuucugugaucauugcuuauagaaauacaaauucaacuuaaaccauuaauaagaaugaaaugugagucauaaaauuauauaaaauuguaugucucauuuaucuaccuauuggcauaaaaauauugcauuccaaaaauuaguaaauuugggcucugagauacacaccaaaaaguaagguuucugccuagcugaaauucuuuucagccauuugaguuguccauguauacauaccucaaauaugcaaaauagccaaugagcucaccuaauccacaugccugugaugucuguuagcggugaaauaaaucaggcuggagauguccauccauaguccggugugagcacauguuguaagaagaugguucagaagggcccucggguuggcccaguuaucaccaauagucgccgccacuuggucguucguucagcaaaugccuucgugggcuggacucuguccucagugcugagccaggugugccaggcacucggcuccauggaguuagauccugguggagagaugaguaagaagcagugagaugagcagucacgcucagauggugaggaguccgugaggaaccgcagggcaaggcaugggccggagggggaagcagagguggucagcacucgccugcguauugaauucugagcagagggagccgcggggagaugggggguggcaggggcagccuggucugggagaguagaguggggggguccuggggucagaaugagcccgaugccgggggguggggagcacagggcuggggcaguccuggggguccuggugcuaacugggcugcagagcucgacuguccuugcagacauaccgggacgccaugaggaaguucccagcagaggagcaccgugagccagucugcuuuccuaagauuuggcuugggcuguggaugaaggguccagggcgaggugucggggaggauaguggggggugcugggccaagugggagaaggagugccugcacccgggcccacagcuggggucugcggggcuggucccugggcucguggccaguagcagaucugagggggccuggcaguaguuggcuugcacuguggggggacugcugggcucugucagugucacccauugagacccagagacagcuggggaggaaccggcuuggggaagaagagauggaggaguccuguuugagcauggaaaagggaaaagccuggaguggguggugagagccacgaagugagcugcagggagaggucaggacgaugguguaaauuugaagacaacagcgugaaguggaaccacacagggagaugcuguggaggaccagaacacccagucacugugcuggagcugcagccucagaggccgggcgggcaaggcagaaugagcaaaaagacacugagaguggacgcacgcagacacuguaacagagagagagagagagagagagagagagagagagagagagagagagagagagagagagagagagagcccacagcugaaauggagugcucaggaggaagagacaaggagaaaggaaaucacagugagggggcaagucccagugaggagggggcaagagggggcagguuccugucaggaagggacuaggucucagucaggaggggcagguuucggucaggagggggcacguccuugucaggagagggcgggucccaaucuggagggugcaagugccugucagguggggacagguuccagacaacagggggcagguuccugucaggaaaggacuaggucucagucaggagggggcccgucccugucaggugggggcagguucuugucaggagggggaagguuucacacaggaggggcuggucccugucaggagugggcaggucgcugucaagagaggguaguuccuugucaguagggggcaggucccuguuaggagggagcugcuuucagucagcagccagguuucaggcaggagggccaggugucugucacgagagggcaggucccagucaggagggggacguccuagucaggagguggcaggcuucagucgggaggcagcaggucccugucaggagaggguaggucccugacaggaggcggcagguuucaguuaggacagggcagguccccuucaggagaagacaggucucagucaggaguuggcagguuucagucagguuggggcugguuucagucagguuggggcugguuucugucaggaggggcaggucccugucaggagggggcugguuucagucaggagggggcuguucccagucugaaggugacagguuccagucaggggagagcaaguuucagucaggagggggcaggucccaggaggagguggcagguucccccccagucaguaggaggcagguccccccccagucaggagggguaaguugcaguuuaaagaguucgggucccugucaggagggggcaggucccagccaggaggggccaaguuucauucaggaggggcaaggucagucccugucagcaggggguagguuuuagucaggagagggcaguucucagucagagggaguagaacccagucaggaggggacaggucugaggcaggaggggacagguuucugucaggaggggacagguuccagucaggaggggguaggucccuguccggagagggcagguuucagucaggagggggcaagucccugucaagaggguacagguuucggucccuguccaaagggggcaugcuucagucaggagaaggcagguuccugucaggaggggacagaucccaguacugagggggcaggucccugucaggaggggacagguuucagucaggugggggcggguuucugucaggggggcaggucccagucgggauggggcagauuucagucaggagugugcaggugccugucaugaggggaccaguuuuauucaggaggggacagguuucaggcaggaggggacaggucccugucaggaaguggcagguuucagucaggagggggcagcuuucugucaggagagggcaggucucugucaagagggggcagguccccauagagggcugugucccagcagccaagugaaagaagcuuuuuuguaaggguguguugggcugugucagcgucugucaaaagauugcguauguugaagaaaaaugaaaucaacuuuggauuuauuaggguucaugucauugggugagaugguuagagcuguuuucaucacuaaaaauaaaaguugguuggaauuaguuuauaguauuugguaaaguaucaacuagggacuuacuauuaagcagaaaagaaugacaagagggaacuagaaagagggcaguaacuuuagggguagauaaggugugugauucuguguguguguguuucuuugguuugguguguuuguguauguuguguguuugugugguguuugggguguguguuuguguguguuguguggugugucuguguguuuauagugugaugaguaugugugguaugcuaugguguugguauguguaguguguaucuguguguauagugucguguguaucuauauguuugaugggcuaugugcguguuauuuauaaggugcuggguguguuguauuugugugguguguaugugugucuaaugugaugugugugucguguguaucugaguguagugugauggaugugugauuuuuguguguaucugcauauauaaucuguguguguguggugugugcgucauguccuauguguggcgugugucuguguuuaaugugcuguguagguggcaugugucaggaggggguaggucccugucugaagggggcauguuucagucaggagggggcagguuucagucaggagggggcagguuuccgucaggagggggcagauuccugucaggagaaggcagguuccugccaggaggggcagaucccaguaaggaggggcaggucccugucaggaggggacagguuucugucaggaggggcagguugcugucaggaggggcagauguguguguguggugucugugugucuguguauaaugugcaguguguggugcauaccucugguguguuugugcaaugugauuugugugugugguguauguguguuuguguguacaaugugauguguguguauaaugugaugugugugguguguguguguaaugugauuuguguguguauaauguacuauauguguggugugugugugguauguaucuguguguggcgugugugugauguguuauguguggcguggugugucucuauauaauguucuguguagguggcguauguguuucuguguauauaaugugauugugugugguauguguuucuguguauaaugugacauguguguauaaugugcuguguguguggugcaugugugguguggaucuguguguggcgugcauguaaugugcuauguauagugugugugucuguguauaauguucuauguagguggugugugugcgccuguguguauaaugugauugugugugugugguguguggugugugugaggagggaguuucccuguguaaugauacaaguccacaggugagaagaugggaucauggaggcagcagaucuuuaaagaggggaguggguuaggaucccggaguccagggaggcuguggccuuugaugagaggaauggacgagaucugcuggacacugaggugucuccacagacaucuugucugcugggcuggccacacagggaggccucaguccacaccucccacaugcuguugcauauagcguaagaucuuccaugcuucacauuauaacuacuuccugucuucuucuuagguauaacaugauuucaaaagcuaaagucuguaauuuucaugcugucugaaacggcuucuaguagaauuugugauaaaauaauuugaguuuggguuugaaaaauagaaauaacauuuggagaaaaguaugccuuguggcuaaugauguagugucuagacaucauuuuaugaguaauugugcaguauuuuuccugguaauacgcgacuuuguauuuuccuaguuccugacgucagucgaaauggagauccguuuguagcuaccuccaucguggaagcgauugcgacuguugacagagcuauaaacucaacccgaacacauuuguuugacagguaucguggggcuguaaacacgcugacccucaaaucacugagcuuuagggugaaggugggagugauuaaagaaugcaugcaguucuaauauaugaauuuugauuugauuaucugaugaucaaaauguuuaauuuaaaaaucaugaacaacaugggcaucugaguuuucuggggguugaaauaacagaaggaugugugcuuuucaaauagaauuuggcuaugauccacaaccaaaacauucuuugaaaauuucaacucauuccuuuggcuuaugacuaaaugauuuggcaaaaacaaauaguuuaaaagucauuaguguauuuguucacguugcugauuccaaagcaguuuuucugcaucuuaugugaaaugcaauaucugugauuuucucuauugacuuaauuaauuauuuguuuuuagugucuuccgguuuuugucuguuuguuuuguuuuuguuuuguugccucccacuucggaugaggaagguauaguacauuauguuguagaaaguagccguagaaauauuaauagcaaugauuauauuuugggguacuaugaauuuuaucuucaguaauuuguuucauucuuccuuucuucccccuaaacucugguuagccguccucguucuccaaaugauuugcuggccuuguuccgguauccgagggauccuuacacaguugaacaggcacgggcgggagaaaucuuugaacggacauugcagcucauucaggagcauguacagcauggcuugauggucgaccucaacggaacaagucagugccaaagccuuuucuuccuccuccauggccugaguaacgggguugaacacgccucaguuaagucacauuccuagggaagaguuccagcauuuucuuucccacugugcuuaugaacugugaaauuauuuccuuaaacugugauuccucuugagcccuacagcccugucgcucucacuuugguuuaauaggaaucucugggggacgugaagucccuuggagugcugaucaggcuacagcagguccaccugcccugaguggguuaugccauccuggccaggguggguuaugcaagcccagucccucugcaacaaaugagccauaagggaggacuuggcagcgugcuugcucccugagugacguuguguccugggaaugcggugccacgcguauuaggaggguuguuuuggaagagucccgggucugugaaaccagcugaugagaucaccucgggcugguguggagaugcuguugggggagguaugucccccacucacucugcucuggcacuuugccguugcccaguaaauaacagaugccuuuacaugucacgauuguccuugcugguaguaguacuauugaugaacccauagaagacccugacuuucucauguaaaaacaucauuuucagcagcagcugguuacucaugguucuguacacacacacacacacacacacacacacacacacacagagcacggaggagaauguaacaguagcugucccugugggaugaaagaacugcuuuauaauuuuucaguuuuccaaauuguuuucauugagcauaacuuuuacgauuagagcaaaaaauguucuucaaugguuaaaugaaagagacguggaauugagaccuguagggugauauaugcccgucuucggaguagaguguugcucugagccagccccguccuguuagguuuuggagcccuguuggugcugaagccugggcaccagccaaugugaagcuguauguuccgcagcuccugcuuccugauccucuccuggccucucguggcugggggcgggggugggggcagggcaggaaauguuggaguuggagaccucuggauguuucugcuuuucucgaugggugaaacuccagccucaccucccaggcacauucuuggggagaagcaucagagcccauuuuguuauuucaacaaguauuuauugggcacuuucugcuugucaggugcagggggagacuaggaugagagguaccaggcaugggucccagccccuucccaagucccuggugccagucuccugguagaaaggccauguucucuucuccagagaaugaagagggaguuacuaaguguaauuucuugcuacucccuaccuuucuucauuuaguuacaggaucagaucuuuaaacauuacuguggcagcccagcaaguggguucugccgccaccacagaaauaaagccaucuggaaaugucuccucaaaggcaggcuguuggaagcuguuccuugugaggaauugcauguccauugugugucauuacaugccaauuauagaaagauuuagacucagggaaagacagaaaggaaagaguaaaaucaccccaacaaugugaaaucauuuuauacauuugcuguuuacccaagcagcaguuaggugcacaugcaggcacucauuucuucacuuauucguuccaccugccugucagggcacacccucuaugccagucauuguccugggccagggccuacagucacaaacggaagaaauaaaaaccucugcccucaaagaucagaccuuccagagaaaugcagauggaaaaccagagagaggccccugcacauaagaagccccagcgagugacccagagagaaacagcaggcgggagguggguggugcccuggcugggauggggugcuguuccccaugggcgaaggugacacgugagcagggaccccacaagggcgagggggccucccuggagcaucugaggggaccacacaugcagagucuuggagguggggcacguuggagcauaguggaacagcagguggucacuguggcuggaaagggggugaggaagggcugauaaaguuaaggagauuugugcuccaccagaaagggccugggagcgaauauaaggauaugucguuggcuguguaugaaaugggaaccuuaggguuuccugcagagaagcaacaugguuugaugcauuuucaagcaucgggcugggugaccacucugcauggggugaggacagaugugggcaaaccaguccugggaaacuggggccagggucggugccaccugcucugguuggcgggucuggucugccucugaaccaauggccaacgccacggaaaaagugaacauucuggaggaaagcccggagaccagccccacagcccagccaggcauuugggaggaagugcuuuuccuccuggcacucugcuuucuuggcucuauggauguucaagauugauaauucuguaggacuucccaagaguagcugugaaaauagggccagauguuucagcucacuguuucagccucugggaaaagucagacagaacagaaccaggggcugaggggagcccgggguucauguucccugcacagaccuuucccacccaacacaccaggguguguguuucugacuuauucuccccagccuggaaaaugccucacuuccaauucuuugcauucuuauguggguguuauggacaccgcucccccacagaaaaggggcugucucuuguuuucuuuaaagguguccauagugauaccugugaucuugacaagcagaaaugggcuggagaaacuuuagaaaaaagaagcagugauggcuuggaacucugugaguaugugcacacgugaaagugugaguguggcucuguaagcauguuugcaugugagugugugcaugugugaauggaaaacauuuaagcgugcaugugugugugcguguguguagcuuuucggcaggcaugacaugugccuggaaaggaggaguguugaggaaggugaaggccuaggauguaugaauauguggaggaagcacuuuggcgaacacagagaucugagugugucugaccccaggacguggaguagcuguugcuuggagcaggugucuugaaggcgaagacuaggaucugaacuuaggaagaucucuuucaucuguggagugauggcccaggcuaccauguuuggaauuucuucuguagcuagugggcaaagacagaaggucucugagcaagaaggugaccuagucggagccugugccaggcucaugggagcgugcgcuugcuguggggagggcguguggaugaccuccaccaggcaggaggcccuucuggaauugaaggccagugccauggaaaucagucccaggauucugccagagaaauggagaggagggcgcggcggcuaggaacauuuugagguagcgugaaaggaaguggcacucuuuuggacguugagggaacagcaugaagccucaguggaccgagaugugcagugacaggugucaggaaaugcccugcucggcagccuguggagaccgauggugugcacucguguggagguguggugacugucucuuacacggggcguuuaaagugagguuggaacagugucagccuggacuggucaacgugggucgggcuccaucgguuaggggucucccagaggagagcugcugguugaaaccaugagacugcuaaguggggaggggagacagggcccagaaacuggggcuguggagagaauaccuguguuuggggcuggaggaggggaggagcaguuuuaccaaacaggaggugagcagguuuccagcaggaagcgcuuguugcauggcgcacaacagguuucaugagcuggggguagauagccccaugucagcggcagaggugccaagggguaccgggcccucacacauccuccaggggaauugagugcgucuugcuuuucuccacgucccagguuaccacuacaacgaccuggugucuccacaguaccugaaccucaucgcaaaccugucgggcuguaccgcccaccggcgcgugaacaacugcucggacaugugcuuccaccagaaguaccggacgcacgacggcaccuguaacaaccugcagcaccccauguggggcgccucgcugaccgccuucgagcgccugcugaaauccguguacgagaauggcuucaacaccccucggggcaucaacccccaccgacuguacaacgggcacgcccuucccaugccgcgccugguguccaccacccugaucgggacggagaccgucacacccgacgagcaguucacccacaugcugaugcaguggggccaguuccuggaccacgaccucgacuccacggugguggcccugagccaggcacgcuucuccgacggacagcacugcagcaacgugugcagcaacgacccccccugcuucucugucaugaucccccccaaugacucccgggccaggagcggggcccgcugcauguucuucgugcgcuccagcccugugugcggcagcggcaugacuucgcugcucaugaacuccguguacccgcgggagcagaucaaccagcucaccuccuacauagacgcauccaacguguacgggagcacggagcaugaggcccgcagcauccgcgaccuggccagccaccgcggccugcugcggcagggcaucgugcagcgguccgggaagccgcugcuccccuucgccaccgggccgcccacggagugcaugcgggacgagaacgagagccccauccccugcuuccuggccggggaccaccgcgccaacgagcagcugggccugaccagcaugcacacgcugugguuccgcgagcacaaccgcauugccacggagcugcucaagcugaacccgcacugggacggcgacaccaucuacuaugagaccaggaagaucgugggugcggagauccagcacaucaccuaccagcacuggcucccgaagauccugggggaggugggcaugaggacgcugggagaguaccacggcuacgaccccggcaucaaugcuggcaucuucaacgccuucgccaccgcggccuucagguuuggccacacgcuugucaacccacugcuuuaccggcuggacgagaacuuccagcccauugcacaagaucaccucccccuucacaaagcuuucuucucucccuuccggauugugaaugagggcggcaucgauccgcuucucagggggcuguucgggguggcggggaaaaugcgugugcccucgcagcugcugaacacggagcucacggagcggcuguucuccauggcacacacgguggcucuggaccuggcggccaucaacauccagcggggccgggaccacgggaucccacccuaccacgacuacagggucuacugcaaucuaucggcggcacacacguucgaggaccugaaaaaugagauuaaaaacccugagauccgggagaaacugaaaaggugagcugaagaggcugugugggauggcucguguaccuaggcaccuggaacaccugaacugugguguguguguuauuugucucugugugugaguuuuguucgugucgugcagaggugagaugaaggucaaguccaugaaggucaagaugggaaccugcagccucccguggcugcgugguuguggggagggggcagagccagggguggauggacgguggagggcccuuccaccggccuguuuuguuccaagagaggagcuuugcugagcuguggcacauuuucagcuuagagaugagcuauacuuuucuggcagagggguugacugcagggaaaaauacacuguucgcaccagaaaacaccaaaacugacacuguggcuguugggcagcuucggguuccugcuguuguaucaggggcagagagagaggcagagcuuggugucugcagauccgggcccuuggggccaccagccccuaaggcuuggccuguagcaucuuccauacucacuguguugcccagacccaggccuguggggccaccugcccaugaccgccacagauggcgccgcuucugagccacagccuugaucaccugugggugcgguucuccuuguucugccacaaaggcaaaaugggacgcugucaccccugagacaagggaagcuggccagguagauuaggagaccucggacccugugggguggaaaaaauggcaaaguuuuacaggcaaagcagugaccacagcacuacccaggccuaggacugggguaggaucagggcugccggguccauagccaguccccuucccaggacucggugccacagugggguucucauuaacucagaauuccccaaaguggagacauucagcggcucuccuuuuugcuagauauucacaucuuuuacucacuaccuuuuuuuucauguuauuucuaccaguuuauuugcuuuuuguauuuuaaggaaauagaaauaauugcagccaggcccgguggcucaugccuauaaucccagcacuuugggaggcugaggugaguggaucacgaggucaggaguucaagaccagccuggccaagauggugaaacuccaccucuacuaaaaacuacaaaaauuagcugggcgugguggcaggcgccuguaaucccagcuacucgggaggcugagcaggagaauugcuugaaccuggguggcagauauugcagugagccgagaucacgcuacugcacuccagccugagugacagagaccccaucucaaucaaauaauaauaaauaaaaauaaaauaauugcucaucaguguuuucccauugugauucuucucaguccuuggauuaugaaucagauucacaggucacuguguauuaggagauguuauucccauucaaaaacauuguuuuaaaaagaagaaaaacccuuucuucuuaagacugucuuccuguauuugauggacucugcaguugacuccuaaguuacuuaacgcugaaguuaggacauacccuguuaggaucugaccugugccuucuaggggaaagugauuuuuuacuuguaauuuauuguaaguuaugacuaaaugaacaugauguccuauuaaauuuaauauguuccaguauucauuuaaauaaugcgcuuaaauuacuggcauuuggaagugugugcgcacuccguuaauccaguguaauuuuuuuaucaugguuuugcugaauuaggacugaugugaacugucuguguuuuuuaugugcuuaaauauccuccuuuguucuuguccaaacugacacagauuacucucccagaugauucucucuuuugccaaacuuauuucaaaacauuucaaaagagcuagauguggagcccagcgccagguggaccgcggcuguguugcaugcuaggucccugguaaagaaguuaaggauguuacccacacacugagccccucgucucuuuauuuauguuuuccugucucagcccauugcugacuaaggggaaaugaaacauaaacaugagaaaagaugcaugaccaucagagaccauggggccaggaggacuucacagggcagagggguugccuucggcagacuguagagauuguguaguucucaucuacuuuguguuucacggccgcacggcgaguggauggcguggcguuggccugggcucgccucugcugcccauccccagccgugggacauuccggaacugcgaggucucuucccuggaggaagcuccuuggauucagguggaggcuuuagacucuggugagccuaaggaaugugacuauuccagccccugugagucccucccagcggugggggacagaagagagcaggcacccagagcaggagccgcccggagcaggagggaguccucugggaaaagguguggacgcuucugguggcccuagugugcuguccucagccacagaccagaugcugccaggguccucccgaccaaguuucacucccaggggacaucuuagagcuagaaguucaaccugaaugucauugaacuuagaagaaaaagggacaauuugucuuugaaagacuaaaugcuaguuuacauaaaauuguguuuauucuacgguaagaccaauggccagugaggacacagcccugugugcauccuguucaguaagcaacaaaaucugucuugauccuaggguucaguugguggucacugauuugaguuuuguagaaaagggcagugagaauuauagaauauauauauguuaaaaaucgaguagagcuuugaauagcaguugaaacaggcaucaucugcugcguagucgaguucuaagaugagauuagcugauucguaguagaaguugugacauguugcuuauaagccuauauuucuaaggaauuggaagaagucgaugaaaauguuuguucuugaacacauaaaccuaaguuuuuugcccuaucuuugcuuagcagauauuuucuuuauggcaaauauauuuucaauauauaguagaaucaaauguuauucuuuaaaaauguauauacuuuuaaaaauacacaugaacaauaaacuauauacauuuagcuauauauaguuuauuguucauauguuuauuuuaaaaagauuggaaggguauacauuaugauguuacgugugguuaucccugaauaguuggaaaagguguggcuuaaauuuucuuccuuaucuuuucuuggcuuuucuaaauuuguuauaauaaaugcguuugugugugugugugucucacauauauaauagaaaguagggaaaauccuuuaaagcauuguggagagaugcagcaaagaaguaaauauuuucuuuguuaaguaaaauucuaaauaauguaaaauagugauagaaagaaagaacuguuuuuauauuugcuguauuuuuuaccacgugcagcuuuguuagguagauuucaguuuucucuuuauuuuuuagguuguauggcucgacacucaacaucgaccuguuuccggcgcucgugguggaggaccuggugccuggcagccggcugggccccacccugaugugucuucucagcacacaguucaagcgccugcgagauggggacaggugagcacgugcaccagaaaggggagcacgcuccuaagccaccuucuuagggacuccagaggagaagagcuguccugguugagacugagggaggcacgaggcccuagugucuucuguguguccccgguugagaaugaggaaggcacugaggcccugguaucuucugugcaccgccuugggcuuacauguccuugcagccucaaaacucaaccacaccagguucaaugaugcuuuucccaccccuucauuuauaggaauauuucuguuccuguaaaccuguuggacaguccauacagcuaaaccacugugggacuuuagaggaguuugggcuucgggcaagaucuuuguuuuaucucuagucuacuguuauuacuuuacuuuaauguaguggaaaggcagacccuaccuauuacaaacuauuucagcagaccugaaauaacugccaugccaguuuuguuuuguuuuuuuaaaguugcccaucgucuuuguugcuagucagaagagcuaacacugucguucuuuuuuuuuuuuuuuuuuuuuuuuuuugagacagagucuugcucugucacccaggcuggagugcaguggcgcgaucucgacucacugcaagcucugccucccggguucaccccauucuccugccucauccucccgaguagcugggacuacaggugcccaccaccacacccggcuaauuuuuuguaguuuuaguagagaugggguuucacuguguuagccaggauggucucgaucuccugaccucgugauccgcccaccucggccucccaaagugcugggauuacaggcgugagccacugcaccuggccaacacugucauuuuuacaccagauugucugccuuugguuuuguuaugggguaggggaugugagcagugugugaguccauuuuuaagugacaccuaaucaaaccuagugguuucuguauugcugugaacuaagcaggggagauuuuaacucagcuccuagugaccugugagucuccugcccuucucugauccugcuuucauuuugggggauccagguugugguaugagaacccugggguguucuccccggcccagcugacucagaucaagcagacgucgcuggccaggauccuaugcgacaacgcggacaacaucacccgggugcagagcgacguguucaggguggcggaguucccucacggcuacggcagcugugacgagauccccaggguagaccuccggguguggcaggacugcugugaaggugcgugccaggggcaccaugucuguuccuuuuucaucccugguuuuggugacugcuuggcgggugcuuaaugaccugcagaugucauccuaaucuugaaaacugaaaacaaaauauucagcuuuagauuuaaaucgugcuguauccaugcugagauggacugcggagccaaaaauaugaacaaaguuggugauucugaggaauuggcagugcugugggagaacauucagaauaacuaaaacacuaagagaaacagaaacccaggcuucagcaagaugugccccuaauuuuuccuuaaagccuaauguaugucuagcuuccaguacuuguguagccagauaaaagacgaaaaucaaaauauggaagaagcauaucaaauauaucagguuuucuuaaaaguuaaucugaauguuguaaauaucuguaacauaagugacugaagauagauguuaucaaauaucucgugaggagcccugcagguaggagguggucucaugauuggcgcggggggcccuguagcugagggacgcccugauaucaaucccacagccccggcacucgugcccuggagugccagcuccgucuucccugcagaggcgucaguggccugcugugugaggcgaugguucuccuggcugaguuccugcuucgcauuccuaacucccagucuugguuaaccuccauuuccauuacuaauuugaacauaauuuuggcuuuauucaaacuaugaucagauccccauaaaauaccaaacuggggauguuuagaacccaaguuguggagcacucacucuuguggugagagaagcagggcccaccacaauggggggaucuggggaccugcggugagcgugaccgggagguggggccagaucccggccucacccggcaaucuguggagcuuguggugucuguggacacuugguaguuuaagaagagacacacaaaguacagacacuguccacauauucuccaccaccucauuuuuccugaaguaauaguucuggccaagagcuuauuuaauuuaguaagcguugaaaucugcacugauaauagagcuguguuuuagcagcuucuucuaagagagugcgugccucugugucugugugcgacugugggguguguguguggaguguguguaccugugggguguguggggggugugugugaucuaauccugcaucugccuccucaucugcaccccccaccacccacacacacaugcauggaaguauauaugauaggagaauucacauaaaaaauaaaauuaugcuugcuagguacccaauuuuccaaauuauuuacaugcuuguuauuacaucuguuggaaacuuauaucuguuuuuuguuuuauuguuuuguuuuguuuuuguuuuuguuuuauauccucacugguuuauccaauucaaaaugcuuuucuacaagcaugguagaaaauuuguucuguuuguagaaaauuguucucuugaaaaugauuaggaaaagccaaugauacaaaaacccauuuucugauaacuuuaccaggccccuguuagcugcuuauuaagaaguacagccaggcuuucuguucuuuugcuaagaaaauccaaaguccuuugaaagacuucaucuuuaaagccagucuuuguuccccgcauguuacaagccccuccuccucucagggcacugugggagaggcuuagcugcugaagcaauugcugacauuguuucuuccggacacuuuucccucuuaaaauaccaggcauggccuuaagcugacacagcuuagagaauacuugauaagcuuuaccuguuuuuauuuuaccccaaaagccauaucuaaauacagcagaaaaauacgaaaacagaacucagauuugacagaaccaaaugucaauugcuauuuacuuuucaauuaaacuuuuuaaaaagacacauugggggcugggcgguggcacaugccuguaaucucagcacuuugggaggccgaggcagguggaucaccugagguuaggaguucgagacuagccuggccaacguggugaaacccgucucuacaaaaauacaaaaauuagccgggcgugguggcgggcaccuguaaucccagcuacaugggaggcugaggcaggagaauugcuugaacccaagaggcagagguugcagugagcugagaucgugccauuguaccccagccugggcaacaagagugaaacugucucaaaaaaauaaaaaaauaaaaagacacauuuaaagcgaacguccuugagcuacaacuuuucaucauuugcuucguugaugccuacaacaagugcuguguggggucugcacuaggucugggaagccagccugcuccuggcuuggccagccugggcagcacagagcaggugcaggccaggccgcugagcagguguggcccagccgugcccuggggugugaggaagagacggccauccuggagggacggaggucccaucaaagaguucugggguuggggcuggugugcgcuuuggcagggaccccacagugccugggaccguguccuggcccugcugcuucccugucgcccuguaauucuaccagggacccaccccagaccugcacagcccuggguggaccccaccugccagugaggcucauucuugaccccagguguugcugggaggggcugcgguagucugggaggcagcugcuguuuuaugauguauuugugugcccaggaguuuuaagaaacucugcucuucucugcuccugagacgauuuguggguggaagaagcgagggguccagccagcuggguuuacucagaagcuguauaguuaacugcggaaauaaacacauucagugggacuguuugugggcuccgcugugggggcagagggagcuuuaggucucugucuugaagauacucuuuccagccagucagacaaaugcuagaccagaaggagccggccgcccuucaagggagacaggaaagcuagcauggggucugagguguaugcugcacgugccucuucucuucucauagaauuucuacuccaguggcuuccugagacauuagcauuuugcaaagguccauauuugcccuucacuuucgugcucugccacagcuuucuuggguggggaugauguacaagacagacugaacaccccauuacuucguuagauaguguguccacagggcccaggugggacacggcacugagggccccucacucacccggggaccaggagggacacggcacugagggccccucacucacccggggaccaggagggacacggcacugagggccccucacucacccggggaccaggagggacacggcacugagggccccucacucacccggggaccaggagggacacggcacugagggccccucacucacccggggcucaggugaggcauagcacugagggcuucucaguccaccacagguugagaaggaagccacuccuaggcagggagguguuugggcuacauucaggagaagcagggucaggccgccucuugucugacacuggggcuggcagugugacguagggaguguagcauaauuuuaaggcacuccagagugcagauugucaucuggccaucggggagggacccccagaaacagcagacucugaucuccgaggcagagugccugagccuccaucuguggguggagggaacuccgcgagggugugguuagauggcguggugagccuccucagugugcccagcuguccucagggcggccagcaccaggaggucaugagggcuggggcacagguggagagaggcuuggccccucagaccaggagaggguaagagccgcagaccagcugccagguugccucacugaaaugugccacaguuuguuccacgggcagccagugaagacuucauaguuggcaggaugugcuuaauuuccccgaggucagagccuucagagcugacauucugcuuugugcuuccauuuuagacuguaggaccagggggcaguucaaugccuuuuccuaucauuuccgaggcagacggucucuugaguucagcuaccaggaggacaagccgaccaagaaaacaagaccacggaaaauacccagguaugguggucucugaggucaaaugaugugcagaggggcccucgcaccgcgggcgucgggcaguaggaccggcauccugcugugggccuguggcgaggaugguuccuggcagggacgucccagggcacugggggccaggccgcagccugcguccugcugugcugcccacucagagcaucaggggcggugcacacccaggaaaccuugaaaugagacccagcucagagcaucaggggcggugcacacccaggaaaccuugaaaugagacccggcgugaccugccaagguuauauuucccuccuccuccuuuccccucaccacaguguugggagacagggggaacaucucagcaacagcaccucagccuucagcacacgcucagaugcaucugggacaaaugacuucagagaguuuguucuggaaaugcagaagaccaucacagaccucagaacacaggugaggugccuggcggccuguguccccccacuccaagauuccacagcagcacagcccugcccgaaccuucuggguauagcauuuuauucccaggcaacuguucaacugcccacacaggacccagacccuggagccuugggggugucauuucugcacgcugggucaggccgggccaugugccacuggugucccuggguuucccagcagaugggggucaccaggcaggggcaaucugugucacggccgugugacugccagccaggugaccuugcuggagggaacacaggauuaggaugcuguaggagaguucagacaugaaguccuguucuuaagccucuuauucaggaauaacucugaaucaucucucccagggcgugguaaggaggcacuuccaggucagcccuccacaacugauccagccucuccgggugugaggaaaguccuggugucugugguacgaccacagggauuuucagacggggcucuucucuggcgcucuguggaaaugaguucuguccucuccuuccuaucccaggaacuuacuucugcuuucuucagugccugugguggggguuaucucugggauuuuacguaaggggguggagauugagaccuauggcuaaauagaaggaagugcgcucacuccgcugguguggaugggauucccaaggugcgcagguccuggcugucugcagcacauuuaaucuguaagcacagcuccuuuccuacucacaggacucuuagcccuuagguuugggagaaacuuccaucaucuccuaguguagccccaagguaacccccagccacagggagagguacccugacuacuccugugccugcccccucaucccgugcagcugcagguccuccugccucugcagccuugagaccaggugcaaguccccaggcagcugucagaguggacgacauguggcagguccuccugccuccgcaaccuagagaccaggugcaaguccccaggcagcugucagaguggacagcaugccgcaggucuuccucccuccgcagccuagagaccagguguacaucccccaggcagcugucagaguggacagcguguggcagguccuccucccuccacagccuagagaccagguguacaucccccaggcagcugucagaguggacagcguguggcagguccuccugccuccacaaccuagagaccaggugcaaguccccaggcagcugucagaguggacagcgugcggcaggucuuccuccuucugcagccuagagacuagguguacaucgccuggcagcugucagaguggacagcgugcagcaggucuuccucccuccgcagccuagagaccaggugcacaucccccagcagcugucagaguggacagcguguggcaggucuuccuccuucugcagccuagagacuagguguacaucgccuggcagcugucagaguggacagcguguggcaggucuuccucccuccgcagccuagagaccaggugcacaucccccggcagcugcccaaguggacagcaugcaguguucacucagcuccaccuggcacuaggagagaagcagagacaaacccaggcugacccuugggguccgugcuggggccugggugcccuagggggguccacuggggaggggggucugugaaccccaaggucauucagggcaggccuugugcacaggugacccuggacagcauagcagaggcagagggggaccagccaccccaccugugucggcaaauaccaacgcccuaugcccucccauguugcugauucuguccacaaugcuggacuuccuuccacccucaggaugaacgggcagcucccuggguggcagcgcugggucugagaaauguggauguuccuugugauuuugcagcugcugacagcacagggugugugccgucuguggucauuucccugcaccccaugugugcagagguguucguguaucuuggugacugcagaggcacacacaggccggcguggucacugcuucucucuggcugugaauuaaagcaggucagccgcagacacagaggugacaugcaggucaccuggaaccucugcagaccguccuggcugccaccccuaagugcucucuggccccugugccacuguuccugaggcuuccuuuuuuuuuuuuuuucccccaugguuucagcuagaaaguucuaagcuuugauaacuuaagugccaguugcuaaugaaugaggcaugcaggaaagauggcuuucauuuagaagccguaucugaggcauuucccaaagugaguaacuguuuggcuaguuagguccuagauguccagcugucauuaugaaaugcagaugguacggugaggggacguccaccuuuuucagcaugaugugugcauaggugagacacugcugcugcacagguuggggaccacacacuuauggcugacaggagaucaaagaagauguuuuaauugacaugaguaaguggguggcuugcugaaguuauucacagccaucaucagacagccuuaccuguggcugagcaugcuuuaugaaggcuuauuagaagaauugggauauuuaugauaaauaauuuguguucauuucagacaucacagacaguuuagguucaaaugcaagggacggaaaacuccaaauccaggaugguuuuaaugaggugcgaguuuacuuuucccucagucguggagauugcuggacccuccgcagugcagggucccugcugcagcuuggugcuguacuguggguggccucuucccaaggucaccucauggcccaggcauuuccggccacugucacccugucugccccccggcccugcaagaugcaagagaggguuugaggaaggagacccuuccaggaggcuucugcuaccccugugcauggcacagcgguuggaaaggucaccuuguuauggggccccgugcuuccagagaaaagccagugguguuguuacucggaaaauaaggcagacuugacucuggggauucugagugaucaucguucguucugguggaaguguaggugcaggacguucucgucaucugguugaaucuugcucccacaguccucugagaacgucgccuuugugacuacgguuuuuauuugacagcacgguggugggaaugucuuccauuggggcguguggucagcugccgccagucuaauaaggacauuggagauucuguaaaaguucuucagaaauauuccccucaaauguuguuuauuuuaaggcauuauuuucagugaaauaacaucuuuuaauacaagagccaagcuguuacucugaagugcccaaugaaugaauguucuuugcauugcugcagauaaagaaacuugaaucacggcucaguaccacagagugcguggaugccgggggcgaaucucacgccaacaacaccaaguggaaaaaagaugcaugcaccauuugugaaugcaaagugaguauggggggcucuaucuucauguccuaagguauacgcaaguccgagagucccaugugaccacucagguggguggcccagaugucagggccaggccccuccccgccuaccugugcuggccuccaucccuccuucacuccuauggaagcaccaggcaagcccagcucucugugcacagaggacgugcuaggaggcccagaaccucagcaugguccaaccccacagagggcgggcagccccuacucugugcagggccaccuggggcugcuugugugcacuggcuucaccucccaccagcuguggcaggaauacucaugccauggaaacccaugaaugggguagaucagcuccucccugcagagcugguggguaaacacugaccugcccaccacuggcccugucccaucuccagucagagcuggggguguuacagaggucacuggagucccugcaaagggagacugguggcagguggagggugcccuggugccggcaauggacagacgucuggcuggaaccaggcuccguggaaagcuuggggcauagugugaggaggcaggauggggaggacagcgcgccagcccgggcacuucucuugccauggccauugggagaggacgcgcaucagugucccugagcuggucagguuugggaagggcagaccggggaagagcaaagcccugucccuuccccccucucucuagucccauccugcuuccugacaacgcccacccccagacacaguccgaggggauccaggugugaggugggaggauguguccagcugguggucuuggccccucagggugagaggaccgugggcauggacggaagggugggacgggagccucagggagacuuguuaugggggcucccauuaacucauaccugucugcaacuaugaaauccuaagagaaccacaaaauccaugcccacagggcaaguacagcgggcaaggcaggggccucagggcaaggccugacucauggccguggcugacaccugucccggagcugacaggcuuugcucaccugaaggccaucccagagcugacaggcugugcuccgucucucuucuccaggacgggcaggucaccugcuucguggaagcuugccccccugccaccugugcuguccccgugaacaucccaggggccugcuguccagucugcuuacagaagagggcggaggaaaagcccuaggcuccugggaggcuccucagaguuugucugcugugccaucgugagaucggguggccgauggcagggagcugcggacugcagaccaggaaacacccagaacucgugacauuucaugacaacguccagcuggugcuguuacagaaggcagugcaggaggcuuccaaccagagcaucugcggagaaggaggcacagcaggugccugaagggaagcaggcaggaguccuagcuucacguuagacuucucagguuuuuauuuaauucuuuuaaaaugaaaaauuggugcuacuauuaaauugcacaguugaaucauuuaggcgccuaaauugauuuugccucccaacaccauuucuuuuuaaauaaagcaggauaccucuauaugucagccuugccuuguucagaugccaggagccggcagaccugucacccgcagguggggugagucuuggagcugccagaggggcucaccgaaaucgggguuccaucacaagcuauguuuaaaaagaaaauugguguuuggcaaacggaacagaaccuuugaugagagcguucacagggacacugucugggggugcagugcaagcccccggccucuucccugggaaccucugaacuccuccuuccucugggcucucuguaacauuucaccacacgucagcaucuaaucccaagacaaacauucccgcugcucgaagcagcuguauagccugugacucuccgugugucagcuccuuccacaccugauuagaacauucauaagccacauuuagaaacagguuugcuuucagcugucacuugcacacauacugccuaguugugaaccaaaugugaaaaaaccuccuucaucccauuguguaucugauaccugccgagggccaaggguguguguugacaacgccgcucccagccggcccugguugcguccacguccugaacaagagccgcuuccggauggcucuucccaagggaggaggagcucaagugucgggaacugucuaacuucagguugugugagugcguuaaaaaaaaaaaaaaaaaagaaucccuauaccucauuuguauuuuuaaaaugcgugauguuuuaugaaauuguguccauuuuuuagguauuagauauggcagaaaaaccauuuccacuaugcaaaguucuuuuagacgucagugaaaaucaacucucauaccucauggucucucuuuaauugaccaaaaccuuccauuuuucucuaaauacaaagcgaucuguguucugagcaaccuuuccccgaacacacagcuucagugcagcacgcugaccugaguauccaccaugugccaggcacagugcugggcacacgaggcaccaagguccgggccaccugcccgcagcaaggcccagcugaggugguggagggagccccugaggucaggggccguuucgguucaggguggcagguguccagcacugggguauggcgucgaggcuuccauggggugggggaggccagcuuccuucugacaggaugggcgcauacagugccuggugugauuugugcacaacccguguuccaggugcacauccucccaaggagacacccagacccuuccagcacgggccggccaaguugcugcggcggaggcagcauuucagcugugaggaaggucauuggauucauguguuuuaucuguaaaaaugguugucuuaacuucuuaaccucauauugguaagugauugauaaaaauugguugguguuucaugacauguggacuucuuuugaaauagcaagucaaauguagugaccaaauuguggaagagauuucugucaaauaggaaauguguaaguucgucuaaaagcugaugguuauguaaguugcucaggcacucagaugacagcagauucuggguucugggaguguucugugccucuuacaugcccuggaggccucauggucucagugcugaggcggcacaccuguagcacaccugcguaaugugcggucugggccagucacaaggaauuguguugucuaagccaaagggggaagcugacugugauuuaccaaaaaaaauucuguaauucaaaccaaaaugucugcggaaucaccaguuugauacucucuguaaucagaacagugggcagugccugggugaacgugucuagcagccacugugcgggaucgcuguaacaggaguggaauguacauauuuauuuacuuuucuaacugcuccaacagccaaaugccuuuuuuaugaccauuguauucaguucauuaccaaagaaauguuugcacuuuguaaugaugccuuucaguucaaauaaaugggucacauuuucaaaugga

SEQ ID NO: 192351 - RNA, 10036 nt, Homo sapiens
aguguuugcaagucagucaucauaguggcagcuuccgccugcuacaggauauuuauauauggaagcauaccauggcaggagugcuggaaagguggugucagcuaacaguugcuucagccagauaaggacgguaacuucaguccaauaaaaaccucaucaguuaccaacuaaaucagggcaugguguuuuuuuguuguuuucuuuuuaaagcauaguuuuaguaauauauuuacuaaaaaccuuagacauuaugaaaaaagucaggauuuggaaucuuacacugcuuggcuaaauugacacaauauagaccaacaguuucauccuggggcuuaugggucucauaggagcacccguaugcugaagaaaggcaaagagagaacuacagaauuuguagaaaaguuuuguuguaguugcuucugaacaauuaguuuuuguuuguuuguuuuguuuuguuuuguuuuucugguaaccuagcagucaaagcucacauuuuuguaaguaauuugcaugcuauuacucuacugagacugaauuaugauucucgagucugggaaguuuuuguugcaugugcucuguguuuuucauuuuugauagaaaugauuuagacuugauuuuaaaaauuacuuccugaaugugaagaggcauugacugggaaaugaaauuaaagaacaaauuaccaugacucauucaauaacacugcuuauuagcuuugaauuaugcccuauuauaacaauucugauuuuguggcaagcaauacuggugugaguuauuucugugguuugauaccaagcaccugccugguuaaaaaauaaagcaccaggcaauuuuucauagacaauuaucuuuauuuguuggaauauuuauuuguaaauagucaaagaauucuuaaaugacaaaaaaucaacuguuagcagugaucuaaaccagaggaaaaugaaauuacuuacauguuuccagucaagguauaagaaaggguucuguuaaagggaugcugcuuuagccaaucuuggugaauaagcaaauuugcacacuggaguugaaaggagggucaaguuagugugaugaagaauugcuaguaacacuggcuucuccagccuugcugguuguuccuagaugcccucauuuggagaugccaaagauagcaacuacugggugucaaacagccguggggccugguuuuaaggccaugugaucuuguaucccuuuacuagcagccucaugagucauuugcaagucauuugcaggcucuuggagcccuggaacagcacccaacucaguuuucucugcuaguucuuuauuuuuccauuugcguguugcagcucauuaaaaaaauauuggaauagcauauauuuacauugugacuucacucuaaagaagacauuuucuuucaaagcacgucauggcucacuagguuguugucuuaguuuuuuuuggagucaccuuuugaguagauagcaagaccaguaauauggagauuuuauuagcuguacucuuaaagucaguuuuuguggccaugauuuucuagcuaggucucuauuuuguaaacauugauuaagccucaguaugaaauugaagcaacagcagauacauuccugaaggggaagcuaaggcucaaggcuauuaagucagagauccaaaaaugaaccaugcuucaguuaccacaccuaaaauagaagcugugugcagaacagugguccugugaugugacacauaaaacuuuuuuuccuggucacauauuacuguuuggucaaauauuaguauaaauggaugauaaaauaugaaacacaucuaaaagaauuguuuuaaaaucugugacuaugcaugagugaauauuuuggggccuugguuuuaacugcaaaaggauaagauuugacugaccucuaaggcccuuuuacucuauuugcugcugcuuuuuaauuuuuuuuaauugucauaucaagucauuuccuuaggaaugcucuaugaaguauauuuggaauucaguaaugucaauaaagugcuaugguaguaucuuaucugaaaacucagggaauuguuuguucuuguuaauuaaaauuucaagauaagugaaacacacuuuuuuaguuuuaacccuaaaaaaaauuuuuaguccaugacuuuuugagcucacuuucuuagcuaggguucugguagcacauuuuucacaaguaccaguaguuuuagguauuacugggaaauuguuuuuuuaauauuuuagacuaaguuuaaauugcucaguaagugucugauacuuuuuuuccccacaucuucuuuagguguauacuuuuuuuuuuuuuuuaugaauuugguuucucccaacucuauauugcucuucauucuguagaugaguuuuaaaggaaauuuuugcaacaacagaaaguaaacaguguguugucaaauacacacaggcaccauauuuaucgcauugacuuuacuagaguccagauagacaucacaugaggauuuuuauccucaaucuuauuucuguucauguacuuauuauuaacugccuccaauucuuuugaaaauggugagauuuaaauccuaaauaaacauuucagguguuccaucuuaacauaagucaccaacuucuaaaccuggcacugggcauuugaagaauaggauucgucccuacucuaaggaguuuucagucuaucgggaaaucaaagauguaagcaaauagaugcaauaaaauacuacagauguucugauagaagaauguaaagaauccagcaaaggcaaaaggaaagacagguugguucucucuuccuaggggaagugauguuugagcugagucuugaggcaggauuaggaagggauauagaaaagaaaaguagcacaaagcaagacucauugaaugcugaacaaaaggcccgauuccagcucugcugccaggcaaaugugugauccugggcauuuaccucgccgagcuuccauuuccucauuugcggaaaggaugggaacuaaagcacaucuaacacccuuucuagauccaaacauccucuaucacgauuagacuugauaaccaugaaaggaaaagcuuuuauaguaauugaaauuugucuuucuagaggcuucuuuucacauaauuaaauggccacaaguucucuguugugcuagagauacaucuccacauaaaccuuuuaaacucuucaggauuuucaguguugcuugcaguugugcugucguuagagaauauuacuuucaauauuuaauaaaccucaagcuauuacauaagugaccucagucuaagggaaacccagguggaagagaucucagagguccugaagucuagcagcauuccucucuauagcagcuaaguuugcuaagauuguugucuuggggacucacagucagcaucuuauggcuaaaggaauugugugaagagaaggacuuacaugccauauggagggaggcuauaaaaauugcaauuuucuauuaaagccuccugcaauuagaaugguucaugguaauauucucuuuuuucagaauguuuuguggccacugcugacuagcuuaauuuugucuaccuagucuucuugcacaaaggauuugaggcaucucaccagaaugugaacaauguaauaaaagaaaaauuuuaaaauuaguuacaaaauaaaaacagauccagggaaaauauaggcagaacugagacaucugaggaggagaaaagaguguuugcagauaagcaggguauacauggauguacaauucuuaaaauugggccacacauuugacugugagcuuccuggcaagcaaagcaaaaagaacgauuacaaagugguccacagaaggaaauauuuuuuucuggauaagccaaguucucuagagccuuaguugaaaauacuauuugugggugguucuucauaggccugucuggcuuccugguggcugugguucuugugaaguugaguucacaagcccaaccucuuguuuuuaacaucaguguuuucuuccagggacaaugacucauucuucccaggacacugguucuuguggcauucaggaagauggaaagcuuuaugugguggauuccauaaaugacuuaaacaaacuaaaccucuguccagccggaucgcagcaucuguuccguaugugugcuggggaaggcacagcagcccuuccuagcuucuaggcuaccuaaaaauagccacugcugacuggaugugugggugugguggagggggagggggcauuaggaagagguuggcacuggaaauguuauuuguuguugggcaauuuugcuuuuguuuucugaauacuugacaggauuaugggcuuucuuggauccuacacgagauuugaacucuugacuucaaauauucugagauccuguggcguuucugucccuggaaagggguggagccugcagagcuggacuccuggaggcuggcucaucccucuccuagugaccauggcuagguuaccgauggggaccacuucccacaggaguguuguuuuauagcagauugcugagagaaugcucaauccagagcauuuucuacuuacaaguuacaaauugugcaauuaaggguuggagaaaggggguggggggagcaaaauaaaaucugcuaaauacuaaguguguaucuugccuccuaaauauuauaaaugagcuuuaucagaucacucugagugccaucuuuucuagcuuaaaugcugacauucaaacaccaguguuaauugcucacuugccauuuguuucauaugcacucuaaacuuacuguuccaauuuuauaucuauuauuuccugucuaaauccuuuccaaguuccuccuuuuuuucuucauuuuaauaaguucaaauuuucaucuguuuuuauugcugucagucucaauagcaguagaaguuuaggugucagcccuaugcuguugcuuugauuaggaagcaaaaguggcugaagcguauggcauaggauguacuuauaaggcaugggacauaagccacccaucuguccauaaucaaguggcacagugagugggaccaauucaacguaggagaguaugcaaaaaguaauccagugaucuccacuaccccagguuucugcguugcuuauucacugcaacaaauaaucuggguguuauuaggcaacuagaucuugcaaaacggugauuaaaugcagucaauucuugguuugagugaaccaagcugucgauaaaauguagcugcauucucaguucaacugcaaagcauuuaaaagaacguugcuuccagagcauauccauccagaagacagcuuuaaaaaaccaaaauaggucagggccauuuuuguuuaaauggauguaggcuuaacugauuauuccuauaauaaaagaaguuuccagggaaauaucccagagcauucaauugagucuuccacccagcauagguaucccacaaccagcucuguuuuacuccuggguuacuuugggaaaggguaauagaacuucuaucacucuuagccuuuaacuucuauauucccucuccccacacacaaaaauucauguucugcuauuucaguguuaagacagucuucaaagaacuuuccaaagaggucuaaggagauagcuuaacccugcuuauuccuugaauaccaauagagaagaagguaaauaauucacaaauuucucugugcccaaagacauuccuaaaacagaagucacggccgggcgccguggcucacgccuguaaucccagcacuuugggaggccgaggagggcagaucaugaggucaggagauugagaccauccuggauaucauggugaaaccccaucucuacuaaaaauacaaaaacuuagcgggacgugguggcgggggccuguagucccagcuacucgggaggcugaggcaggagaauggcgugaacccgggaggcagagguugcagugagccgagaucaagccacugcacuccagccugguugacagagcaagacucugucucaaaaaaaaagagucacuuucuaggcuugucagagagaaaguggguguguccauuacucacggucuaacacugggguacuguucaguucugcugacaaguuguaugcugagcaguuuuuguccuuguuuuuuguuuguuucauauuagcucuagaggacaaaaucccaguccuuggcacaaacucaggaaauggaagccggagucuguuuuuuguggggcugcuaauugugcugauugucagccuggcacugguuuuuuucgugauauuucuaauagguaaguaccaccacagguuucuuuuuuauuacuuguaugcauuuauucauagcugguuaacuuugcucccacaaaguuugcacccuccagucaaugcuuccuggucaucaaugcuuacauugaaaaaagaaggaaugccuugagugaacaccacuggcugaggacagggucccuuggccacaaacccacugcagaagcccauagugccagaaguccaugaauauguauguuaaauaauucuauagcacuuuaguuucucacuuggagccucuagcugcccaauggaaggcaacuuauucugguugauucuagcuuuacuuuauccaaugccuagauuucuccacuaaauucagaucuauaacaucgaaacauugagguuucgaacugaacucgcucccagguuuucucacuugcauaucauccuagacaucaaugagaagcacuugagggcuugugcaaggccccagagacaguguuggagauguauaaagguggcuucuuuccaauuugauccuguccaggcaaccuacuccuaauauaaccugcuuugucugcucuuggccugggccaugcaugucgugaccuugaguggugacucaggcuuccccaccucagcuucucagucaagagauccuucaagccuucagcgccacccuccucucugccuuggaugugggaggggugcuguccaccugcggugcugucuucccguucugagcguugccucuucccacagagcccaccaguuuccucucucaucuggaauuauuuugauucucuuccagaugacuuaagagcagacagagccuaagggaaggugucaucuuugauaccuuuuugccugggugcacugcacugucauuucuuucacccuugagugcuuuguagccuuuggaagggcucuaauuuaauuucauucaggauuagaggaggcagaggugaugaugacgaugagagaagacaggugggcagaguucaugaugacccuuucaccgcuuccaaucccauuuccucccccaaagacuccucccuccuuacagcuugaaggucuuuaucuagccucuggagaaaaggguugggacugggagggaggggucauguuuaauugcuucucuugcaccgggcugaugaccuuuugcauuuagaagcuaacauguguacuauuuuuacaauaguugcaaacuugcaucugaugaugaauuaggggaggcuuggcuacugaaccagcaaugccagaaagagcacaugcgcuaguauucugaaccguuacuccaacauaaauuaauacugggcaugucauccugccacacccgccuggggguaaugacggaguuaaacuauuaggaaauuuuagguaugucuacagacauguaaacaacccucugccaaauucuuuuuuucugugagauaaguagcaagauugagggaaauaauaccaaaugcuauauauugagucauuacucugucccagacacugugcuaagcccuugauaccucuuugcucacaaccucauaacaacucuguaguguagaauccauuauuauuauuauuauuauuuuuauuuuuaagaugaaaucucacuguugcccaggcuggagugcaguggcgugaucucagcucacugcaaugccaccuccagguucaagcgauucuccugccucagccucccaaguagcugggacuacaggugugagccgccaugcccagcuaauuuuuguauuuuuaguagagaugggguuucaccauguuggccaggcuggucucgaaaucuggaccucaggugauccucccgccuuggccuuccaaagugcugggauuauaggcgugagccaccgugcccagccaaauccauuauuauuuugguuuuaccagugcugaaacugagauuuagagagaucuauuaaugugcccaaggucacguugcuaauaagugccaaaauggggcucaaggauacuccacuugacaucaaagacuauguacuuuaucaacaucacuauguuccacuuuuaugaauagcuuuuauuuuauauuugccuugaguguuuuuuauugagaacaaagucauauuaaaugagaaacagaaagaucaggugaauaaagaagaguguuuuuuuacuggauaauugcucuguguuagauacauuaaguuuauuaucuuaaauccuuccucuagccaucuuagaaaauuuaacucugauaagcaaaccucaaaguguuccauuccguaucuuauugccaaagguccuguguauuuggaaaauauuguucuuccauucuaauggguggucugagggggaauuauuacacauucauuuugggcugguaauucagaacaagcagacuuaugucaaaauaggcuggaacccaaagaauguaauuucucaaaugagcaaaaaccuuuuucugagaaugggucucaaaauaaagcaacauagcaaucacuucugggaggauaaucaaacaugcugacagcuuccuuugguugcucacagcaaggucuuuuuuagccauaauuggugugaaguugccaaagguagucuagguuggcaccaagagauuguaaaaacaauucacuggauaggcaacuucagccuucaccaguuucucuacugggcuucuggcaugcauggauaugggaacaggggauuugccaagagugucuuucagcaucagcugagcaccaacauggggaucugaugaauuucaguggaacacaguggaaaccaauguaacacagucuguuuucuguuuugaaguucaaacuggaaacaagauggaugaugugucaagaagacuaacagcugaaggaaaagacauagaugaucuuaagagaaucaauaacaugaucguaaagcgacucaaccaacucaaccaacuggacucugaacaaaacuaaaggaaugauuuucugaaagcaccugcuaacaccuugagcuuuuuacuuuccugggaguguacaggguuaggaacugagaaagugcacuuccucaggcaacagaugaucuggucaggcaacccaccccuggggcccacuuucugcagcaagaugggagcaauuccaaggcaaguggguaugggaauagcaacuaaaaaggggugaacuugucucagcccccuuuuaugguagggcacuucaacuuuaauggggugggcggcuagcagggaggagaaucaacaaagcaagagaacuugacuauguacguccaacuucuuacagaaggagcuuugcuaccagaacaaguucacugugucaaugaaguucaugacaccucaugcaccuuuacagauaucugggaaagccugagaaauucauugaguuuuauguauugaagggaaccaggugauuacucuuuucaauaagagggauucugcucaggugauuagacuuugacucuauuuccccagggacagugaugggugggccccagagcuaguugcugucugguguuugcuggugaaaacaugagcaguaguuauguggggcugagagucaaaagggaaagccuaauuaauucaacuaauguuuauuaagcuccuacucugugcaaaucacucuacucaagaggagcucacauaagagugcaggauaaagaaaggagauggacaguuauauguaauuauauaaacuuuguguauuuuguuucucaugaaaaaaccccuuuggcacccugcugauugauuuggaagaaaucugauagauuuguggccuuuccuaaauugcacuaggaaauuauguaguuagaauauuuggaaccugcauuaguuccagcaaugaaaguaagacacacagcauaugacauaagacacagugugaaauaaaugaguuuaaaaagca
